United States Patent 10,407,724 (METHODS AND COMPOSITIONS FOR SCREENING AND TREATING DEVELOPMENTAL DISORDERS) - sequence listing, part 87

SEQ ID NO: 2582 - DNA, 1162912 bp, Homo sapiens
gaacgtttgtttcatattttattgaatttcatttatattaaattaaaaatatatttctgacagattcatgtaacaaaaaggcagaacagttttcaaattgttcagctgggatgatcagtatggaatgaggcaaagcagttcgcattctataattgccttgtacaggtacaattctttcccaagagccaaaagaggatccttgagaactaacggaaaagcctaattacataaatgtaaaatactgtttctccctcattctcaaataacaacaggaatgagggaaaggaaggaggatgggtaaaaggttggaggagaagaaagaataagagaaagtatactaaaaatatgcctaacattaaaaaagttagtatgtgttaggtgcatgatccttcatcaataacatggaaaaaaatcaaaataacattacaccacacacaattggcatatcctattgtgtaagcgagtgcagaggttgaacacatcacaatagtgctgaacacagaatcacaagtaatgtcaaaatgataacttccaaccaaaaaagaaacaatcacaggccaattacttatatacaaatcaaccctaaagacaattatgttccaaataaagatgtccacaaaagaaaatcaaagcaacattatacttatttacaaatgcaactagccatgtctttaacaagctataaaaatactattcacattttcaaacatacagtagtattttttgtttgtttatttcaaaaaggcagctaactttgaatgcagggatttaaataaaacattgatggcttaccagcaaggtatttttgcaccccaatcctttgaagatacttcacaagagagagggcttgttttctgcttacaagttaagaaaataaggaagtgagtacaaatgtatacaccttaagcctctgccttttcagtaaagtgactccctctctcacccaaactgatgtcagtaaattactttgatgcatgtataagatgaatgtttgagagtagatttaagatgactttttttgtgctatgaattgtcttccacattgatctcattttcatttgatcttcttgtaatggtgctcaagaaagagatgaactagtcatacaccatgggaaaatgcggtttcagcatgcagccacgcaatccctggtgctctcaacatgagaaggagacacaccagccagggagacaggcattcaaagttagctgccctcacacagctgctccgtttaataatcgacccatttaacagcagtaccagtttatgctacatatttcaaagtaccttactttaaaagaacaccttacatatctacatttagaaaataactttcgtagttgattactggagtaatcccaaaagggttcttggagtgctatggttgtagtcccctcactcccccctcccagcccctgagagatccagaaatatacaggaaaatgactctcacattaagggaaaaggacaacccccaattaactaaaaaatctggaaatgacatttgaaaaccagattcgtgtcaatatacaggaggtatgatttgctttccttcacaaaggctataggcctgggggaaatatctacgcattggggataaaaatagcagtaaaggcaaagtggtttggacaagttagactattgcctacaggtatgaatctttgttttcctatatttgtatatttgcacaaatataaccacttctcatgatatagggaaagctcactagagcatgaaaagaaaaacgtccataaagagcaaaagtaggtaaaggatggcattctattaaacaacatggattttcattaacatgaactgtcctcattatgtatttgttagatggatgaatgatccaaaaaagaattgcaggtggttatcaaagctgaatagcctttacctttatgataataagactcctcatttgggagaaaaaaatttacagcagctacaaaatatttacgattaggaaccaaataagatgaataaagcaaataagttaatttactggcaaaaataacttcttggttatatgtacagcttttatgtaaagattaaatcgaagttctaccaagtgtatgtggacatatgtgagtttcaagattcatcacagggctaactcgtctcaaattcctatagggaaggacacagagaattgatcttcatgggaaaccataattttaatagcttaaatattctctatgcggtagtttgatagttcacttaaacagtgtccaaattgctagaatctcttatgaaaaaatcaggcattcgagggcaaagatgaagtcagtgtttcacaaagtggggtgtaggatctcagagatccactatggcttaagaaaggaacaggacagcatcgggggactactttgaaccagggtggtagaaagggaagagagcagtgccagttgtgtcaatgggcaaaaaagggaaggattctattttcctctaaaggtcagagagaaatacatttttctttgattcctaacaaggtaatcacttacttgcaaagctgactgtcaaagagtattttccagaggaagcatgtgaataccccccgtgaaattggggcttagagtcattttagcttgtgactatagaagcatttacttctgcccaaaatgtcacctggccaggaattaggtgaggcaggggcctgcaaaagtgacagatcctacatttttggacctctacaaaatcagtgagacttgaaccgagtatctgaaatttctattattttagagagacttttaatgaaaagaaaaaagcagctcacactgctaaaagatatttgcccacacaaacacaagggcccctggcccgacacaatgcccacaacagcttcttgtttccaactgcagagagaactcagatctctgggatcagaaaaattttattaattctacccagaagtataaaaactggccccattgtaatatcagtaataatgaggtctccactgataatgatcttttaaaattatgcctgatctcatctgtataatatttgttcttaagcaaatagcaaccaggcgataccaatctgcatttatatgtttacatggggcaaggctgtccttcaaactgatacacaccgaagtccatgtacacaaacagaggcacagtaagatcctctgcccacagtatatacagtagaagttaatttatctgtttctttttttttttttaacaactagaagctgatgttgtaggatcagctctaggatcctctgcccacagtatacagtagaagttaatttatctggtttttttaacaactagaagctgatgcacatggatttctcatttgccctataacaatcatcattctaataactaaagtccaaaagaatggcaatgcaatagtttgaaacgcttggtttagcatttatttatcagaaaaattgtgattctttgttgtcatttttggaggcaagagggcatagtgagaaaagaaaggacatatcaccaattaactgtattttgtttgtttgctagctaaatgacaccactcctttttttttttgtctctgcataaggtaatagaacatttacattttctttacttcatcttgaagacccttacttagtcatatgtaacatgtttgcctattaaattctgcaaggtggtgtttatttaaaaaaataaataaatacaattttctttacatttaaaaagtgataaaggaataagagaatgagaaaaaattgttcattgtaatgctttaaagcaagttttcccaagtggaaccatatatgcctactttcagctaaacccaacaaacaacaattttaaatggcaaacttatctttttactatgcaaaatccatcctacatttttatatcctgcatttaactttgttacattatacttgtggttagttttctagtttgatttatttaataatattaaaatcatttaacatctgataacctaactaaatctacatcttatagcattatcgtggttctgtccagttatatacatgctttcatgatcaccttttctattaccttatgaactacatatactagttaaattatcaacaattacagatggatgaataattccagttttgaaataaaggttagagagctctagaaaaacttgtatttacatccttccctgtcaggcttaaacaattttaattttcttttcatttttgatacttcaagaagcacattaatagtccttccaacttcatctagtagcagagcctcacacagtccttttcttgatttttccttagcattgtaagtatgcacaatcttcatgccatgtctttcctttagaaggtattagctcacacactataacacttaaacactattccttctcttaaattagatattcagtccttctccctaatctacaaaaaagaatcacttgattttagtttgtgtgttttaatagaaatttgagttttgcgttgtttttcatgctattttaagaatgttactggagaaaggattctcatcctaagctgtgctactaatactatgcagaaaaccaggagctgcttggtagtctaacaccttttgtggtgcagatgctttgtggttctggatctatcctagatcagaggccatctttcctcacctgtttaccactttctttaggcaatcatttaactgcaaaatttttccatacctgcccaaaataggtataatctacaaagttgggtgatttaaaaaatatactccgtgtaattttaatactaatttgtctcagatttacataattgattctgcaaatttcaattgctacaattggcctctggaatctgatatccccccaagcactttgaagactttaactgacattttaaaattctaccctactggactaaataagttattctctggaaggaatgaaactttttttctccctcttatacatgctgaaatatgttttcccaggggggacaaaaataaaacaaaaaacactcaaacaactgaagtcaattatatactacagaaatcattcaaaagaattataaagtggtgctattataaagcatttgggtcattttggattattcctacatgcatctctaggtattacccaacatgtagaagtcttgtgttcttaggaggaaagagacattcactaaatacatttctgttaccttaacagttaaaagtttgttttaactattcattttttccttctccaaaatgagtgattctgctttctatagcccagtagaaaccatatgcatattgtaaatcagaaaaaaaaaatcaaggtatagtatccaaaaagagggctgtgatgactcgatgcagatttatttagaaagggaggcttatattcaatttttcataagtactgatatgagatcccttttcctagagacttctctgaatggataggagagccctgagctattagattgtggcccctgaatcactctgtgtctttacccctgaaaagtttgagggtgaacttcactagaaggaatctcacaaacccttctcctgctctaccatactttttcagctcgcctcacttcttatagcttagaaaaaaaccaactccaatgtctccaatattcttggccaaggaccaccatctgcttttggtttaatggtgaagttagactctagataggctaattagtcagtgatgcaatattctcctagaccagtttatgtttgaataatattattgaaattatcctgtttgtcaacatcaacaatttgaaggatgtttaacttatatcccaaatgagtttaaaggagatatcttacagtacaactgattatatgacagctattcacaaaagagactatgcaatctgattgttggaacgcatagaaaaattaaaatgtcattttaattaaatctcctagatcatagaattttgaagttgaggatgatattccatttatctgagtgttccccacaaaacatggtgcttttagtagacacagttagataaaggaggtttggatggatggatggatggatttacttgttcagaataggaagaaacacaaatttctttggatttttttctctaaactttctctgccttaatagatatttttactctaattaattaatcttatactattgattctaatttggtcccaatattttaacattagaaatattttttaaaaatctaaatgacttggggtagaattttcagaaaagggcgacttatatctaagtttcctaattattgatgtgaggccccctttacttggagactcatctctgtcatttgttctcatccttcatctcatcaggtattctttcaaaatgatacataataatgatggttctagtactggatgcagtatatgaagaaagggaattatataaagtatcaaaagattagtgtgttggataataaaataattgcatgagaagatgtttcacatttatttacaacttttgacccaaggacctatccctaagctttgaatgtttgtgtttttctttttattataccaatttatgtgcaaagagttaccttctacttcatataaatagtctcatactagaaattccatggaattcaagccaatccttactcgcattccttcttacgaagtatacgaactgaacaaatttccttgcgtagcaaaggtgacatatgaagataatgtgctggcctctcatcatagtccctggataccgttgcaaggttcctaatttgcttggtttggcatttccacagtctttatcttagctctttttttaaaaatgtacttaaattagttaatttgctggttgcttccatattgcttgattcaaaatccaaaatggagttcagaaaaagaacaaataaaattacagcttaagtgcaaactacatttctgagtatctgccaggtagacatacccaatccagtgtgtttcttccagttcaatggattccctcattgggccacccctgaaagtatcagtagttttcctgaaccacagagaactgtctcttagtttcccttctactcttcagacaaccaacggcctatcaagtagtgtcatttatggagaaaaaaaaatgttgaaaaatgtaaaggatgagggtgaagataatttgatagcatgaaaaatattagcctccctttcttattttaaagattgtatacttaaagtagtggccatttcactatattaaaatatttcttgcttaaattctgtgaagaagctttgatgtaaacatctttgcaattagaaattaaagccaaaaataggggagcaaatataaaggaatcggtcagagcaaaacaaaatgaaaaaaaccaaaaagtgttgaaaacataattactagttataactttaatggagatttttaaattatgaaagttgagttggccattcttacttgctaggacagaaactgctggggaaagaaactggattctcaatttcagacaccatcatatgttatagaaaatgttattcttttgttctaatggaaactttattatgatttccagggatgctaaatatgcacacatcagttcctgcagataggaacagatagcatgggtgtttcaaccatctgctttaaaaaaaaaaaaaaaaaagaagaggaagaaagaaacaaagaaagaaaaagaaaaagaaaaaaagtgacagctagtttgatagtaggcagcattgccttacattttctggtccttctctagctgtttcattctcctgaccaacccatgcagagaaatgaagaaacattgtggttcctcctatctttctctttcagtctttccctctaatgttcaagttaggtaagcacataactatcattgcatctctgtatcttccactgggaagtgtcaaaactactggccttggggtagaaggaagaccaccagagaaagagaggggggtggggaaattggagcaggtgtgtctctccacctaaaaaaccacaactgagcttacaccacagtattccggtgtctgtaaggtggaggcggcagcacagtgcctggcttcagggagaactcagagaggtattcaggattctctgccacaataggccggatccgcccattctgtttataaaaatattttgtgctgtactcctgcaggtagtctgggtgctgaagggtgctccgaggtggcaggctgtggttccagtagtcagggttgtcaaacgctttcttggccttctctggcattgacagtatgttgttcttcaggtactcagcttttcccaaggtgttggcaaaggtgttgaggtacagtggctcattcacatactcatcctcggccttgggtggaccattggatgcattgtgatattcgggattatccaatgcttgaaggtctccattttttctccgagaaacaaaagggttctcctccactggattcaggtattctaaaggaataaaaaaatatcagctaacctctagtttctggaaaatattaatcagaccaaggttatacataatggttagcttctttgtctagaacaaaaaaacccacagatttgttttcatgatttctcacaacaagtatttgtggatcaccattgtcttatgaaaaaaagagtaagtgggtcaaaaatgtttataataaaacaagaagccaacgaggccagaatcagaatttctatctcctaaatttttctttctttctaattgcatttgtctcttctgcatatggggctggttgtttcaatgtttttgttttctaaaagttatttatattaggaaataagactacctattaggattaaatagtctttaaatatacagacaacttaacttctataaaggatattgaaaaaacaagaatctatagctgagttccatgccaagatgaatagatggagtgaagaaatcatgttttttagtctctatggtttgctatgattgcctatactggtaacaaggatttaattggagatgcttctgaaaaaggttttacacatggaaaagaaagcatcaaaggaaaaaaattcaactaaaaaagcaaatctaacagatagctaacatgcctctagttgacctgcttgacattacatatacttctacttaatagtaaagtataattataatatttccattgaccaatcataatcacaaagtagcaaactatcagcttgaattatataaaataaaataaattttgtatattgaaaccagtcaattagtgcctattttgtacggatcaatctaataaatccatctagtataggtattggcctaaaaggtgctaataattatcaccattctcctgaagcttaattccacatctatgtctataatatagactgcacatagacataaacacgcatgtattgtaagtcctctgacagtcctctcttttactatatacacaaagccctaagctattcctattttgaattcaaggcatgaagagggcacaattctttgttgagaggccattctgaaacaaactttctgtcttttatccttagcccaataagtagagagaaaaatcctattaagtgaggattatttttctccaaatatatatatacagaataggtaagtatttagcatcatttattcaacttaaagggcagtaatgaatatcccactatcatatataggcctttacaagacactatcatttcatcctcccaattctgtgaaaaagaagtacaagacttatttttccagctttgtagacagaaaaatgagattaaatgatgtgtgcaggatacaattagtgttgggatagaattcaggtcttctaactcctcttgcataatcttcttattctactgcactgttttttattattgcccctgcaggagttgggtgaactttatgcttagtaacaagttttaatttgacaagtgtatgaaaacatttataaggaatgcagaatttggtctctcttaccagattccttaaacttcttaattgaaagaataggaatgtctacactaaaattctgtactctctgagtacgaggttagactatagcaaccttttatagaaacggagcttagtgttcagagataaaatctgagaatacagtgtgactctatagggtgacttgcttttctcttcaccttacctttcctcaatgcaatctacttatatattgtcctcatgcaaacttatatagctgtccaataactttacggttggagtgaaaatctccccagaaaagattcttctttggggtgaatctgccaagtcttcacaacgtctacatttgtgtcattactaggctactatgagcatccaaactcttcattacatttttatatgtatagaagttttagatatgtaaaaattttatctagacagatatattttaaaaggttatttacaattagagatctctaaattttactttaaaggagagaacataaccatataccaggcccttctcagagtcttaaaatgtagtttactgttgacactaaagactgcgagagacatgatcatcattttttaataacaatcatctatcttctctgttgtgatactgttagcatagaagaagaaaggctgttttgttgcaaaattgaagcattatttgatttgggtgcttaacatttctactactaactttacaaaattattgttatgctttgtaaaaccacagattattattttcaaatcttggtggtatgcttgtaagtatatacagggtcaaacctttaatttttgaaaaacgtcatataagaacataatattttcctataataaactaggttgtttaaatgtcatcatttaaatgagtcaaacaaatcttttattagtgccatcaaaagcatcaggcacttttgccaacaataccagtctttctgatctccgcaattaagtccaataaagctatggtcctgacactttgtagtatgctacttcattcaaatatttcaacaaaatatgtttagaatagtgcttctcaagactgattgctgtatgcagatagcctggggatcttgttaaaatccagattcctattcagacggggcctgcctgagattctgatttatataaataataataaataatgtggatgctgctgattcagggaccatactacaagtagcagtagcctaggcctttactggatcacaaatgttgtgctggtcagctatctggcaatttctattctgtactttgtttatcttgatggaagtgaacttcgaatggcgatcgtttctgaataatcagttcataccttgtttgggtttgtctcgcataggagtcatgtaaccttcctcatccagctctcctcgtgggctccgttctggggcaaacacggtggggtcagcactgtacctctgggtgctactgtcctcttggacatggggtgccactggcttgcgtagggtgccattacagcaggagtcatcaaaaatctcagcagtagcaccctgtgccacaggagcttctggaattgtgctagttggggctctgtagggcacagacactccttgttcagcagcaaaacctccatctcggtatacaaactggttctgttaataagagaaacatatgtggagagaaggcgttgttagaaatagtttaaaaatgaatgttaatagccacaaggatatcaaagccagtctttcagagaatagtcatagtatttactggttttttttcccctagtggctaatggagttacaaactataaacacctaaaatttccacttttcttaaaagataaatcatcagaaaataattttgaaatacacattctagttttattaaccaactgaaacatattctaataaaatgtatttgatgcccttttcccacaagtgcctatatttaatacaaatttcaaagtgaatttttatgataaatgcaagtgtcattaattatagacagttgtcattaagaatagaagtacatggatatattttgaataatcctatgtctttattcccttcgaaaattctgtggttattatgaatttgaggctctagtacctaactagaggatcatcactataattctgactttttagtacatgaccaataatcagggaagtaaagatcacctccacatccagaagcataatttatgtgcccaggtaaatccttcagataaaaattgaaagctactgttgatgcatgatatctcaatttcggattatcagctgagataaaaacacatctacaaaggcagctacacgatgtacaccaaattcttaactcactgttggcaaaggcaaaatgaggaaattatgcagagacgagagaggaaacatggtaagcaaagaccgaaaatcctaaaagatgaaggttgattgtgaaatacttactcctgacatgggggtgtaggcaggaggagggctgtgtccaatttcactctaataggaaagaaaaatggaatgatggatataataagaggcaatatgaatgaaaaaattaaaaaaagaaacgaaaaagaaaagccacatgggtcgtatgaaccaaaggggaaaaagtgcacaacagtgaagcttcctaagcagcacaattgtatgcattctgaccataagcaagcttatttatatgttttgaggaaaataaatattttaattcaatccctgaaaaggaaaattgtacagaaaaagcaaaatttttcaatggattagaaaagtaaataataaacattcttctgattaaccctagaggaaaggaaaagtagtaaatgaactatagctgtaaatgggaaacagtttccttctttacatgtcaaaagattgaaatggccatattgtctgctgttattttttctcttagaataaatgtttctggaaggagatggcaggagatttcgatttgcctggactaatttttgctatcaagctacatttatttttcaccacttcagcaaaaggtaaactccttagtctctcctgattaaaaggtatatgctattttatcttcagtctcacattttttttgttttttttttttaagttaagaaagagcagaaaatttggaaaatcaattcctttcctgaaaacatgctttagattccccttatggtatttataatgagtcaaaatcagatttcagttaaagaaacaacaacaaaaatacatctgtatttttatagcttaacgctccatcctatgggctaactgaaagaggatataaaaatctaataaaagatgaaggacagtgttccttagggtaaggaaaaggagttgtataatactaattctgtttcttaatacaaaaatacattaaacacattttttgagaacctactgtctatgtgccaggcacttttctaggcacagggataatgcaaaacacagacccaaatcgcttgattttatgaagcttatattctctgcgatccagctttaagtaaacagagatgactaaaataaacctctaagataccttacatcttgtttgtttgtttgtttgtttgtttgagatgaagtctcgctctgtcacccaggctggagtgcagtggtgcaatctcggctcactgcaagctccgcctcccgggttcacgccattccctttcctcagcctcccgagtagctgggactacaggcacctgccaccacgcctggataattttttgtatttttagtagagacggggtttcaccatgttagccaggatagtctcaatctcctgacctggtgatccgcctgcctcggcctctcaaagtgctgggattacagatactttacatcttttaaatgaaacagataaatattattccaggtcaatgttcatatgatttagattcatgaagcattctaagaagaatatggtcccatggagattaagtgtttaaagtaagtcaataacaactggataatataatctcccttaactaacttagtctgctggactaatcaagggacatggtctgaacccctatagtgaggttatatcttaattttccctacaactatggtggtattagaatatttatctattttcttctttagtaacataactaacaacacctcaaagattatggcatggaaagtcagagatatatttaatatgcaatacataggaggtgctactatgcaacagacagatcgtttaatgacctgggctccagttccaatgataagtggtgtgaatttggtgaatcatgaaacctctcagaccctcattttcattcttggcctccctattttattattaataaatatgaagtaagataatgtatataaatgaactttgtaaactctacactattataaaaatgtaaaggatatatcaatcacatttaaatattcatatctactaaattgaatttttaaaataaagcaatcaggatgccaaagctactcatcagaggcattttaaaatgctcacctgttctctaatcaccttaaatataggcatgttttactatattttagaaatacctgaaatccagtacatttgttcataaaatttgaggaaagtattttttatactccagtgatttgtaatatagagtgatagtacaggaaatatggaactgcctggtggaactttaccaaattacaaacactggccttaccctcatcattaaacaccaattatttggcaagtatttaacaaatatttactaaatctctacagtgaaagcacaggcactgtggtagatgccagcaataccaccatatattaagaaagacatggccactgtcctttgagaatttgcactatcaattataatctaagattgttagaagaaaaggcaagaatgaaacaaggcaatttatttcaagtctatggttatatattagaatgccaggtattccaaaatattcataattactagtgctcctttgacctcttaccttgcaaaagttgctgtactgggtaatgtttgactagaattacagctgagaaatgagtattgattgcacattttgcattttacaaaacctgagacgtaaacaatcaaaggaacaacttacaagtcattcttcatcagggaacagtttattatctatattcattatctgggctagaatggcttccattgtaaaggcaacggattaaaacaactgggactcttgcggttagtctgttccaagacataaagcgaggccatgccctattagaatgcatccactgtccctgctttgacaagtctttcagtcagcaacctgccaactctgtatctggacaaactgccaaatagcatcacagtaataggagcatcttcatgaattttcctgttttcagcattaaaatggaaaaaatgctaagcaaaacccctttagcattcattgtttttagggctactggctgctttttttatgtttctgtttccattttttcagtttgcttttttatctgttttccatgataaaaagcacctcattcacttccccgtggaagggcaatgcagctccaagggaacatctgtgaggccaattagctgggctggaaatgtgatataattgttgtttaaatatatttaaattacatgttaatcacgatgtcataatttataagctttgaaaataactttttgtacttgagagccaagccagattttacttgtttttgctgtttttagtttgaaaccagctcttctcatttctctctccctcaattccccacacttgaagagctgaacttttaatattggaaagaatgacagctgcaagtaaattggttgagtaaaaattaagatcctcacagcagtcaaaatgagctggagtgaccttaaagttcgaagcagaacaaagcaatgctctcagttaaaagcttttgtttttccattgtgctactttctgctgtccatcaaagtccagctttgcagatctttaggaagcagcactgggtgcatctgttcaattagctggtgaggcgatttactgtcagcagggcagagatagaaagaggcgggttaggaactggcaggtgatactgagtttgttcctggtgggggggtttgtaagggtgatggatggaatgagtttaattctgtggccatatcgctgggagattgtatgattaacttggacttaaatgccagagattaaagagaaggcaagtatcagtaaatgaatcaaatacggtattaaatgcacttttaaatacatcatgttctaaaatttactttttagttgaatgataaatattagaacctttgtctcatatgcacagtatttcttatatttgtattatttaatattgttcctgagaaattttatttattaaatagatggactgtatcttgtgatatttttaaaaattattatacaaatctactttcggaggaaacaaaaatacaggcctaatgcctagcttctatctaaattaaacaggtgatcaatgagagtcactttctaatctttaaataattattactttcaatagtaattataagattacaatttctaggttcaagaaatactccaaattcctttgactaaaataaaatgtctctgtaagacgttgctaatccatcagcactaatttattatccagacacttccacatagtaactattaaaggttctcaaccttttatcctccctgacatatctgcttaacactctgatgagcatctccacactttcacaggtcacatagcaacatacagaaaatgtttattgcattatgttataattattgcattataaattataattcctgatgcatggttgtaactctgcatctttctcacaactgagttcaacataccagtgttttgagacgtttagatttaggaccttcatttttcacagggcaatcagaaggaaacaaacagaatgtgtccatatgtgccaaacccaataatggctgggaaaagcctactgagatttcagctgctggctgaattttatatatatgacacataatgtcttttgtctatttatgtatacatatatttatttatttagtcatttttctatttggtttgattctgtgggactctacttttttgaaaaaactctcttactccacacacacacacacacacacacacacacacacacacacacaccccaataatgactctatgatccagttgaagaaatattgacttgggctcttattcttttttgttgttgtttgtttgtttgtttttcgagatggagtcttgctctgttgcccaggctggagtgcagtggcgtgatctcggctcactgcagtctctgcctcccgggttcaagcaattctctgcctcagcctcccgagtagctgggattgcaggtgcccaccaccacgcctggctaatttttagagacagggtttcactatcttggccaggctggtcttgaactcctgacctcatgatccacctgcctcggcctcccaaagtgctgggattacagacgtgagccaccgcgcccggctggctctcattctttatccactcattaatcttggaacctttcatctttcatatatgtctcatgtactcatttaattaaaaaattgaacaaatggaaactatgagtggtatctgtaaatatgaacaagagtcaagacagaatttacaaagcatatggaaatgctgtcttttataatgcttaataatcctgcttttcttaagtcagtcctcaaagtctacttttattgtgtttcatagatgaatacatgataactcttagggaaattaagaaatagaaagagaaactaatatatattatgtacctaccctataccatggactattttaggttttatttattcttataaacttgtaaggtaaatagcattattaaaaattataactcccattttatagacaaaaaaattgtggagcagagaaattaaaggatctgccatgtgcacacatccatagttggctatctgaccacatagcccgtcactctatgaccttaacattataccacacatagattttgactttagcatttctattcttactcatctttgccctgtctcttcctttgcgttatgcctcaactattttctcaaacaaattcttacagtttctttctctagttttagtgaaaagaacttaatgacttaaggaggcatctgaaactcattatcttaagtataaaatgctgataatgtgttacattactgctccaccccacttattttcacttaaattagttacaaggacataaactggaaagaaggaaactttgagtattaagagttaatagcgtgtgtgtgtgtgtgtgtgtgtgtgtgtgtgtgtgtgtgtgtgtatttttccattctttcctacaagtcctttttatctaaaatcatgttgtgtatatatacatttacctacctcaccaagagcaaagccagccctgaagcaggaggagacaattttaaataactggagagcacaaagatttttcatgacagcactcttgcttatggatttattgttcctagtacaaggcttagtcaataaattcttcttcctgcttgactgagggtaagtaagctattgtatccccgggcagcaattcctatgccctttccaaatatcagtagaacaagaggatatttccttttaaaatattcatggctaaatgagtcaataaaatgaaactgaaaatctccctcactttacaggttcctgctttaagttgctgctttgagcaatagtatgtgatggaatcaaagaatgttattagcacagtcaaaaaagaaagggcataaagaaatacaattttccactaatgccaacattgcttagcttcattcaagataagcaacaagaattgtgtcacccttcttgagatgagtgatcacacagaattgatctctttaccctggtgcaagttctgcatttttgtattgtttggttggttctagcaactttctcttttttggcatgtttatattcatttccattagcatgttgtcataattgaaccttttcctcatgatcacttagctactagctaatgcatatagccagaaacctaaagaggaaaacttctaggagtttctcaaagacttctcagtaattcttttcagttagagagggtaggctctttttctttctttcttttttaatgtatgcttaagaacatctagttctaatgcaatgtctttaagaacagaaatgaaatcatcaagccttttcgatgtgtaaattctggagtagcctaactgattcttcaaatgaatcgtgaagttgtctctgcttgtgtggtttttatcctaacctcataaagaatatctgatgaagatttttcaggatgcaaacaatgcactggatcgggcaacttttttgaagacaaaaaccccacagacctagaacaaatggtctcatgaaatccttctacctccaggattgtattcttgaataggtctcactaagtcacatgacttttaacaaattccttagtttcttggtcttttagtttatttaatcctaaaaagaagaataggggtataggacaagtaatagaaaagatcacttccaactaccaaaggatttacgtgtaaaataaattttctgcctcaagcccacacgattagttattaaatattgtaaaatgtgattaacattaaagcaaagtatcttataaagttttctctcataaatcttttcaaagtcgactcatcgctttttctttcctttttaaagtggactatcttgttcaaagtatcacttaggctacatgcagtatatgattgtatgttttgatgaggctgaaccacatttggatgatgactcatgaaaatacaattttttgaaataaagttttatgatttaaaatgtttattttacagatagagactctgacactctgagaggttaattttccaaggtaacaaaagtagtgacggtactagcaacaagattccctgagttcccatccaatgtacaatctgttataccttagaacctcaaattaacttttaataaataataataagcatcctttagaggttgcattttttatgtttttcagaaacaaacctatttattttttaaatatagctgaaagcattggccttaaccaaaacatttgttctaagctgaaatacatattaatatacgcaaagtaaatttagtgacactttaattttaagacagatattaacttttgttattgaataggctataagacgtttattagacaaatgggataattaatatggccatacacatattaattaacatattagttaaaagtagtatttattaaaatggtactttgtctacaaaacaggttgcccttcacagagaagagatatgttatctaaacactctacctataaaagccagttattaaaaatcgatatacacatacatgcttattgtcagttgatatacttttaccttcataatatttatatctgctacttgatatacttttaccttcacagcatttatctccagatctgtctatgcaataagatactgtttagggattaaaataattgttaaaaataagtaatctataaggcaggtttgaactaagaataagaaaaaaaaaaagactataaacactttgaatttgaatgccataactttagaatttgaaatgtaatgtctttgcctagatatagttccttttgtactatcagcgaagacttaaatctcaattttaggctctgtgtatgtgtggatacatatgttagatatatatatgtgcatacacatgtatatgtattaatatacatgctaagaaaattaatagcttaaaacaagataacaaaggttatgtaacccatacaatcaaacacatcatattttagaggctgttaactcatttgtggggcagcttttgttttgtttttcttatgtttcacatgcagatattgtttatcaacaaatgagtgatgttcactaaaaaaaaaccatgtataagagttctacttagaaatatttgttactctatttagagtttagagttatttactggcaaataataaggcaacagtgaaatattcaatcttctctttagtaataacccaagctcaggatgctttattatatattcaacatttcaataatagtatttagagcaatctatgtgtgagaatgtaaaaaatatgaagcgcacggtttgtgtattggaggatggagaacaaataatataggaaatagaactgcaaatgttataaaccttattttggcacgtagattttattcagtgttttaagtgataggtgttggcaacaagcaaacaatttaacgtaatacagataaagcccttcagtgttcctataattgcagtgtggaccaggttgaaaatatcttcagttatgctagtttatgcaaactgtttaccagataaaaagtgaatttgtaacaatggtttattcatccaactactgctctttaagctaccaggtggcacagctgttgccgtaagtaaaaagatttctaacagtccacctggaattaggacagctggttcctgtgagctgatctgaataatgtactgtgaatactctggtacagctactgacagaacaaacagcacatgactgtcccatcagcccagagcaaacactagttacatttgacagaaacaggctggtatttacaactgatctaggccaaaaagaatatcagattgaaggcaacaccccaagagaaaatagccctccccgagagctacctgttgaccatagtctaagcagcttttgccattattgaaaagcccccaaatctgattttgctgcatataaaaaggaagaggaaaaacatacaaagcattcctgcatctatttgtgaaccattttggaattttctaaaataaaaaaatggccaatacttcttagttttccatttacacggttgctgccaaagtcaacccagattagccagaatcatggccataataattttcttttaatttctaaaattgtaacactttactaaaaaaatgaagcaaaaaatgaaatggaactaaaactagagaatctcatttaaatctgccattggtaccacagatgacccatagagacggtaaatgactttcttcaggatgatacagctagttactaacaggcctaattagaaaaacatctatcggctgaggatccttagattgtccacctgagccaaggacagccgaggtgaaactctaaagcaggcaaaatctgatctcagtgtttccccactaaggttgattttgcagtttcaggcccgtgattctttattcctaacagaattatttctgggcccatttatttctgccccggctccgtggaaaataggactgtattgtcctcccattccaggtgtacaattcttgatcagcaactcacactccaaaaacatcctcaattatctatacttttattttctgcccagaaacatgcctttagccaggccagagggcatctatttagtctgatgaattcattcgtaaaatcttctcaaattggtcaaattggtgttagtagattatgatggaattacttcagggaacactgaactacagaataccacgtcatacccatataactaacagctgccctgataatctacactgatctgtttcacagcatttcaaacatcacatttcttaaagtgaaatggccatcttcttctctccctggcctgcttgtctttctttgcttggtgaataatatcaataacttatccagctgtgcaagtcaaatatcttagtgttatctttcatgtctcctctaccccactccttatagctaagcatccaaggtctaccctttcaaacctcttaatacccccagaatctaaccattctcttcatcctcatggccactatttcagttgtggttaaggtgccaaaaactttgtcactcccactgggatacttagagagtaaaagaaagtgttattaataattatgcttctgatacagaagtaaactaggatgcactaaggaaaacaggcacttatgaaaatcttaattatggtaccatttcttgactagagtactgtaacaaccttctagctgttctccttgatctcattctttcccttcactccaatctaatactcatacttccttcccctgctttaaaaattgcaagacctctaggcaaggtggctcatgactgtaatcccagcactttgggaggccgaggcgggcagatcacaaggtcaggagttcaagaccagatggtgaaaccccatctctactaaaaatacaaaaataagccagatgtgatggcatatgcctgtaatcccagttacttgggaggctgaagcaggagaattgcttgaacccaagaaggggaggttgcagtaagccgagattgcgccactgcactccagcctgggcgacagagtaagactctggctcagaaacaaaacaaaacaaaactgcaagacctactgttgccctcaggctaaatgaagtccattatttgtggcattggaggctttggtaactatgatccttgccagtttctccagcttcacctctttctttgctctttcctcataagccttcagtcaaataaatctcagatttgcttgatgagccctttcctctctcacctccgacctctgtccaagttctaattacttcctcaatgctctttctggcttctttgccttgattacatcgtgatcttatgaaaaattgtcagtagcttcattatatttaattattgattcaaaaagtatttatgaaagaacccattatatgccccatgtgaataatttaacaactgtattctgtttatttcatcagtgtgtcttttttcttagactatgagtctgtttagaaatggattcactctaatttactattaaatttttcatatctagcacagtgccaggggcacagacatggtgaatgttcagcaaagatatattgaatcaaaggagagattaaaaaatgtcttaaacccaaagagtggctctattgatgaaaaatctcagtgactccatcaagccagttggataagttttaaaagatgtggaattttagcatccctgatattatatatggtacacatcttcttctgcagatggcttgggtggaattgaactcagatgcaattatctgactattatatctcatctagtacactcttcctgtcaatatcagttactatttctgaagccattgttggaaatcttaattctaatggcaaagttttttaaaagtatttttaaaagtattcttacaaatgggtgagtgattctgaatgcgatgaacatttcacattcagctataaaacttcaagattctatcactagtatgacaacattcccctaagacacctaggtatttcctattgctttggagacctagagaaccagggtttagctgtatccctgaaaaatacaacttgttaactaagaacaataagacagaccttgtagataaaccaactgtaggcagatgcaaaatgtatcctttctctacaagtggtacatatcacctaactgcatttccacactgtggtgcacagaacaaacacataaggaaggaccattttaaaattttcaaaaagtattttaaggataatcatggctaaatgctacagaaaatcaaacttataagtcaatgaaattctaaatcaaaattacagagtatgagtctctgagaagggaagtagctgctggagaagagctcttgataagagaaaaggacggtcatccaacagccccgctgccttaaaaaagtgttctctaagcttagggttctcatctgtaaaatggggataataatgcctgtgttgggtgctttataagctttataagctcgtgtttatgatgttaaatatctttgaatagaataacatagtagataaatgtgcaacaggcttttttctccagtgacataaagaaaatacagctgaatactgaattttccaagtatccctcacacaaaatcaactaaatgctgccttccaaataagcatacactttttatataccacaataaaagtatttgcacagtgacatgattatctgtgtgagggtagaggttattttgcaaactttgtatcacaaattttatttgaagtaaaataagccaggcacagaagacaaactttgcatgttctcacatatctgtgggagctaaaaattaacacaattgaaattatggagatagagagtagaaggatggttaccagaggctgggaatggtagtcaaggggagagtaagaggaagtggggatggttaatgggtacaaaaaaaaaatagagtaaataagatctagtatttgataacacaacagagtgactatagtcaatagtaatttagctgtatattttaaaataaataaaaacatataactggattgcttgtaacacaaaggacaaatgtttgagatgatggaaaccctatttaccctgatgtgattattaaacattgtatgcctgtatcaaaatatctcccatacacccaaaatatatacctactatgtacccacaaaaattaaatatttaaaaatttttaaaaagtttaaaccaaatttgaaacaattgtcaaaatgattgctgtcactgacataagtaaaataatgagaaataatgtgcaagtttcatttaaatgtctattaattaacacatcatttaaaatgattttaaagcattcctttgaaaattaaaactgctatgctttttttcagtgcagcagtaattcaaagaaaggctccttagaactctcagagccctcaccacttagccacagaaaggtgtacatgaaatatccagtaataaaatccttaagcaactaaaataaatgaactgaatgatctaacagtagagattatgataactgaaataaaatctttattatttttgctttctttagatgatgagggtgagaaagtcaatggaacgcaaacattagaaattcacattttttacagagtataggttggcattgattttttttttaatcacttctactgaacacttgaaagcatccaggcagagtcctaataagatatatctcagaattcatgatgaggcattgtcaacaggccaaggagaagtcctccgtgctgaatgtatgcttcaattgaatttttccttccctgtgattgctggcctttgtagagaaagttgacacactaagagaggcatgtagtcatgtaggaaatatttgaactctcatgccctgtttggtggagacatcattcctatatatcacctctttaataaattgagatctgaagccttttgtagattttaaaaacaaataaacatgcttaagaaagatgcaccttggaaagaaagcagccaggttacagaaaagtgcttagattggcaatcttaaagtaatttaagtgatctggagttgggaaaaataaaatagattaaactttttcacatatcctttaccctagctcttctaccaataaatagcaaacaaacaaaaaagtactagaaaggtaagaaaaacctcttttatattttctgggccactatgtcacaattataatataataatatattatatattactagcacaattataatttatcatatctaaagaaaattattaagccagggtgcagctatgatccaatgaaaggaaatattaatacatggtcttatgaacatattcacaaagaagagaatgcttatctttctggtcatgagtcttaaatattaggcatcccaagctctcttaggaaccactactgtttttatcatgtataaatatatcccagacttttagaaaccctatctaattcatcagtgttgtcttttagggtaacaagctccttaagtagataaccaaccggttacattagtatcctgcctctcttatttctcctaaatttacttatccaagtagtaaaaagttatgtagtagcttcaattctggtgaagaaaatttagatctagttatccttgcaaaaaacgataaatgagaagagaacattttgatcattcttaggactgatcttttaaattcttactgaaaagtgaccaaaagctcaggtgaaagtaattaaaagtaatactagcaccctggcagcaattctaggatttgtatttggttcattgccaatatgaaggcatattgaaggtaaattatgcaggaggagaatatatttccaagagagtttgacacaagctcagcctgtgaattatttgctttgaaatgccttcatattctcctgcttggaaattctggtcaagagaagagagcaaaaacaagcagcaagctcatcctaagcgtatagacaagtgaacattcaataaaacgtttatcagcctgcaataaagttttaaaatgtgctggaccatcctcccctagaaaagaggaggtacaataaatagttattatattaaactttcagagaccaccccatccatcttgatgttctaaacaccagaagtccccaaagcggctttcactaacatgctatttgaaactagtagttaattcctgacagccgttcctcctacatattttctaacctctttgacccaaaggtggatttaccttgaagcaatgaagtttaagctttagactcttcagttataggcctgatgaagaacccaagtcatagattcacatgatttgggggttttataaaatttgcaaaagtaaaattttcatttttgtgttctctttctcaaagaggctccacctctactctcaattattagtgtctggctccacaaaacctggactgccccttttccaacctcgctgtttctgaaaatgttccctacagtttattatttaccaaaaatctggctttcatgagatgccactctgcacatcctttcttgctttcttggaatatttcatctaatggagaatgtctattccatgattcaactcaggcctcagagccaaggttaatatgctgtaagattccagatactagctcttcaaaattcattcaagcccttcttcttttgaagactcatgctaaacaattataccacaggttcttatctttgtgactataatctacagtctttggaggcattgtccagcactcagagtgttcatgctcattggtatcactgagattgcaattatgcctggcttggtcccaaaacctttcaccatggaccccactaaatacctaagtattataattctggagcctcctccttgcctacagtcttatctccactgcactttaactaccatatagctgctttaactaccatatagctgcgtatacattttgacatcactgtgaaaagctctcaatgccaattctttaagaatccctttctctgaccacaatctcttattctttctgtgcattgatttcctttctctgactcaatcggttcttctgccttttatttttttctgctcctcaattaatcccttggcactttatttttccagcatgggctttgaagtaagccaggtatggttttgaatactttggcacttaccaaagctattttacaagcttctcaacctctctaagtcccagtttcctttgcctaacatgaggaaagaatgctccttccttttccttagtattacattttatgggaatgttatgtcaagaacctagcatactcagttgacagcagatatacaacgttagtatttacgtaattatgtataattaggtacatagataagagaaaaagaaataagttacttataccccattatcctttatccttacatcactgatcctcaatgtaacctttagtgccttcagcttcagcgttatttttgcaactgccctaccggagctcaactcttgatttatctcttttgttccctctcccttgctgccggttccatcagtgctactgaacagtcatgcattcaagcagaatggtgcctcaaaaaagccaagttttctacgcctttggtgatccttagatttactatcccctcatttgtctttgtttgtatgccttactgtggcatttttcttaagccttagccagtctctaagcttcctaacacagccctgctcttctccctctctgtcaacagcctgctctcaatataatagagagaacagaatctaaatgtctataggttggaagtacctcaatgtccctcaatttaacctctaaattataataaaatagaaaatttactacttgttattacaactggactgaattgtctcttgacagacaactaactttgttaaaacacttttttttaactttgttaaaacatttttttttaatcttggttaagtgtttgtttgtgtagttggtgagtcaactgagagttgagtaccaaggcttcagatgagaaggaaaattatacaacaaaatcgagaaaggaaattttggagctccagatcagtctgggaggaaacagctgaaaaaggcagagagagaagaggattaaacagtaggtgactgtactttctatgaagtgaccccttcaacctagtccaccagttctgttttcaatctaatctgccaaattcatgaaatctggatgtgagttatttttgttgttggagaaatgagagaagagactgatttgtggaaatcaaggaagtggtgagaattaataaaatgtggaaattaggaaattggaacttaaaaaagagaagagctaacagttaatgagttgttagtttgaagtgctttacctatattgctgcactacatcctcatatatacctgtggtagatattattcttatcatcattttagagtagaataaaccaagaggttaagtaagtggccaagtttacagaactagttaagtacaggaagtcagacctcagattccgtgatatgctatgttgccatatcactaaattgcctcaatcagcactttatcctcagtgaattaaaagaaaatatgaggaagcaattcgaatgtcttccgttcgtgaatttcaggttcaataaaattgtatctaatgctcaagggacagagaaacttccatctgacacatgggttaaaaatctcattcttaaattttatcatgccaaatgtacttcttcttgcctaagataaacttttctacaaatgtgttggacataccttcccctaactcctcccagagttttctccacctatcccctattatcttccataatctctgtgatttcactggctcactcgtctctaatatttggatgcccattattctagaaaacttcctctgactcatcttcctttctgaattcacattctgcgtcctttcttcctttcacatagatgagtttttcagagaaattcacatttcctgcctttaactcctcaatcaattttattcggctcttcactagttctacattctaccaaaatttctctcaaaaaggatagtaagatgtcatgaatcaagaataataatggtttccaaattatgagttaacttcactcgagctctagacacacattcctatctaatgactatatctacttatgttttaaaatattaattacatctccttaatctactcctctgttttcatgtattaatagtaacgttaacgtcttcctagtcaccctagacttctctccttcccactctgcaacatccaactgatacccaaatcctgttgtttctatctcaaaaccatcacttccatcaaactttccactcatgtcctgtgactcaagaaataatcaaatctctctttgttttaattcacatattaaaaagctaccagaattttcttactagaagccaggtctgactttgccatgcccctgcttaaaaacccttatttgctcaaatgatcccttaacgtattctctttgtccctattataacactttctcattgcattttattggctagttacttattcataaatttcttccacaaataagagggcacaactgcatatggctctagtgggaaaccattagttcagatatatagtagatacctaaataaatgtttgatgaatggatcaattattgaatgaataaatgcttctgctacttgcctgaattaatcattattcaatataggtaagtagaaatttctaagtctgaattaatggatacacagctaatagtaagatgatttagccccttaaagatcaaaattaacatttatgaggaatctgatgataaaaacattcaaaaagtcaaaattcctcactgatatactcatctttaatgtactgagtactgatcttatagcaataataaaagagaaaagaaatgtcagaggcagactgagaggcaatgcatcattttggtaaacagtgcagcctcaagggactctcgagccaggcttccaggttttgtcattgaatagctgtgcctcggtttacccacaaaagtgataaaaatagttagtagtagatagataataaacaaaaaatagtaaatactaaaatagtagaaaaataaaatagaaaaaactaaactcaaggccaggtgcagtgcctcatgcttataatcccagaactttggaaggccaaggtgggtagattgcttgagcccaggaatttgaaaccagcctgggcaacatggcaaaaacccacctcaacaaaaaataaaaaattagctgggtttgatggtgcatgcctgcagttccagctactcaggaggctgaggtaagaggattgcttgatcccagagtggggaggttgcagtgagctgagatcaccccactgtactctggcctgagtgtcagagcaagactctgtctcaaaaaaataaaaataaattttaaaaaactaaactcaaggggttttcatgagatttaataaactaataaatattagacactatggtacttggcaaaagataagtgataacaggtatcacctattattatttactctttgaggaatttaatacacttatatgtaattactagacacaaaagaatgcatttagtcatttcgacccaagaatatcctgtagcctggtctctctaacacataactacaataccggactctaactaagaagagactgtagtaggctccaaatgaatatgaattatgtatacctcaacatctccatacgctaggaattataaacactattttttttttcttcccagggagggaaacaattaagtatgaatgttgctaaacaattgtctatgattattgttggaaaaagcaaactaaattggttgtagattaaacttccaatttctttccctttttgatttactgtacttctttcatcataatgtagcatattttgctgcaagagatatagtcatagtatttggaatttttcccacggtggtctacccatctctcaattcagcttttgctcaagtgtaatgagaggctggtccacagccattcatttacaatgtctgaataaaaacgacagaacacaaattagcctctctttagaacacgctgctatgtcagaattctgaactgaaaagagaacttttcatttgggcaggtgagcgaggaaagggactgaaacacaagatccttgtgattaggatatgttcaactgcagaaagtgcacaaaggaaagctgatgagccggcccaccccctactatccacaaccatcttctccattctgtttcatggagtaatcaaaggatattctgagcctctcaaaatgccatcagtccttattgagaataaaatagagcatctctctctctcaagcctttgcagaagcaatcatcatagcaggctggcctgaacagggagctctggcagacaaagatggatttgtaaaataaataaataaatacatacatacataaattaaataacttccaaaaaatttgaatagaaagttgatgataatgtgccacttctattatataaagggtaaagaaactcacaattgtcctttctaggtcgagtacagtaaagaataggcttcttgatgagattttcccagtaatttacagcagagctgcgaatcttgtagcagtaatactaaaaattaaccatctaaatgatttagataaaacattcattaacattctcaatctaaggatcctctctagttgtccctcccacctctttgtgtccttttccagctctgattttcctctttagcactttttaacaaagagtggatgaagcctatttcaactgttcagaaaggcttctcgtgccagctgatagttgctcaagtgtaaaataatttcataaagatctctgaaacattctttagcgccagactctccttaaacaagcagtgtttctaagacacgcattgtcttagtgttgtagaaacatgtttggcagcagccaagtctagtgctgataagaagctacaaacaataagcacaagttgttctttcaggtgaatcattatttactagataggtcattctctttggagccggaagacctgacactcgtctggtatttgccaagctcttaaccaagttactgagttatttaataggccaagaatttagtgttctgtataattgggattctggtgtaaaaataaaatgccacagatgccaaaatgctttgcaaacttttaagcactgttcagctgtcacttatttttgtgaatgtcacaagaataaaagtgattcactgatttgaattacactgcttgtagcaaactccgaggatgtaaaggggacaggatatttttcaaaatagtacttcgtagtctagagtaaaacgaaaaaggcttcataaaatttgtccccaatatttaaaaaacaaaataaataaagtagaagtctgtaccatctcttccatcttttaatgaactccatttgaatgattattaggcttatattttatttaattgctatttattgaagattattatatatatatttttaaccaaatgacgggtgagagttgaaagcatagacaaatcagtaaaaaaaccttactttttaccatgtaacctggaagtctcagcaaaaatactttgcctctctgcttcatttttgcctttgtaaaatggccataataatgcttttcagttacccttgttatgaaggttaagggtaataaatgtaaaaaagctccaagcagagcctaatacatgaatatgtgatcaataaatggtagctatatttaggtttgtgtttgagaattttgaaacatttgtttaacttgtaaggatcattttatcttcaagtaggtaatgactgagtcccgatacagacattgttctccctgcttttttgctctgattttggctctatcaattccatttgttcctcctaatcattaactcttgattacagggagtctcacagaggcataaatcgagcaggggctctggcttctcactgtgctcccagtaagatccttttaagccaattgatactaaatctcactaaacttaaagtcaaaatcaagattttcatggttttgaccaggggtggggggaaccaatagagcaatagaggtctgaatactagagttagacttgagaaactgaagcttctcacataccccttagaagcacaaggacactgggctacaggttttatattttccagtatcagtatacacatataagatgaaagggtttacactagaatgtctttaaggtcccttgcaactctgacactccgcgagtacatagttacttatgcatccacctcgtactacaacagtgcatctcagtgaagcaagtcacttcactcagagttcatctatatatactaaggccaaggacaaaccacactggttgtatttctattcagagaaaatctagtggaaacatatgttcagagaaggacatacatgctagggaaaaagaaggaaaaccaagtgccaaaggaaggatgttaaattatgttgtccatattgtaaggagagcctggtgtctgcatgtcaatgagagtgtgggactttatacgcaatgaataatgtatttgttttaaatgtatatatatacacacattgccaatctctcctcttttcccgaattggaggtcagttataaatatcaggctgctgcttcagtttgggtgaggagtaaaatcattgtgatttaccacgctatgagaaatatttcacctctttcacatgtgtaaacatgcatttataggtttataataccaatggttggtgttcagtttgacacacataaaggactagactttgtttaaatattaaagagaaaaataataagattaacatttattacaagagaaaatgtcgaaagggatacaggcaattatttaacaatggaaaaagcagattccctgaagaataaagcagtgactatagaggaattcatactgtaccataacaaggaggcattatacaaagttcaaatctactagaagtgatttgtatgatacctggagatacaatttgataaattaaaacttacctctttattactaaagaaattgagaaaatagttcaattttgtttgtaattcctaaagacagggctaaatgaagaatttagaattcagagctggtactatagaaggcttgacattaagtttaataagatattataacccaaccctatgaaaatccttaggaagtcagggataaattaaagaacaataacaatttgtaaaaaaaacctttgttttttaaatttaattttgttttgttttattttgagacagagtctagctctgttgccaggctgaagtacagtggcgtgatctcggctcactgcagcctccacctcccgggttcaagtgatcctcttgcctcagcctcctgagtagctgggattataggcatgcgccgctacacccaggtaatttttgtacttttagtagagatggggtttcaccatgttggccaggatggtctccatctcctgacctcatgatccacccacctcagcctcccaaagtgctgggattacaggcgtgagccaccacgcccagcctaaggtaccgtgttaaatacaagtaaatcttacaaagaatagcataactgaactaatatatccagattttaagaaagtcactggtagaaaagacattgcaaaaaaaggtcccttgatatttttgttatatataaattaagtatttgaaaggtttctcaaattagtggaaaatcagaggggtcagaaccatttttgatatccctgtaatttccaagagcttggaaggacaaatgaatgcaatttgacattatgtccttatttaaaaacaacagtcaaatctataatacataaggagaggagctctttcttaaaatatgcaaattatccagccacacctctaaagtcaaacagaaagcaccaacatgatctatattttgaaagagatcaatgttgggatgatgcttgcagctctgggcagttttgtgtgtgtgagttggagaagagtggaaaataaattgcagtgactggtcaactggaatgaccaaggcatttccttggctaaacgttcaaaaatccttcaactgttagtgacaataggattatatatcatttgaagagagacctactaaaacatgcatcattccagtttcttcccttgatggaaataatagaaagctgtactctaaatagatgaaggccaaaaaataaaaattggtgccaataaatgataaagcatggaaatattaattaatattgtatttcacttggtacaatgtaaacactattatttagaaattgagcctattttccaaaaaataaaaaataaaactaattggatctcgattagagtaatattatagtaacttctgtgaagtgatgagggcctgaaatagattcaagacaacagaaacagaagataggaatttgagagctgtttttcaggaaggctaagagaaaaaaaaaaagtttttaaattgaataatttaatgaggagcaagagatttcaaaatcatgtttcaagccatcctaacattgacagaaaaaaaagaaaattggaagaaagtccatctcacctcctgataaaagttctcaagcatgtgcaatatagaaatattacaaaaagtagaaattaaaaagtaacaaaaacacatttcttcacctttgtttgtggtggggggttttatttgtttgtttgtttttgcctttcttctgatccatttcagatctgctcatctgctccaccaaaatgatttctattccaagctagataatcagcctccacaaagatacatttaaaatgactttttataacctcttaaactgatttagcttcctttgtctttttcctataattcctggcatgtctctctcagaatattatctcctcaactagaatattaactctttgatggcaggacctctgtcttccaactttgtactctcattgcccaacacagtacctagcctatgataaacattcaatatattaattcatttactctttcattataagaaattgaacaatttggccaggcatggtggctcacgtctgtaatcctagcactttgggaggctgagaggggtggatgacgaggtcaggagatccagaccatcctggccaacatggtgaaaccctgtctctactaaaaatacaaaaattagccgagtgtggtggcgtgtgcctgtaatcccagctactcaggaggctgaggcaggagaatcgcttgaacctgggaagtggagattgcaatgagccgagatcgctccactgcactccagcctggcaacagagtgggactgtctcaaaaaaaaaaaaaaagaaagaaagaaagaaaagaaattgaacaatttaaaaaatttctacttaggcccagtgctgtggctcacgcttgtaatcctagtgctttgggaggccaaggagggaggattgcttgaggccaggagtttgagaccatcttggacaacacagtgagaccatgtcttcacacaaaaaaatgtttttttaaattacccgggcatggcagtacacaactatagtcttagctattcaggaggctgaggcagaaggatcacttgagcccaggaggtcaagactgcagtgaaccatgaatgattgtgccactgcactctggcttggggacagagagagaccctgtcttaaaaacacacacacacacacacacacacacacacacacacacattgataaaaaaaaaaataaaaaaaccaaaaacaaacaaaagcccttgtcatagggaggatcttaagaagaagagccccttcttttgtcttaataaaaacaaacaaataaacaaaaaccctcaagcatcatgtcaaagataccaccatgtcaagccaatatcctgagactacaatcatttatcatcaagtagcagccgttgttagaagtgatgttgatccttggtaaattgcaaccacagtaaccttgtcatatcatcacaaaattctcgcactatatcatttagctatgagatacttccttaacttgtgtccatagggttttctcttctatgttcaatcacataaggaaaaaagttatgcatagaggcgatgcaggattttttttgctccttagctcagctaatctgggtttttgtttgacgaccatgaagaattaggcatgcggacacattgaagggtgaggaaggtggaatgtattaagtgaaaaagaaagctctcagcaaagagagggggtcctgcaagcagctttccacctccctcaaattgaatactagcaccaccacacacgagataaagaggccaggctcctcccctggataaggcgcaaattcctggtggttccaccccattcccccagtgcatgtgggcttccagtccactgcgggcacgcccaggcaagcaccccatgcaggcttccttatctgcacaaaatatctggtgtaaacacttgtgggggcgagttggagactctctggggacccttccctatctgcctaggcctttgtctgcctcctacctctatcagaggtaggccaaaatgtttttgatcattttctgatgaaatgtttcttagaagaaaatacagcgtgacctggcgtggtggctcacgcctatatctcaacactttgggaggctgaggcgggcgaatcacttgaggtcagaaattcgagaccagcctggccaacaggtgaaaccctgtctctactaaaaatacaaaaattagccaggcatggtggtgcatgccttagttccagctacttgggaggctaaggcaggaggattgcttgaacctgggaggcagaggttgcggtaagctgagattgcgtcactgcactccagcctgggtgacagagccaagacacagtctcaattaaaaaaaaaaaaaaaaaaaaaaagaaaagaaaagaagaaaagaaagaaaatacaattttaatgcatgagatataatcaggcaatattttaaaacataactaaggttaaagcttcatcgatttggttccagaatgtgagatttctgactttcagtttagtttttttatccagattaccgtaaagtgaatgaaaagttttagggtccttcagtagcaagatgtttaacagcaacttgaaatgagaagtctccctcctccatcccctctgttagcttagaaatatggcctttgtgtgggacaactgaaatccagactcgatttctagctctttttcttatcatttgtaagttacgtaaactgtccatagctcaattatttttttaaactcttaaaattggactggcagtagtagttacctcctagggctttgtgaaataaaagtgagatatttaatttaaatcacttagcatagtacttgggttatagtgagcattcagtaagttttagctgatattattattattattactatttttattatttcataaagggacaggattttgatttattgaaatactaaggcaaatcccattgaaacttacattttctttttttttttttttttttttttttttgagacggagtctcgctctgtcgcccaggctggagtgcagtggcgcgacctcggctcactgcaagctccgcctcccgggttcacgccattctcctgcctcagcctcccgagtagccgggaccacaggcgcccgccaccacgcccggctaattttttgtattttttttagtagaggcggggtttcaccgcgttagccaggatggtctcgatctcctgacctcatgatccgcccgcctctgcctcccaaagtgctgggattacaggcgtgagccaccgcgcccggcctgaatgtcattattgagaatgacatcattgtgtctgcattatcattttgctcaaacttctactggtttatgcatcataaggaaacatagcaaaatataataaatcttacaggagagaccaaagatttgcttgcatttctttctttttatgcaggagttggggctaaatttataaaaatctcatggttaattacagtgtgtgtggtaaccttataaaaataaatatctatattaaagttatgaaatctaatctgagagcaaagtgatatggtgtaaaataaagtagagagaatcatatttttagcagtcaagatactcaacttacattcaatgacttagaaattgatcaaatttttgagataccaaacttctttaattttcttcattcttcttcacttctgcttacattttatttttcagtttatttatatatctattctgggagaaagcgtgtaagaggaagaggaaaatgcaaataaatctatttaataaagttacttcttagcagatagaaaagaagggaaaaagaagttacattgtgatgataaatccattgcgggttactcacttcactaatgtggagtagctacaatttctctgtcttccactggctgagataattaagagttagctgatatgttttgacagaggagcatttaatcttaaaactattgcttacaaatgactggatgggcttgcaattgaaactatgtcttcctctataaaaatacatggaagcttttacattaaattaaattttctaatatcattaaagctaaaatatcttcagccacatcagtttattcactatttttattcattgctatttcatttaatatacaatttattatatcaaaaaaatataattctaggtaactcaaaagaccaaacttagccattgtaacaaaaaagaaagaaaaaaaacctatggagaatttttaaattatgctgaacatgtaatcgaaaatattaggcagcatgtgtttaaatatctagagaaaagaaggccgcaatggaaactaaatccaatagactgaatatacaaagggacaatggcctgaccatatgtaaaaatagaaacaaattgggaagcaaacctccttatctacaataaacagcccagcaaaccagccttttgtaaatcagatttgcaggaagtcagattgctatctctagtaacaacccaggaagctacacaattacttgtataacaatcagctccaaatgaccagaattgattaataactggcagctttcctaatttttgtccttgcttccaacttcagaccaacagaaaaaagtcaaacatgcacctctaaccaatggcttctagttatcctgcctatagcttccccaggccaacagtctctaatgagggcatagatgaagccttccctttttttttttttttttaaccctacacagctttcccactcctctgcgggcctttaagtctctgccaaaatgtaactgatggagctgactttcttgctatagcagtctctgaataaatactctttgcttttttcgtttggttaatattcatttatttccacactattggagcatctattccaggtccattaataggtaacgtgcatgcatacactaaaaaggtaatcttcataatattccgtgagaaaatttttaaatccccattttacagatatagagcacggtttgcagaagttaaatagcttctcattttctcctatttttacatcacgctagagtaaaatagcttttggtgtattattgcttaaaaagatttgaggccaggcatggtggctcacacttgtaatctcagcactttgggaggccacggtgggtggattgcttgagctctggagttcaagagtagccttggcaacataaggaaaccctgtctctacaaaaaaatataaaaaaaaattagctgggcagggtggcatgcacctgtggtgctactctggaggcagagatgggaggatctcctgagcttggcatgtggaggttgcactgagccaagatcgtgctactgcactccagcctgggtgacagagtgagatcctgtctcaaaaaagaaaaaattttaaggtaatattaaaagtatatctaacaatagtaacagcagctgtaaattaggtaagtgttttctagcatgacttaaatttgtattcatcaactttctggacaaatataaacattgtattttgaattgattcattgctttaaagttgtaatttatcaaaatatttgtggaattgaaaaaatcaaaagcactataaaaaattacttctgtctttatttgatattagaacacatcagcagaaataatttgctggccaagcagtaattgcatcaacaagcttttcatagatagtgggtagagcaccttataagaaagtgtgattatttatgatatatgatattgacaaggaaaaaggtaaaaatggaaatggtaaaaatgaaaagtgaaattgatgattctaaaagtagagtaataaaatttgtttacctggcattataaatactctgcaattttttaaagttaattgcctaacactcatataagataggcaatatagcatttagaaaatgaggaaacaaagtcatagagatattcagaacattacctaaagtttcttaattagtgcgcagtggagcctatattttcaaaatgcattattttttttttttttggtttcaaagtctatcacatatgcttaagaaatatttgatcaaaattcacttttaagatgttcccttagcacgttatttagccaccaaacttaaaatggtagtaatttgttttctaatttagccaaacttaaaatggaagtaatttgttttctaattcagccatgtaggaaagaaaggaggaacatggcatttgtacatgttagaaatttccgtaaaagttacgtaaagccagactgaaaactattaggacaatatagatgacaaataaagctttttaaatgcctgaacataaaatgatacaatgatatttaatcaccatttcttttccaaggactgaaaaagtaaaaagaaatctacaggtaacattgttttataatgtggaataagaaatgatggctaaaggtcaaataagtccacgggtgatttagactttgtctcaataattccatctagctagctcaaacctttattaagaatttcttgcactgagaattataaattaaaatgaacaaaaagctgaaatgtaagaattcttataaaaagaaaaagatttatagcattgcaagctaagaaagaaaaactatttttttttaaatttcactgttgtaaccagaagtaatgaatttgtcacttaaaattataaatacaagggtatataatttgatcattttgcaaagtgtacagagagcctcctttatacaccttaaccgctttcttcccctctcacaagcaaaagactgattattcattacctatccattgatctaatttttaaaacttttagttatctattccccattgggcatgtgataaagttttcagtttgtactataatattttttaacagaaaagaaaaaataattgaggtctccatctttgtctctttccatatcagatcttctaaatggaggtagatgagtaaaaggtgtagagcagatttgagatgcattttataagaaaaccacctgggaaatttcccaaacaagacaagtcccagactctaatcacatcatggaaataacatgcttcagtaactttgaagcaaacctacagtgtagtaggcagatatctagattacattattcctctcttccactgactagctgtgtgacaccagtcatatcacctgacttctctgtggcaagtttcttcctttgaaagaaggggatgataataatagaacctcatgaagtttgtttaaggattaaggaggttaacatatatgtgttgaatagtaaacaccaggggaatattacttattacaatcaatatgaaataaagaaaattatgtttgttagataatgagcagcaagttgaaaatattcttatggctatggtcaagagaaatcggatgctgtcggttctactagctatgataatgttcttagattaagagaaaagaattatcttctagaaaaaattaagcatcatgtttatatcttatcaatggaagaaactgattacagacacaaatttactacttcttcatgctccgtactggtcagtgaatactggattacagcacttactatgcagtccctctatctgtatgattctttgattaaggttttcacttcttgaaagcagaagttgtatcaaaattctttgagtcttaaatgtatactaatgcttcacatacagtggtactcaatatatgttgaatgtatgaggaatgaatttataaaaataaatgcatggatttgacagctttcaaagaaagaatggaattcatatagagtaggtttaacatttaaaatgtaaagtgttttcagaaacttccttcaaaacttaaatctacttcttaaaaacaaaaatctacttctcagcagccttttcgatgtgattaggttcaaaggactgcacggttttctgtgtttctacttcaacttgacagaaaatatttaatttttcttaaataagtgaaagagatttatacttgtattacttcttgactaatatatcataatatctttttaagaaagaaaagtagaaagcctacttggtaggaattttcatttatttatatacacataatggttttattagttggaattgttttttaaagttaagatttgttttaaataaattaagatgaggaaaatgttttgcttctgaaatcttgaaggtatttcagagtacatgttgtattgtccatgcttgtcttccaaaattaactacatatagcaagattggcacatcttttgtgggtatggtatatttttaatctaggcatcacattgatttgagctatataattattttgaaatgttagtgcttatgaactattacatgattttatatctcagaaagaatatgatatgtgtatataattatttcttaccctattcgagtcaattcttgctctggaagtatagatgggaggtgggatgttgaaagcctgagggaccaagtactcctcagcatccatcatatcttccaaatcctcttcatccaagagattctgaaagaacttgctgtcatttggactgggaagcttcatacgatcatcaccctaaaagaaagattgcccatcagacacaaatatgattctttcttatcttaaatatgtggtctctgcaataaatttatgtaatatcataacaaatggttgaaaaattcatacacacattttaaaaaaacaagtctttagcacaaccaccggccattaagaaacctataacatgcttagaaatgatagggccaggtaaacaaactttatacaaggagaatatgataaatgccattagagaataataaagcaaaatcaaaagatgtttttagggaggtaaaatcaatttcaggtctgaaaataattgttcattgcccagatagtgtatgggttgcaactttaagaataaacaataaaaggtgatcaatttatcaacgtttatttggttggtttgatgctgtaggattatcaggaccatagggtctatactttattctatagcatactgactgcattatcaaagtaggggcattcaaaactcacagtgcaagtggcaaatagagtaaaggagtatgagaaagacaccaaaacctttgttatgctcttcctcacctcgtctatttcttaagtatttttcctatatttttaaagttacataatttttggaaacaatttcagttcatgaaaactaattttggggaaaaaataaatggaaataagtatcttctaaaacctagcttttatctttatgtcagactgtcgatatgaaaataaaggctaccttgctttactgaggaaacataatacactctagtccaaggcccatttgtttagagtttaggtgaaattaatcctagagaaatatattattattttttaattatccaagtctatctatttttctagtgttaaatataaaatatttctttggttggttgattaaaatgtgcatcaattcatttgaattgagttattgcttagatactgcatatctctccaaataaaacaaaacatattttaaaatatttttggggaaattaaataatatactgaaacttttgattcactgtcttcaagcatgggcaagattaaaacaaaaatctgtcttccttttgttccgaaaaaagaaaattatactaatgaacatgacttacacataatgttaataaaatcaaggtgctaaaataagtgtctgaggattaagacctctttatgtatatgtataatcataattatctgttcagtagcagagccacttgaatactaagggaaggtgctaaaaggtggatctgacgtgaaataaaaagctcttttccataagtcatgtcacatgataattctgcttaattaatcaacatgtttgtggtcctttccacagttccaaagtcctgatactactcattttgcagtgagtttgccattggcctagtcttaaaggcataagtcaaatgtactcacctgaataactaggtatctttgagggtctcgagccatccttgaaaactcagcagccagttccttaaatttaggtctactgtcagcatcaatcatccaacctggaaatttacacagtgaaaatgtcactatattcgtaactagaaaggagttgaaatttaaattttgtgaaaatatgagcaaaagtttgaaaaatgttgttttaatcgtaatgatctgagaaagaaagcaagctagtgaaagaaacgactcaattggtaaggctttatcggtctctttgttgatattcataactaaatgtaatgtactgtaaaacaaaagataaattttttctctgatgtgtatagacgtgactgcaatataagttattattttgtattaggagtgacataggagagaagatttggttacaatgcttacactggcacaaacgggaaaagaggaattaaaagcaactttcttgtgctacatttgtcctggtggacaaaaaaaaaaaaaaaaaaactaatgcaaagtgattggtaatgcctgttcagcaatagacattagcttatcttagtactagcttgtctagtataaaaatactatcagcaattttcaaggtatgtattcttatttagctgggagtctagataaagcagaccttatctctacaggctctgtttagctaatgagatgacaagaataaaagtatcaagctttccttgattttcttgccaaattatcctcttcttaggtattaaaaccccgaaagaaaggtaaaattctccattagggaaagtgttttcttggttttacataattaatttcatcagagctaaattctgatgagtttaaatcatttcctatgctagttacaggattaaattatataagacatgcatgtttttaaactttcttccatagatgtctaccaaacaatatttaatagaataaggctgtaaagcttgttccttccttttccgggagttcagtttttattcctattctgggaattttttgggtgtcattttatgtatcattaatgtcatctgctttttttctccccaaacaaagctcaaatgctctgtattctatatgcattcatttgaaaaaatgcttgctaatgccaagatgctaatgagaaaacaggtgtttctgaaactattgaagccaaaaaaggttaaccacagttgaggtatcggtttctttccaactaaatattgagtaaatagaactatgcttagtgaaaagggcaggctgacctgaactgcaaagaacattttttatttcctccctcactgtcagaatgtatcacacatgtcatgaatataaatctgagtagacctgggtccaaagtctcttattaataagatgcttattcaccttcacaagtttgtttctttgctaaccccgtgtaaatcagaaggggaaagccttagattatacaagagagattgctgcatgttaatctcacttaaattaagccagaaactccagagacttcctcaattctatttaaattaagggcctgtgcttcaaaaacacatttataatacatatgtgtctgggacataggaagaaaaaagaaaagtaagagtttgatgtaaacaaatgatcaaattgaaaaaagtaaacatttataatctttttagctcactatagattcatttcttcccacttcccaccttgtcctgctaatttgctcctgactaaaaccagtagacctatttctattaaattaatttttaaaactgtcagtttcaagcttttttccttcatgtttagatcatttatgtagcctgatattttcccataaaggtcactaatgtttgatattttcccataaaggtcactaatgttattactaacattcatgttagtaatgttagtaataacattattgtgactaattacctctctttacgacaggcaatttgactgtcatggagattataagaataaaagagtcataattttgacttcatagcatggaagagtattactttatattaataatagtcacaacaaagaggcgttcatatgttcctttcataattgtttttgaactgtcgtatttttcaatacagagaaatgttgtacagattgagtaatctctgctattactttactaagaatgatgatggtgataacattattttgcagtcttacatttgaccatgaccatgtaaacgtcaatagtgcagatgggaggctgaggcaaacgttctcctttctctaataaatcagggatttctcgcgttggaattccatcatagggttttcctccaaaggtcatcagttcccatatagtaactcctatattggagaaaaaattcttacttaagcatattaacaacatatgttgaacaaaccagcactataccagtagtaaaagaatactccttacaggtcaatccaaacaccaatcaattaaaaaaaaaaaagctccataaattcctgcatccattatgagaaccccaatgtcaaaatctttgtgggggaattcaattttcttattattgtcttggaatttctaatggatagaagagacaatttacagtggatgtcagcatatagaatctgttccccatttctgcctataggtaacactaatgtttgctgatccaagttataccacgttacagtccataaaacaattcatctactatatatacatatgtattcagtaccaataaatatgcttttgccagtaaaataagatattgactaattttaagatcagcatctttgctataaaaggcttccagaataattaccttatgttacaataaagaattgtgactctctctaacttacacaaagaaaacagttgaataaaacatagacttctttagcacatatgagagcctgagagaggaatgttccatacgtaatatatagtacatgtgaagtagtcaccaacaaaattgtgaaggggatagaaagtagtttattttttaggtaataaaatggctttcttgaatcactgggacattgattttctctgcaaaagcaaataccctaaatggtagcatgcaaacagccagttttggtgataatgatggttctgatttgagcaataatatatacactaaatatcttttttgtaatgtaatgattatataatttaagataatattttcttagggataaagatttttaagttcagacatggctagctgggcacaataatattacaaagtgaattttgattgatgtgtatatacagtcatctttcagtataaaatccattaattagagctatgttttctttcctattgccatctgtaatgaattatttactcaggctgaagtattttttagtttataacagttatcattgactgataacaaaaatacaaagcttaaaatataaaactatgtggaatttaaaattattctttctaatagaatattaactattacctgatttttttggttaatatttacatcttaggattttaggtatattgttaacatgtacctagtgacaatttaattgactgattgttattacatctttaattttgtatattaaggagaagctcctaaaatctatcataaaaattttctatgaggcaggctgcaacaagttaagtggatgactgttcatctctagatagtcatacttacagaatatatatatatgttttatattttagaatattttatatttagaatagtttatattttagaattatctattttgtattttagacagggtctcaatctgtcactcagaatggaatgaagaggcatgatcacagctcactgcaccctcaacttccccaggctcacatgatcttttcacctcagcttcctgagtagctgggactacaggcatgagccaccatgcctggctgattttcgtattttttagtagataaagggtttcagcatgttgcccaggctggtctcaaactcctgggtttgagccatctgcccacatcggcctccctaaatgctaggattacaagcacgagacaccgtgcggggcctagaatatatatttaaggagaacactttattaacttaggtaggtagttataaaagatagagtagatactctcacatttctagcagaactcccaacataagcaagatacaaagcaactgtaaatcaaaataatagaaaatataaaatacaaaaacaaaagccaaaatataaaaaactctacttcttctgataataatccaattatatccttgtaaaggtgatgacaagatagggttagaaaaggatggtttcaagcaaaagaacaatgtcaggaaagctaaaacaaaacatcctcgaattttacttgcaattcctttatcttaagatgtatatcacagccagtgcttattttgtaaaaataaaaatgcacctagtgagaattttccataaaggtgcactgtaaacaaggttatgcaactttatctgcctttaacgccttttgcaatcaactatgatatatcacaacattttttaaatgccttatgaatatgggttgatgacctgggctgtgtttcaaaacagagtactacctatctatttatttatttttgctgaacagttcctgggattttgcaactcaacatgaagaaaaatgttacaccctgagtaacaagattttccccaaaagacaaattttactattaaaaatatgactgttctgcccagtttatatatatcttgagctaatttaaatttgccttcaggagactgcctatatatcttgagctaatttaaatttgccttcaggagactgccatatttgattcagggaactgtaagtagaaagaaaaagaaaaaagtatatacatatataaaatatactatatgatataatatataaatctgacataatatatattctataaacctatctatatcatgtaatgtataaatgctaatctacatgctaatctgtatcatataatatataaagttatcacagaatacatgcaatagatgtttttctatacacttcttacaatagtttagcaagtaagttttgtcaagcatttccactacatttgtctatacctcagacacacgacattttctatttctaagctgagtaaaataaacacatgaaaccttcatgaaaattttaccacctcctatggaatacatatgtggaaggaataacccacttgattgaaatgtcttaaatacttttttaaagatagttaattttttcctagataagaattgtaagttcttcagtgattgaatggtttatatctttttttttccaacaatgcaaaaaaggtaaaacttttttttaagcttaagtttgagtaacataaattgtaccatacatttaaatctcaccaccacccttttatttaagtgggcattatgctttttatttgtaagaaatgctaattttatatgatatatttaaacttagaaacgtattgactccttcttggtattaccggacttacttaaattttaagtagccagacagatgctaaatagctcatcttaacaattaagttaaacacaataaaataaatgttctaattataaatgtcactcttttccagttcatattattcactctgtaatatttctgtaactccacaagtagtttgtaaattaaaattaatgttgtaattagcaatcttctcttttaccatgttcattgctctaacttactgctgtcagtaatttttctttgttatgacaataatctgttttctactatagaacataaattcttacatgcaagaaacccacaaaaaagttggttttgtttttgtttgaatatttattgtattcagagttatgtttttgaaagttgcttaaaattaacaccatgaaattctatgaaattgtccctaaactaaaattggctgattttttttttttctgtcaaaatgatcaggcaagttcctacaaaaccacagcttatggaaaacatcttagcagaaatattagtatattacattgtaataaaccaggaaaaaaaaaaaaacagaaaaaggcagatagcaatgctatttagaatattttgttgctcttcaatgggaacacatggacacagggaggagaacatcacacatcggggcctgtcggtggatggagggcaaggggagggagagcattaggacaaatacctaatgcatgcagggcttaaaacctagatgacgggttgataggtacagcaaaccaccatgccacatgtatacctacgcaacaaacctgcaggttctgcatgtgtatcgcagaacttaaaataaaataaaataaaataaaataaaatatttttttttcattgagaaagcaaagagttaactgctttaggaaattaggcttatcaataggtatttataacacaacaaaataatttagcttaagatatttcacatgaacttaacatatgtatttttgctttacaagctttaattcgcaaagaagatttatttaccatagctccaaacgtcactctgatgggtgaatttcctgtaatgtatacactccagagccatccatttaattggcatctatagagaagtaagaagtaaaagttttaaaattacattaaaaattcatttctatatgtatttcctaaatgtgagtctttgggctggccttaatcatatttttttattatgtgtgtatagatataactataactataaatatatgttaatttatgactataactataaatatatgttaatttataaaatacataaagtgaattaatctaaagatgtactatacttattcattttttattttatttattttttgagacagggtctcactctgtcacccaggctagagtgcaatggcacaatctcagctcactgcaatctctgcctaccaggctcaagtgatcctcccaccttagcctctgagtagccgggaccacaggggtgcgccaccatgcctggctaatttttgcatttttttagagatgatcatcatgttgcccaggctagcctagaactcctgagctcaagtgatctgcctgctttgacctcccaaaatgctgggattacatacgtgagccaccctgcttggtcatacttatttttttaaaaaaaaagctttataaacaattaaaggtaaaaataattaagtggggataactttctatagttcttaattaacattcagtaattaagttgctagtaaatattatgatttataatattaaatctaaacatctaatacacatgcttctaaaaatgtgtttatagttttttctcaaaaaatgagatttgttatactttcagttatcccttttcaccctcagacacattttgggccaccagtacaatggactctttctatacttgccccctcccttctcctctcatataatttggccactaaaacgcctaaaatcatgaattccaaagttagccttgctttgttttccagcttcaaatgacccctctcatcttggttagccagtattgaaaatatgtaccattttcaaaataggaactatataaaagaatgtgaaaggatcagcacaaatctatcatcactacaagaaaaacatctcaacccacatatcctgctgatgatgggtcagcagaatgagtttcaactatgaagggcagcattatatagctgggaatataattagattctatggaataaagataaacacttctactttgcagttgaaagcttaaaactaaataggcctttgaaatcatgaggttggctgctcaccaaggtgacaccaaggtaactctatgacagaatcatggtattcagtgaaagggaagagaagacacattgaaagtaatttccctacgggcaaggagttagcagactttatggactacggacattgtgttaaagaagtaagtttaaatcacaggtagcttgataaagacttaatagttaccaagcatttaaagctataatgaatcttgctttagacaaatcttatgtctcaaatcttatgttctcaagacaagtgaagccatgtgatttatagacttcaacttctgtgcagtcttagagtgaatttcaatgctgtggtctcagactactgcaatttggtagtaaacaaacaggcaaaatagggtagttttaaaattttttgtgttattttgccttgtgataaagttaagcatttggaaacctatcattgcaaaatatttataatatatatttggatggcccatatgataaataaggcatataataaatatatttatatgacatgagaataactgggtttttttttgttgttgttagtgtaagcttataggtcaccatagcctaagattgcatttgcttatttcatttgggctgcctgaccttaggtttcactaggtgaagctagagggacctccatatgaagtctagtcctaatagtttggccaagaaagtcaagctaaagagaaggttaatgaggaaatacaagacatgggactaaggcatggattgaaaccatatagtgggtgaaagagtcaggaactccattgtcaggcagaggctgagactagagggtcagaaaaggtagacgaggcagtggctctgttcagggttctttgtagtacctaaacttttctctaatctatgagagagaatctatgttctctataagagttagtgctacggtctttagatcagtgggacaatttctacagccatgtgttaaagtttaatttctagaagccctaaggatccacccactttccatcactggacctaacatgaaggtcacctgggtacagacatgcatcatcttattttagctacttttgagaaacggaagctggtaatatatggtatatatatatgtgtgtgtatatgatatatatatacacacacatatatatatacccggggcaggagaagaggcaaatggtagaaccaaggcttaataatctcctaagcttcaggcttattggtttcttgtataaaatataaggagataaaaggatattatactatattttcaagcaagattgctctcaaaaagatacccacctttcctccatcagcattgtactctttttcatctccttccaagagtctggctagcccaaaatctgtgattttcacatggtttggagatttcactaagacattacgggctgccaaatcccgatgaacgagtcgtctttcttccaggtacatcattccctgaaaaatatcaagttccttaatgatattcagttaatgcccaggttttcccatttttctaaaacaaagtttcttagccttcagttggaagtgcctaattttttaagtgaagccagaatcctagaatattttcaaaattagagaaaacctgatttgggggacagcaaaccacaaacagcttttggtgttttctccctaaagtcctatgagatgaaagaattactttcacatgagctaaatgttagatcattatttttccaagtgacttgatatccttttgcaaactctttctttagtgaggtgtgcaggtgttgtagtaaataagctaacatatgcttggattgacccacatatttgtaatcattccttctcaataacttctgcttcacgtcatcttccccctacacatccaaacaaatacctttatccataatttttagaaatatttcatttgaagtttaatggtgccaaaatcaccattatagattctatggaggctgaagaattatactattcttattatactattcttattaatcatgcacagaatgaagtatataccctagcagtcttacaaacctgtaatttttaagaagacttctatggtatcagtagtcattatgagaatccatagtgaaattacacagtttgtaatgacactgaaattagcctttaatattttacctttataaaacatagagggaaattaaaaataaaatttgttggtgtttagcagcaagagacatagctggctctcctcacaatacatccatgtataacaatatataacacatgttatgtattaatatctatacaaattcagaaaaaataatctagaggagtaataattactttattaattgtacttcagtactaggtaaactaagggttgctaaacattatgtttaacaaaagaacttatgtaaaactaaggaaataaacctgaggccgagattagagtgaatatatttttgttgaagtgttaggggaaattctatatttgatgatttttgtggtaaaatgatcaccatttaaaaatagattagaattattataaaatgttgaagcatactctcatgccaattgcaaatcaatgctgtgggcagttaacattacaactgcaggactttgaaggattaatggtttctaatatcaaaacaaaagctgtggaaaacagacacataaatcacacaggtcaaaaaattatgaaccgtatacctggtgtagtgtaaagagaagattacttcaaacagcatcatgagccaaaccccatataaatgcacattaaacacaaccagtggggatactgcctgatatggtctaatcagtcaacagttgggtgacgctgtgtgtattagtgttttctgaaatcaacttacaaccgagatttatgggacttttgccctctctcctaaacagtgctttgtgtttgagtacattaaattagaaattcctataataaagtacatctgagaacatatagcccttatatgacttaaaggatcaaaaaaaaaaaaaaacaaataaatgcattgccttggagatagaatattttcatatcttcccaagtaatactatccctttaacaaatgttcatgaaacattcattattctctttcttatcaccttcatatcagaacacggaatatatgttggcaacaggttaacacgtactatatgctggactatatagacagatactgagaagacaaaaaagattcagataaggtctgtatattaaaggagaacagaagctaattaataaagtgggcggatagggaataaaaacttgaatggactgatgtgatacatgcaaggcatttaaagagaactctattctgaggcccttatgtagtatagcctagcaagtatgcgtgagaggagagacttcaaagcagtaccaaggcctaagtaagggttgaatgatgtctcccaattggacagagtgagggtaaaactgcaggcaaacagaacaagcacaggggtagcagtaccatggcgtacttgcaccaagatatgcaattctgtatttttaaagcataatgtatgagggacagtggtgagcagtgaaactgaaaacaaaagaagaggcagggtccaagaagggtcccttatatgtcatggtaaagaacttagacttttgcatttcatgcagtatacaattaggtgatgtggaagttgttttaaaaaggggagtgaggccgggcgcggtggctcacgcctgtaatactggcactttgggaggccgaggtgggtggatcacgaggtcaggagatcgagaccatcctggctaacatggcgaaaccccatctctactaaaaatacaaaaaattagccaggtgtgatggtgggcgcctgtagtcccagctactcgggaggctgaggcaggaggatggcgtgaacctgggaggctgagcttgcagtgagccaagatggcgccactgcactccagcctgggcaacagagtgagactctcaaaaaaaaataaaataaaataaaaaaaggggagtgagagattattgttggattcttgaaaacaccactctggtgtcagtacagagaatggattggacatcaatgtagctgaaggcaggagccactgccacaatacagaagcaaggtgatgtaaaataaaggctgcaatttggcagtccatggactacatccatttttcagatttttttttctttagtccccacactgggcgggggtcagttattctctgtagctgagaccaactgtaccccaataagggcaatccgaccccattttccaagatccctccgctcactatttcttcccaggagttctgcttccatcacttacaacactcgtctgctcctacgtgtaagagtatctgaaccttcaactaaactaggccagaaggaatactataaagaggataatatcaaggaatatttataaaataatcatccttagtatttgtttgaacgatgaagaaagagaatacactgagaacaattttgtttttagacttttgtaatttaggtggataatgatcccttgaaccaaatatcattctaataaaaatatcatttttatatttcttaaacttatgcaggaagagtgatatgtactttgccaatagggaactaaggcacattcaccaaaaaatttaaaactctgctatgatctgaatggttttatgtccttccccaagttcatgtgttgaaattctagcccccaaagtgatggtgttaggaggtggggtctttgaaaagtgattaggtcatgagaatacaacgtcatgaatgatattagcaaacttataaagagaccttcgagagatctgttgcttcttcaggcatgtgaggttataggagctatgaacaactaggaatcaggtcctcaactagacactaaattttcttgcaccattatctgggacttcccagtctccaaaactatgagaaataaatttctgtttatggtattttgttatagcagtctgcacagactgacactctaatgacacactctacaatacaagaaaaatttcaaaaactctgaaagttttttgaaattctatacacaaagcctcagcaagtgatagactatcctgaagctaaatactatttttccagaaaaggtactttcttcaaaataatgagaaatcaatttttaaaaactaggtgacagtctctagacagtttccctcacccacctgaccatcactaaaagcaataagaacgtaagtatctatatcattaccaaaccatcaaaatacatgtttatggttgctttgtaactatgaaacatcattatacagatgcacgctttcaaatcattacttactaaagccaccttagtcctactttcacacactgagagtgttgaatcatctatggattgctcaaaacagttttctctacatcacagtcattaaataggattttcttactggaagctctcatttgagtcacactctgtgctagattccttcaaaatgaaataactcttcaaattagagtgtcatgcaactaaggtggcagaaaattattagaaataacagtgacaaaaacaaactggatgaagtccgtggaagtttcaagatgaacaaataaaggtccttcattatgatgctgtgtttcatgggtaaagaagcctcatactctgtgctctagcagttcccgtatccacgtcaggccagcttgagtaaattaggagaagaataatactgacagcaaccacagttgacattgacccagtacttagaacacagcggtcattaaagtaaatgttgccacattggttggttaacttaatcctatgagatgaacactgttgacgtattttaaatatgagaaaacaaaggctaggcgaggtcaagttacttgctccaagttatctaatcagggatccccaacccctgggccatggagcagcactggtctgtggcctgtttgttaggaactgggctgcacagcaggaggtgagtggcaggcgagccagcataactgccagagctctgcctcctgtcagattagcggcggcagcattagattctcgtaggaggctgaacccagttgtgaactgtgcatgcgagcgatctaggttgtgcactccttatgagaatctaactaatgcctgatggtttgaggtagaactgtttcatcccaaaactatctcccctgccgggcccccacaaaaacagtccctggtgccaaaaaggttggggactgctgatctaactaatgcatggtagaagttggattgaatcccttgctgtggcaattctaaagtctacatttttaagcctatcttctctcttaatgggtcacagggttaggtggacatggagaaattaatgaacatagtggtcatacagttttgttttctttgtttttttttttgagacaaggtctagctctgtcatccaggctggagtgcagtggcatgatcagggctcactgcagcctcaacctcctggcctcaagcaatcctcctgcctcagacttccaaagtgttgggattacaggcatgagccactgcatccagccacttgaagtcatatagctttaaaaggcactagtactttggcagaaaaaaactattatctggtgtttctgtgaatttcaggacataatgcaagtgattgacattttttaatttatattttaaactcagttaaattatagcatctttttgtaagttcacaggaatttgaattgtgcaaactacagactgttcttattttggtcacagagaatgcaagatggtagagtgggtaggagtgtagattctgtggtcaattgcctgtttcaaaccccagccctgccatgttctagccctgtcactctgagaaacttatttactctctctgtcatcaccttcctctcctcgtctctaaatgggcataacagcacctatcctgcaggttgttgtgaggtaaattagcatatgcaaagcacttaaatagcaattggcatatagtaagtgtagaacatgaaaacctttattactgctccatggatagctatcaacaatcctagaatgcacaagaattacttaccctccttaactttaattgcctatttcagaaaatctgtgaacctcagctaatatatcacaatgggtgtttaataagtgtttgcaaatgatgatacatatacttataacctacccatcatgattaatgtgtgaatacaatttcagaattattattattcaaagtattattttaacaataattcacccgaagatgctgtcatataagaagaaagaaaaattaggagacatattaaaagatttggtgccctctataaatacatcaccgactcaagaatttagtgaagataaaggtcacgaataaaatagatctaaaaggttcagtgctgtagaatgctttctgtgggttaataatgctttctatgggttaataaaatagattttctataccaagataactgccacttattacacaccatggaggggagtttttgaaagaagtattttagggttattttgtctacttcatgatccaaatgccacaagtctgattttaccgaaactattcagaatttaccattacctgaactattcataatctgactattttttataccttctctgtaagccctagtaagttttcaaagaatgcatacttagttcatgttttgctcatagctcttaaaatgtgtaatcatagtaaatacaagctaaccagagaaagtcaaattgtatgcttgattttcagaaatgaactttgatataaaatccaaggaaaattgtattagaattgaatttaacattttaatctctggttagaatcaactcatataaactgcttatggaaaagaacagagaatgacttaattttcaaataatggtattgacgaaaacctagccatgaccttcttttcaatcttatgatatgtgagtcacaacaatctggcaaaaagcattatttttgttttaattcaatgtgaaaatgtattttgcccagctgccggaagctaaaggaagtcaagagagactggactatttctgacaataaatatttgcttctcacatattggccatgcgacaatttcatcaaatacgtgtgtggagctaaaaatttcaagctgcagtcagctctcacaggcattaatctccagcattaatctctagagttagcaagagagcattttttttttctgttttcattctaattacctgaagctttcgtaataacaggaagcttcaggaaacctaatttcaaatgaaaatatctcctttttttctacctttccttctaaaagcaattctatccctgggggaaaaagaatccaactataatgcttactatggttagagctaaagatataagcatgtttaaggaaagaaagggatctttttggatgaagtagccgattttatccaaatagtgcataaagggaatataaggaggctcagtaatggaatcaactgagggacctttttaaccagcagaagctggttcatggcagaatagaaagaacacagagctgagtgttgtgaaacagaagttttggacatattgttaactaggtttatgaccacaggtactcatttcacctctgctataaaagtgatggattggccgaaatgatctctgaggttactgctagctttaaatttttattccatgatagatgaaactgtaaaatatgtctatctgaaatattaaattgtgggccaataatagacacagagaacagtaaagaggtagagtagatgtcccccttcaaatatttagtgagagttgtgaatatgttttagtaaaaatcatcttagtgcatcctaattttaaaatccaaaaacactggctacttagtagctatgtgattttggtcaatttatacaacatttgtgtttgtttcactttctttatttgttaaatgggggtaataatagtatctactctgagggttgtcttgaggattcaatggcttaaaattcagaaaacacgtaaacattcactattataagataccatgtatttttaaaataaataagcacaaatttatcttattaaaaatataatttgaccactttaaaggcagccaattgaaacacctgttggttactcagcactgttaggtgcaatagcttctcattctgcttgttcctgaatgttcttcctattattctattcagaggaagaaaagcagattcatacggctgtcctgagccagcagggagttaacactcatggttaattctcacacttccaactgcagtcatgatcttcaagaagcctggttaggttgcagagcttaagaacttagattttggaatattaaggacaaccaaatttctgtccttttaataatatataataaaaattattgtttgctatttatttgaaatttatttttcacagatagtcccaataatatatttgagtgtgtgtgtgtgtgtgtgtgtgtgtaagcatgtgtgtgtgcatacacacttgcatgtaggagatgctgtggtgggctgcccagaaacctctttaggacctggacattcagctggaagttttggctgttgatgattcgtctcagcttcctcactcgtgggatattgacactccaatgctctatctatgctgcaaagaaaaatagctacttcctggacagacttacaaaattctggtcttatggttcatttactccaaccacaaacatgtatagtgtgccagttactgatgccaggcaaatttcaagttgttgaagacacagtgaaattcacaaatagttagttggtttttaaagtgcctccaaaggcaccatcccttggggaatccagcaaaattaaagaggcttgtttaaaagccttcaacgtttattatgtggaaggaagtgttttcactggattcatagagcacccattttcaagattacattcagttttgtgagtttcatatatggcttgtaatctactgagtatatttttatgtatatggtcatatagcataatggttaagatcattgcttttggaatcaagctgcctgcaagacaaatcttagttctgataagttttgtcgtgcactaggtatcacctttggacaagttattttacctctctgtacatcaatttccttgtcttaaaataggagtactagcagtaatacaggtttcactgggttcttgtcagtttccatatacaaaggatttagaacagtcactgacaaattaataaatgcaatttaaaatctgcaatctttatgatggaatgtgggaaagcaaaccctgccacatttaggctaagccccagatgttggtattagtctcccaggggtagagaaggggaagaccatttacagattcctgaggccgacagagataacagaatttttttttcttgctccttacattttcttcagaagtttcatttaccactcatggcaagcttttaaaacatccatttgaagaacagcctccttggggcttgaaagccttcttaagaaaaccaaaaaataaataaatgaaatcaaaaacaaaaaagcaaattaaacagcatgtgcgaaaaacctctgctttctcactacattgtgagtaaaaagctcatctgcctgcatcaagagaatatcaagcatgctacagtttttctcccattgatctcttgccaatatggttacaataggagaagcgaatcatgtagtgtccgaactctcacagggaggtgtacttaaagtgcattacttctactccttaggcagccaatcaataaagatgtgctttccaatgagaatggagatgtctgtgggctgtagcagttatcctctgtgtctctttagaaattaattaaaaatcaatgaagtgtgcaacctattaatacagcaacctctagattaatagaagctgagcctttctctgagcatacatattgtgcaaatgcattcagagactacagagaggtggttgaatgtctgacaccttagtaataattgagcagaaacagatcattcctaatattttgtggtttcacagaattgcatgctactggtggaaaaccatacagcttagggatagggatatgtatatacaattttccttcttaagctgattatatcaaattttatgaggtatccttattacaaagcaaaacttctgccatcatatagacctaaataatttcaataactattttcttaagtgtggtttacttatctatatgtccaggtggttgagtttatttataactgctgaatacttttatgtaagtgtctttgcattaaaaatgtgaaactcctagagcactaaaggctcttatgcaacttgagtatccacataaggggttgaaaagtgtgtcattcaattcagttctgccttgtctcatttggacagcaatgggcttggccccactatgcaaatatctgcccaacgcatgtaaaactcgcaaaagtggcacctacatacttccttctggaagtcacccagccacttccaaacttcctgatctgccccatgccctccttcctcaggcttgctcctctcaaaatcctcagaaggatttgtaccatggcttctgttttcatctaaatcccttactgttgatttggatgcccactttgacacacatccttgtttctacctttgcattcttcctcggaattccagggctttgtttccatctagttcctgcataaagactaagagaaagagactcctgctttgcaccttggctcattttctagcctaatattaccatagaagtaccagatatcatcacattacttaaaatgtgaatcatctatctttaattattaaaactgtcaagaaattgtcctgggagagtctgctgtcactacaggcttcaggacacatgtgatggtatagtaataatacaaatttcactgtttcttggcccaacctgcttggagagcacctgtagctccctgcctctaagaagccttttgcagatatttctagggttagccaggagcctcatagatgctcatggataatctttcttgtttttgtttgtttgtttttcaggactcttcactgatatctgcagttgttgaacccacagttgaagctcctgtggaaatgctgatatcttttctggggctgctatctcttgatgctccagaagctacagcttataatgtttcaaaccattgcaattatgcccttccatcctccttaccatgtcagtgctctgctgtcttccacacagccctagggaggagttctaccctcttctgaactttgtgccttattttgtcctcagctgtatcactagctattcttgagtccctagtaacaaacaaacagtctccttaaaaatcttcagtaaatttagatactcattccataaaggctcagatctagtccaagaggtagccatgggaaattgacatatttctctttgcttaagtcttctctttttaaccatgtgcatttgccatcatttcctcattctcctttacccttcaacagacatgcacatacactgaaccacgttttcactcaggtagccaaaaaagcccacaagcaacttgactctgcttggccctccagcttcttttcttggaattcttcaccttgaactctatggccaagcaaagctgaaaaccctctaatttcttttgcctttacacttactatttcctttatctggaacaccccctcaccatacactgccacactcttcctaccatgctacagacacatgcttggtcaaatttaacgtttcttagatcacaaattagatgtcatttcctccacaagatcttccccaactcctaaatagattgggtcactctacaacatagtgataatgtccaactttatctatagacaggtatctatccatccatccatccatccatccatccaaccatccatctggagctaaaccctgagattatcaagcattattttaaaaaagctttttggatttgcagctaaatcaaagtttttttatgatcagaaaggacataaacttgtatgctcagactttaaaaatgctatataacaaattacccaatgctaacagtttcatgtagagagtagataaagcacaaagccaaaatatatatgtgtgtatacacacacacacacgtatatatgtgtgtgttatatgtatgtatgtatatacctgtatatatgtatacgtgtgtatatatgtattgagatttatatatacatatgtgtatatatatatgaatctcaatagagcactcatctattgacttgattaatttgtcaaactatttttaagagaattaaacactaaaatgagtaatggaagaagtagaaagctatattttttcggcttgttcaagtccgaaaaataaagattttttttatcttctattcttcacttcaaacccttatggactgttgagtgcctggaactgtgaatggcgtgttcctgtggagatgacataactcagtttgaccctcctcacatttaccaatttcatcacgttttgggacagtcaataaataatagtcgattgattgatttcctcctctccctactccttactcatccttactctttctatcctttcatctctttctactctttcatccttactctttctattgcctttggatcaagaggtctggaaagaagaaattcccagcagtaataaatatacttgcaaacataacctcataacaattaaaaataaaggaagaggaaaaggtataataaattttaatattattggcaataattttctattgctaatgatgatttttattacattgtccctttgctttttattttttagtattaaacatctgttaattttcaggcttacttgcatatatgttgcaaattgcttgctgaatatttttaattctggaatactatttgggctttgggctaaatgctatcggttttcccacaattgttaggaaattagggtattgctcatgcacactgacaatgtgaaatttgaaagctgacctcttcttttggtctcctctccagttcacagatttatgtggttaatatctcatatgaaagaaggttaaaagcacatatcataaaaacagttctaaagggtcatttttaacccattcctgtttatcattgacatctgggggagtggaatgcaggaatgaagagtgatttctgggacaagacttcccaaacttcattatcagcgctgccactaactatatgcagccataggcacgttagacatgttagttactcagtctgccaatatcttcatctataaaatggcaataataataatacttatctcataaggttgttgtgagaattaagtgaatgactgtatgtaaaattcttagaacagttaagagtaaaactcaatgttgatagtattatgtcctttgtccagcaccttgcattacagatgattctcattttcaaaagttcagtttttaagtaacttgaaattccctccgattttaagtataaaacacacttttatacttagaatcccaaagatcatctatcaactgccaaccacatctcctgataatgctgtctttcctataatggtttaatttcagcacccttaccatcgttaaagtttgtggggttttttttgtatactttcatttctgtgtataattatctgtataacatttcactttaatgtttaaaagataatagggtagaaaatagagatgataagaaaaacattctcatagtaatataattaggaagaattaaaaaaatcactaaagagactaaaattggcttatctttagcctccactggacactcattgaactttagctggatgactatgtattcattagaacaaaatttaagtacatggagaaaagctgtaaatatataactgtacatgaggtttaaaggtaaaacaaaattaaatattttgtgttactcttaagttatctataattgaatctcacttataacatggaaatctatcattcacatttttaaaattttacttttgcctcttagaaataccttacaaatgaaaatcagggacaccttgtgtcctatatttgtgtataggtatgcatattccattagattatcagctatttaaagttacaggaggaaagacaaattttctcttgatcactttctagcttattgcatacataatatacactgtgtatacaactcactctctatgtagttgaaaagaataaagtttccttgtttctctaaacaatcttttattgaatagaaattatgtgctgaacactctgctaattgttttacatataatgatatgttatttccttcaagctgttcattgtctgctgtgagatacatacatggacacagattacgtaaatgatgtgttcagaaagtacagaaaaagggacatgtagcatattctgtgttgattacaaaaaaactaacaaaagtggaatttgagcttgatattgaatgaaaattaaatatttaaatttttggataaaatacagtaagaacattctagacataataaaaagcacgtaaaaaggatagagttctaaaaggtaatggtatatttagaaaaaatgacaacttctttgaggataggatctaaattaattgtcaatggctaaaagcgccaaaattaagtgtctaacttaattgtgattacctaacatgacgtgcacagcagttactaaaagccttgataaaacaaattgacttgatcagatttggcagttgtgtggaggacaaacaagggtaaagcacattagaaagaatcaaggagatcaattgggatactataatactagttccaatagcaatggtttagtgtttgactaagacagtaacttggagaattaagtttaggttagagcagcagacagatatgggaccttaccaatgaggttaaaccataagagagcatgagataactcagatactttcttccagggaaaacaccgttgttaaataagtgagtgccagaaaagaataccagaaaaagtgaccaaaagtaatgaccagatttataggagaagaacaaagacagagtgttatttcttgtggagttgttggagaggaaatgagagaatcttaagaaggtaaaactagcgacagtatcaaatacaatagggacgtacaaaaagataacagaagggggacctttgaatttggaaacgggaatattagcaacctggtgagtcactagattgcagtggactcaagagtgaacaaggatttgaagaacggtggtccgcaaaacaacacaaaattaggctcttaaaactaaatgaatacataggctgtcacttgaaagaggaagtcacaagtttgggattgtttattcctccacccccagagaattgaaatatttatatgatgcatgagaggagccagtgagtcaggagattgatgatacaggttgagaagaaatgaaggagaaatgttccagcagcagagatgggatcaaatgttcatgtaaggaggcaggtttgtaaaggaagagacatttcctctgagatagcaacaaaggaaatgttggaatctggaagagaacaagatggggggagctaatgttttcataccagtatttttcttggtaaattgcgaagcactaacataagttgaggatgagaggaaagatggggtagagtgaatagttttgaagtggccaaaggaggaccattggtctgatttcactctgtgcaccagcacagcaggtgtccatgtagagtgggtaagaaagctcacataagatcagggtaaagattgccaaagaatactgaggcacaatataagataaaaaccataactttgtaattgcatcacctggctggagtattctattgtcctcagaagcagagaaacagagaaattggatatttggggtcacccagagaagatactagcaggtaagtgagacaggaggacagagataaggaaaaatgaacaaaaataacttcgtagaaatacaagaatgctatttcaaagtgtcatgtatatgagttttatttttaagagttttctatatgtaaagtctttttaaaaactcagaatggatttggacattagtatgaagtttgaagttagtttcttcttcaaagactttcttactatcaccaacaaatgcatgggatctgaaaaatttatctcatctaaacatttaaaaaataaagtcagttactccagaaccagatttttaaaacttaattttaagcttaatatcaaaatctaaaagtatcagataactttatagaatcagataaaaaagtgtattctaaaacaatgtgaatgaattaggttttttttaaagcaaactaaaaaggtagtctttactatttgatttatttattttaacaatttggcttccagtaattccttctacgcttttagttataaatgatccatgtctcctactggatttaatttttatctatcatatatttttgaaagaggtgaagattttttccacatcacaatatattaacatttaacataagaaaactataaaccctctataaaacactgaaagcgtaaaacaacaaagcaacattcacaagtcatggtaccgaataaatggatttaatgaaaccagtgaccttgtgttacaaaaatcagtgggtttcttttgctgtcaaagtgagtttatttgaatcataacttctatattcctttacaattatgatcatgtttggcaaagttggactacctttatatgactttacagtattcaatttcattttaaaaacatctaatgcaaatttaatactttatcttttatgacaagacttagctcagcctgaaataatcactgtattaacattttttacccattcaaatagttcaatccattattagaaaaacagcaagcatccccagcctgtcattaagtcctactgttttaattacaagaaaaaaaaaatactctatggaaggcttttgtgaataatggcactgtaaacacaatcttacgcaaagatatgaaaataaaatggggtggagtttcttttctacatcaatattctagtagaaatgccatattttctggcaaaataatgtaaagtctgttaaaatataatggttctttctttgaatttagtcacaaagagacactgcttagaaatacatgttactttctactatttggaaacacatgaaatctgcattcaaggccaatattttgattaaaaagttctacatccactaggatttagcagacttatttttgacttctgaccaaatttagttcctctttctgcatattgtggttgcatgtaaatgtttgccagtgtcaggagattcaagctattcaaacattaaaattaagtgctacctaagatttatttaaaaataaaacccaacttttgaccttaggaattagaatatttaaatcaaagtctgtacaaaactgaacacttcattaagaacgcctgttaagagaaacatggctggggtttggtgagtaaggaagaacttcattgtatattttgtctagacttattattatattattattttttgagacagagtctcgctctgtcacccaggatggagtgcagtggcaccatctccacttactgcaacctctgcctcctaggttcaagtgattctcctgcttcagcctccccagtagctgcgattacacatgcgtgccaccacacctggctaatttttatattttttgtagagacagggtttctccacgttggccagactagtctcaaactcctgacctcaagtgatccacccgcctcagcctcccaaagtactgggatcacaggtgtgagccattgcacccagcctattattatttttaatataaataagaacatatcacaaaggtagactctgctggattttccagcttgaagaaggtgaatctaaatccaaacagtattggagaataactaactttgagcaaggtgtttgaacagccatttatgattttttaaagatgacaaggaaaattgtatgtatatacatctacccaaacagatacacacacacacacacacacacacaattacacacagagataatgcaatacagattataagaaatgataatgaaggtgcaaaggcatataaacacatggggtgaaatatgaattctgaatggaggaattagcaatgtttgttgagaatggaaattgaattacattttgaaggaccaataaaggttagaattcttagtacagctacaaatgcattacaaccccatcaatttacacttttaagattaagcccaagaataggtaaaatattttctgtaaaaggaattactttaataaaatatttatgtagagctaccatagatgtctgttaacactgaggtcatgcatcttctttctattgagacagttcactaaaagatatgcagtattgtaagagattttaaaaaattaaatgcacattttttgttctaagatatttaaaatctctttgggtaaactatgatattgaagtatacatgctcaatatatttcagtgttctctattaagacaaattaataaatttgttaattactattctatgtatacctctaacatcaactttaatcatctttacaaattaaaattatttatgtctagatattaatactgattagtacccaatagtgtacctcctacaagaagcttgataactagtatttaagatattgctgataatgtttctgaattcctatcagaaccttttggctgaactagataaaatttacttaaagataaggtgcattttcatgttatcacagtattgttctgaaatgttttagaccgtgtaatattagtagcagaatactgaaactggtatgaaaataagatgtttcctcaatagtttaactgttttgtaaaatttaatattttgtatttcacaaccagtgaaaagttcagctactatttttatctattaacatttgcagttaaggcatagggtttcattaaattaggaaatggttattcattataatataaccataaattgagctctagctcatgaatgtgctaattgttcttttctgctgaggatagtagcttatattcacttttaaaactcaatagacatagttcatatgcaatttagattaaatctgagtatgaaatggaaagcacacataccatctgtgaagaaatgcccttatccctaattaatatgtatcatgtattatagcccattttattactgaagacaagttataaaacataaagttgagtttaataaaaagaaagctaatttaatgggaatgagaaattgcctacaagaatattgtagttaatggatacaatagtctttgcctagggaaggataacttgatttccatgtaagttacaggcctggatataagtgtacttagaagaagagcagaacaagcctctagaggctaactagggaattaacattcaagtgtttattgagaatctactatatctaggtactatgatataatagcaataacttatataatgaacactcatctagcgcttgctaaatgataaacactgtcctaagcagtttacacaaccccatgaagtacatactattattatttccattttacaaataatgaaactgaggcacagagatgttaagtgactttcccaaaaacacacagcaaataatagagttggaattttaactgaggcagcctggtttcaggtctaaggaatacatgtgcagaactgggattagagaaattatgaaacttggtgagcctatgagagagctaatggaggtgggcagaaataacaagacagagaacttgatgtggggtaaggctggaggagtgtgcaagggcaaacctgcaggatcttggaggccaggctcaggatgttgacttttatcttaagagtgataaaagtccttgggatgtataaaccaagagcctgggaataacatgattggattacattttgagaaaaatctcattggctacagtgtgaatgattgattacagaaggaagataaaagtgaaaatgagagttaaggggttatttcatactctaagtgagagatgatggcagcccggaccagggtggtgctagcaatggtggtggagatggagagaagtaatcgatttgaaagaaatttaaaagctactatcaacattacttaatgtcaaataaaataggagcatgagagagaggaagaaacaaggataacttcagttagtgctactgattggatggtgatatatgcaggactaatgtttatattattcaggtttcagtttaaatattatgtcctcggagaggccttctccaactgtttgaattaaagtatcatccacccctccataagtctctaaacccttaccctgctttatttttcatcagagcacttatgactacctgacaacatataggcatgctgttacttacctgttgtctgtttcactgactacagtgaaggcaccacgaggagaaagaatttatcactcatattcatgctgtattctctaccctttagaacagtgccttgcatatcgtaagtggataatcaatatttactaaaggaataagtgcatgaacatgaaggctgtcagaatatgtacgatagttaagatcgtggatctgggtgaaatctttcacagagatgaaagtgaagaaacacacgtaagcaataaacaaaagaaaaactcacagggacaaaactgagatgacaaagttaggggcatggaagaaggcccagcaaagagcagtgcagcagaaatccagagtttcaaatatggaatgactgtcaatgtcaaatgcaaaatgctagaatggcattgtaagaagaggactgaaaaaatgccattaggattggcatttaggaggtcattagtgatgttgttgataaaagtttcacttaagcattcaggacggaagtctgaatagtagtttggacaggaaattggagatgaaaaaggaaaacagtatttgtagactattctttcaagaggtatgtctgtgaaaaaatgaagggagacagggaactagcgaggaattaagggaggcaggatgtagaaagaaatattatataaggattgatacagaatccagaaatatttctcaatggtggtcatgagaatttggtcaagaacctaacaaaaaacaaaaagaaagcccaactattcctagctagggaagtggtggggagggaacagcaaggggaggaaaggggaaatagaaagccctagcatatgagctaagctacagtgaactggtataaacaacaaggtcaaggtaaatgcaacctctggcagaccttccaataagaagggtcagtaaaattgtttattcctgtaggctaacataaagaacaagttttagactacttaaggctgtataaaaggatcctgtctcaaaaccagactttgaaatagttttcttaatagttccaagtaatttgtcatgcctagctcaagtgctgggcaaatagcaggtactcgaaagtattagatactggaaatatcaagttatcaggagtaaacttctattaaacttggcttgttttgtcttatcatcaccatcacatttcactgcgagtagaaattttagaaaaatctctttttcatttgtaattattttgaagtgacattccttccaagaaatagctttcctcctatatatccagcactcatacactgcacctgatttgaagatgaacaaatatatttctgcttaagaatttttgatttctgtctcagataatacatttgtaataaaaataaacactatttttttttgagatggagtctcgctctgttgcccaggctggagtgcaatggcgcgatctcggctcactgcaacctctgcctcccgggttcaagcgattctcctgcctcagcctcctgagtagctgggattacaggcacgtgctatcacgcccggctaatttttgtatttttagtagagacagggtttcaccatgttggacaggctggtctcgaactcctgaccttgtgatccacccacctcggcctctcaaagtgctgggattacaggcgtgagccaccgcccccagccaataaactctatttctaaatgcaccctatttcttaccattttcttcaaaatcactatgtatactctttcagttattaccccatatgtcctttaatggatgaattaaatattgatacactaaaaaaaattaaaatagctctgttaccaactatctcaacctctatcaaattatctatattgatattggccaaaataatattgatatataaatattaccagataatttctttgaaaatcttcttcaggtctatacatttcatagtatagaaccttaattacatttcaaagacaccacactagttaggcacttcactgggttttacctgaaatatcagtgtcatgttaaataattgattctaataatagtttattattgaatatcaaacaattgaaatcaacataaaatttgtgcagtaaagtatgtgtgattccatctcaacaaaacgataaataattagtctctcagagtgttttaatatagttagaaagaagccattgaaaactgaattataggactttttccttcctttttagtatattgaactcacacaagtcacctttaatttcttttctctactaccagattgcaaggagaaaattcgaagcctagcttctcaaggatttgctgtttctttattaattgttatatgtgcgtttcattcaaagtactaggtaatgctttcagcaatgaaatggtaacacctcaagaaaagggtaaattaacatctgattaaataaaattcatatgctctcatttagtaagagtgcaattaaattcatgtctttaaagtttaagttatctcaagtcttaagctcattttaaaagtataataaaaatactaaaatagtagatattactcagggtcactacgtaacacaactccacagagcattatttacacaaaaattttggtttatttaatttcatcatgcttaaaaccccgctttaaatttttttgatgttcctctttttatactgtagtactatttaatatcttcactaatgaattatcattttaaaaagaggaagagagaaaggaaaatgaaacagcacataacatgtacaatgtgcttttgactacatgcactagacatattttcaaatgaaaatctctaatgttttcttaaatccatttcatagcattagagtgctttggatcgtaactccatagacatgtgttataaatcaatactattatctcattcacaagtctgtagcagacaggcagacgtggatcccaggataatagacgtatttggtgttagatcaggctgacattaaaaaacgtgtctatggaatctaaacaatagattcacttgctgttttgtagaaagttgtttgttttaacatacttatacctctcatttcacaaaatgcactagcactgcttcagaaacctgtctaggaaaaaatactaagctactaaaatttaatagtagttttaggaatagtaaaaatacagaaactgtatatattgtcataaatggagaaagtccaatgttcaatcaactacataaatctaattttcatgagagtacaaaggtatccaaatgtctctggaaaaaaattgcaaataaatccccagatacgtagctataattgtactgtatagattccctatgctccacaactagtaagatacattctatcagttttttcttatgaagctaacgttgtgattaacattagaataagtcaagcccttttcttttgcaccaatctaatatttgtattaaaattatgtattgactaaatatgtggaatatcttccattaagaatatttgtaacctgagaacactttggtagagaatataaattataacctattaatccttaagagcttataaataaaagcttagaggcatcaatcagtaggatgttgttgttatatttaagacatcacaaaattgaaaataaattcagtttagtctaaatccatgtattctctgactctatgctttacacttcttagataacattttgaatgcagcattaagaaaatcaggcacccaattgcactgatgctagagaccctcaaacattaagactgctagagcaaatgcatttctctctctctctctctttaaagtaatttaggggtttttaaggtgatgtgagttaatgaaggaaaccagaattttaaagagtacaagtgacaagaaaaagtaacagaagatgtcagtcagggggttattggtttaatttttaactttacatctcctattccctgttttaattgggatgattgtaattgatgttatttagtgtctggaaagagagaaccatgagagctccattagccttcttgggataacaagcaaaggtaataacttttcctattaagcaaacaaagactgtggccaactctcatttggcttgtcagtgcctccccgccaggacggttctgcctcctcacttgtgtaaggagccggctggctggccggcacacaggatgtgctgtcaatattgcctggcgagttttaaaatcattttccaaatgaaaccctttaaaaattctatgaaccattcttttgctgaatgtatcagtcttttgctacttacaacaaagaatgtgctttatcttcaacggtgcttctctgtctttagtgtccgttttatttctgtccccaataaaattcattagcacagtagaacagaaattactctgttttaatatgatcatctatttcaatagaaaatgctcttacacacagatggcttacattttttgagtgtgtgaaacacaaaatttagcattgcataatctactaactgcaagtctctgatggacttataattatgatttcctactagctgatttgagaagttatttctgtagggagttcagtggacttcttatttggatgtcataaatacttaaatattcattttccatgagttgccagggacaatgggttcccagcagtgctaaacagctctctgaacagtaggtggcagcactgttcagctgccttttgtttggttttattttgccaattgaaatcagttccttcaccattagaacaaggggaaaaaagggaaaagcttcaaatgtctatatgcttacatataaaacccacataaatctctcataatttgggagtgcaaattaaaatgattacttaagaatcaaaatgacaaaacagttcatattatgttttctcccttagcttgttctatgtgattgcttacttttaattttgcctgtttttcactatttgaaggaaaaaattacaaacataaaatatgtccacaagtgaagtactctgcacttaagtacttctacatccatagttgctgccagtttcaagagagagcttcttcgtgtcctctcaaatgctccacaatttatacctaattttatcagttccaggagtaataaattgatacctaattttatcagtcccaggagtaataaattttcctctttctaaagagtagccagaagtctcagccagttcacagcgtaaagtttccacttcttgaagattcaggcattaagtatgtgataatttggtcattttacttagtatcacatactgacatacatatacagggttttgcatgtgcacccgaacatacaaacttattgtgtattgactgatgaggagcctgagtgtgtgaagccacctatgataatgaggaatttgaagtctgttttattcaagtctactgttttttcatttgttaactaagtgatcccgataactacctcacagatttgaagtgagaaatgaatggggcacagtatataaggcattctgtaaaagcaataatcccgttgttttattattctatgtctgtgtttttgctagacagtacaatgtaaggacaaacaatgtaaggatataatatacaatcttatatccccagcacttggcacagtatcatgcaaactttaggcactcagatatacttctgaatcaatgaataattgcaaattttcgaaacataatgagtttataatataaatcaagctggttaatttattgaagtaaatccaaatacccactcatttattcaacattcaaagaggtcctcattactctgagctcaaattctagcagatgaggtggatgtattaaatatatatacatatatacgtatgcaaaatttatataaatatatgccagtgctttagtccagtggttcccaacattttaggatccagggactggttcgtggaagacaatttttccatggatgtgggaggaggggagagggatagttttgggaaaaaactgtcccaactcaggtcatcagatattagattctcacaagcagtgcacaacttagatccctcgcatgcacagttcacaatagggatcccactcctatgagaatctaatgctgctgctgatctgacaggaggtggagcgcaggcagtaatgctcacttgcagcccccttcaccttctgctctgcggcctgtatggctctgtggtcctggggttggggacccctgctttagtctatatgtgaaacattgacataaactcataaaagtgacaatttatatatgatactttgttatttatgaagcacttataaatatacaaattatcccatttaatctttttaacaactattcagttagaaatatttaatactgagcaacctgagacttaagagtttaagattcttaattaagatggactcgctctaaatcatcacctcttcacactataccatgtgaaaagaacccacaggagtaatcagttcttgtgatgcacggccaatacattatggttacattaagcctgtacagtattcctagattaaatggtttgaaattatctatttaaaaataattacttctttatagatgttagtttccccttcagtgtaatagatatatttatgctctataaactaaattcctctactcatctatcttgcattgtacatttgatgaagtatcatatgtgttagtcattgtagtgacaggcagaaagaagcaatcatgtttattatcattccaagactctcattgaggaatagcacaaaagctccaactgccacttatcctagagaggtagcaatatgtaaacatcgaacactcaaggttagagctgagccttgaatatgagctggtagggctgaggccttcacttgagtcaacaactgcacttgaattttgcacagggagatgagggtcgtggaggaagaactcttacatcatgcatgcctaacccacaaggttaaggataaactgacaaggaaagtgatgtggattcttcctgcttgtaatcctcaactataaaggcattgcaagagttagatacattcaaggatgatgggattgttatgatttggatttttatcctaactttcttctattgagactatttcaactattaccacagcctttcatgcaactgctagagaccaaaccacaggttagaggaaccgctggtccactgtgggtatcacgttaactcacaaaattgcataccattcatgtgctacttcagatccttttgtctcacctgtttcttggggctttgctactttttgattttggcaaccacttgcactgaccaggtcttgtgggctccaatcagtgcaatagatatatttgtgctttataaactaaattcctccactatagtgatatatccatagatatatcactctatatatctttcattcttacctcctgctctggggattccctgttgacactgaggtcacaacacttgcccagcaaccatgcacatgcaacctggaagagaggggagctagcctactgtacaatgagcctttgaccaatgagagacaagacaatgaataatttttttttttttttgagacaatgtcttgctctgtcaccaggctggagtgcagtggtgtgatctcagctcactgcaacctccgcctcccgggttcaagtgatccccctgcctcagcctcccaagtagctgggattacaggcacgtgccatcacgcacggctaattttttgtattttagtagagatgggttttcaccatgttggccgagatggtctcgatctcctgaccttgtgatccacccacctcagcctcccaaagtgctgggattacaggcgcgatccaccacgcctggccaacactaaataaactcttatacctttctcccttcaaaaaaccttttctgagatgcaattattcagatgacaaaaaaattgtcccaagagatgagcaaagctttccctgacttctgttttcttgatatcgtactccattaaaaaggaaataacacaggtgcttttgcctcaagctttgctttcaggggaatccaggctaaaacacacactactaacacaaatagaaaatccacatcaaatacacaatgaaatccttcagccatcaccaatacttcctgaatctcctgcaaacactgaaatgagcaaagtcatagttttctgcagctctttaagaaaggtgtaaaaaaatggtattgattcaaccaaatgctctgaaatagaaagcttcctctttttgttttcccaacatattataaaatgattaaaattataattttatggatttaattcagaattttatttcacttatcataagcttgtctcataaaagcaaaaactatagagaaaaacctaaatcataatatctccccaatacaatacttttctgtgtttgaagtttcacatcacctcaaataattgactgattatatagcatgcatatgctaagtcagcatatgtcagtgttcagaaaatgttgaaatgagattatttatgtaatttataatcaatcttgttccaaaaaaagatttaggaccaacaactagaaaaatgcaatgtggtcaaccaactacttctatggggacactttctctatttgaacgcctcatgtttctttcatattttttctatcaaaagtggtaatcccacaactctccttctcagaaaatggatcaaaaccaaaagtgaaataatccaggcacatttgtccctagggaggtgatacggtttagctgtgtcctcacccaaatgtcatcttgaattgtagctcccataattcccatgtcttgtgggaaggacctggtggaagataactgaaccatgggggaggtttcccccatattgctcacatggtagtgaataaatctcacgaggtctgatggttttacaaggggtttcagctttcacttggctctcattctctctttgcctgctgccatgtaagatgtgccttttgccttctgcatgatatgaggcctccccagccatgtgaaactgtgaatccattaaacctctttttctttataaattacccagccttgggtaactttatcaggagcatgaaaatggactaatacaggagggaaagaagtcataacatttagtttatctcgttgtttatatctataaaatgaacattggtttgaatcataatgagaataataaatatatacacacatcgtgcactcttggtatatggttagtcaacatcaagtaattaagcttagaggagagtagcaaagaaaataaaaaatttaattagggccatagtgagaggctaaaaatcagataatattaacattttccctttattcagaagtcctttagtttctgaaatctccataataaccacctttttcatgacctccttacccaattccaggtcagactttcaggaatgctttaaaaagtcaacattattactataaataattactttgcaaaatttaaaattattattaccagtaaaaatgaatattatatatctcactgccttcttcgtctgtatgtcttttaagtcaaatgcttttttttatgattgaaaatgatcttctaatttctactgaactgtaatcaccttgaaagtgcgaacagatttatctttgtaaaacttcagtattacacatgaagccttgcatgtaagaggtcagtaaatatttcctggataaatgaatacattttttgttgaaccttaaccagcctctgcattactagagcattaatttcttagagtgggttaataaccataattaattcaaagttgaacaactgggggtagatggtggaagttgaaacataatcactgttttaaaaccaggttaatgcagtttccaaatcaacataatttgccagtagaaacatcatcctggaagaaattgacaaaacaaattctaatcacgagcttgtgttttgtattacagacagtttttgtgtatttcaacttgccatgttgaagaatacagccagggtggcttcctatgtaattgatacaattcagtaaaatatttctgctgttttaaaaacattttcctgcattaaaaaaaaatcaatgtttattaaatcctttcaaatgtttaaaataagattttatagctagaacagatcttgtctagtctggtctgaacttggagaaggtaaaacttttaaaaaccaaaggtaacattgtttcttaatttatgttactgtagctttgtactgtcttccttagccaggtatattgctcttctctttggtatttcctttgttatttctttcattttaggaactgaaaaatgaagtacagcaatgcttcaacctggtattacagtttatattagacagctagcactcatttttctccttttgtaactcctagagattgggggaaaaaaaaaaaatccctgcttttgattaaatcatctttattcaaagttagcttaaaaagtaaatgaaaattcatctgtgtcattggaagagatgaaaacttcattactgtatattttttaaattattgtaagataaaacaaatgactcacttggttctttaaaaatgccaaaaaataaggagaaatgtttgcttttactagtagatatttatattattatcaatactaatgagatgaaagaaatcggagctgatttcaaggtagaagaaaataatatggaagaaaaataaaaatggactgcaaagtgttttttgtttgttctgtttcctttctaagaagtagagatctggggaaaacaagggatgtcagaggatctgtggtggtagtttcctcttccttttttgtagtatgcagaagggttgttccttttgcatactatctcatcttctcaatatctggcctctaagaaaatattttttctaactactgtaaattgaggataaagacacatatattgtgtttatggttaggcaggggaaagaggggccacaagaaagaaacatagacactaagcatatgcatccacagaaggagagagagatacacactacgaaatgtaggccggcatgctgaaccattgagaaaacaactgagcagaggttatctagaagagtttattaaaaacaaaaagattaattaaatggagagtcttgaagataaggaaaagcaaaatggtaacctctttctaaagtactctgggccaaccattttaacagtgtgtattagttcctacactgctatttaaaaaaaaaaacaataaaacaacaacaaaaaaaaactctgactggataattacgtcggtgcaaaagcaactctggttttgccattttatggcaattaaaatgctccggtaatggcaataaaatggcaaaactgtgattactattgcactgactcaatataaagaaaagaggtttaattgactcatggttttgcaggctctacaggaagcatgatgctggcatctgcttggcttctcggggagatctcagaaaacttacaattatggcggaaggcaaagtgggagctggcactttacatggccagagcaggagaaagaggggcaggggtgctacacacttttaaacaatcagatctcataactcacacactatcatgagcagcactgagggatacctgcccccatgatccaatcacttcccaccaggccccacttccaacattggggattacaattcgacataagatctgggctgggacagagatccaaaccatatcggagtgattgtatgttattttttaactttctaatggaaatacaagtgaaagtataaatagtctcaaggccagtttcaataagtgagcgagagttacctgtgacaatgaatcagaaatttgaccaaatagcaactcgcagaaagacaagtttcatgtggtccagaaggtgaaggaagaaaagggttttttaaggaaatgatttgtaccccaagactcaaaagagactgttcattgtttaagcgagcttgttccagttcttactttataatgggctgttacacttcttaggattcctagaaaaattaccattcccaaatgctaattgcaattccattttctaaaagtcagtattttgcaacaaactatttaagtgaaaaaaatattgtcagctctctacatgttttattttagcctatatttaaatagttcatattgaatctgaaattatactagagttcaaaatcaatgtttttgtttctcttcaatccaacctcaagctatactttatagtttctctttttcactcaacaagaaaaagtaacacatctaagaccacaacaaaaataaatctgatagaaagcagtttgttgctctttaggaataaactcaccacaaatattccactgctgtattgtagtccatagttagaatgagtaaattagaaataatttacccaccctaaaattatcccagaaaaaagaaattcctagggacttagaaactcaggtggaagatgctctttagttacatgctgtgatgcccttgcttaataataattctgtgactgaaaaagaagttaggaatctagtgtaatctctgtaatcagtgattctccttcaattacaaaaagcggagctatagtttttagtttcaaggattcctggctcaaattccagcagggtttgttcatgtacaaattgcaaagctactcacttgattaagaaggctaatttaatattgctatgtggattgcacactcacacctcagtgattttactaatactacttcttcctgggttcctatggggaattttgaaggtgctagatcagcgttggtttgcagaagcatgcagtctgctgtagcttcattaacctaactggaagtgggcctcatttagcattacccagatggtaaaattggggctgattatctgctctttggaagctgaaatgtgctaataggtcaggcggtacttcacaaagtttagtggacataggaagcagctgggagcaatttaaaatgcagattacataatcccacttccaaagattctcactctcagatctgggtaaaattcagcattttaaaacaagtatcctcctcccctcctacagcaggcctttccaggaagttgaagagtaggttggatggtcgctctatcaaatggtggtttccagacattgcttcattcaaaacaaaagtctaagtcttttcaatgacattcaggaccctaaatgatctagtccccattacctctctaatctcatctccctccccatcactcacgttgctgtagccacacaggcctccttactgtgcctcaaacattatcaagactgcttcaaccccagagattttgcatttgttcttccttctgtttatagtgttgtttccccaaatatctgcatgtcagtcttgcttttttcctttaagtcttatctcacatgtcactttctccatgaaaactaccctgcccacctaatctaaagttgcaaccactctgtatttcttctccctttctttgatttaatttccacctgggcatttatcttgttattttgtgatttctctaatagaagataagctcaacaatagcagaatttggtttttgtctgttttgttcacttctataagcccagcacccaagacagtgcctagaacatacataataggcactcgccaaatatttattgggcatatgaattaatgatgaggcactgcgtagagttatgcaatactgtggccttccaaacagttggggtattttccacatcagcccttttgtcagaaaaatataattacaggtatgactgaagttcttcaatttcatcaatttcagcagtacctaaacaaaattgaaggctaaatatattctggctaatgcaccaaaaccatccttaacatcagaaaatctgtatttaagtgacagctctgtcatttattatcttgtgtggtcgtggtcaaatcatttgaggattcaatttaaaaagtacgtcactaatctcactaatgcatgttctacaactataaaaaggtaataatagtaaaagcttctcccaccctatagaatcttcagaattaacttgagaaaagctttttttatattatacactactaaataaatatgagcaagtttatactcatcatccttcacatttaacattttaacttgatacaacaggctgttacagtggtggcttctaatggaccatacctcactatatccatgaagtcccacagtgatgttagaacttagccaggagacttgctttgactgattgcatattaacaagcacaatacaagcagaggcttaatgagaggcatacaggataataagaggcccactggagcttaccttgtttttcttttttttttcttttttttttttttgaggcaaggtcttcctctgctacccaggctgctggagtgctgtgacatgatgatagcttactgcaaccttgaacttctgtactttagtgatcctcctgcctcagcctcccaaagtgctgggattacaggcatgagccaccacacccagcgagcttacattcttgaaagccagttccgtgctttaaataggcttgagctagactacccaccaaggaaaaaccacgtggaggattcgcaggtaggtgagaggctatcttgaatattttgacctcagctgaatgcatgaggaagatcagacaccacgtggaacagaagcacctcccagctgagtccagtcaatcacagaatcaagacaaataataaattactgttttaagacctaagttttgggatgaattttaatgcggcaacagaaaattgaaatccctgggtttttaaaaatgacatcatagctttaaaaaaatactttaacagcaggaattctgaacattgtatgaaagagagaagataataggggaaggaggaagacctttaaagtaaaatcagatgttcacctacttcacttacttttgaagcctaaatgacagttagtacataagatactgcttatgcctatgaaaaaaagggcctcaaatagagtcattttgtataagtcactgtataatcaaaatctatcttgaacaaatgacaacaaaatacaggacaaagaaacctcctatctgcttttctaagacttgccggtcgagagtagccaacccactacgagaaaattctgaattcttattctgtaacttacagtagttacctctgggcaggagtctattgttcatgattaggacttccaaatgggagcaaatcccctggcaacttccagatttaccagtggggatttgcactttgatgaataagtcacactgctaaaaattcagcatgggtcttaatcggtgctgaagctaagttcggaataaacaaaggtcagaccctttttgctgtcattcctcctttgtgttattaaggtcttgtttggaagcattttgtcatacatttggcaaaagggtaggaagcaaagtagtgaagtccttgtgaatgtacaagcagtcaccagggcactttgttaccattctgagagaaatgttctcaactcggaaagagctctgacatttttaaaagagatattgcaaacgctttatgaagtctttgtgtcctccaggccggcattgttgtttagcgtaatagccttcactttctaagcaaaatggttgggaagcttttcaatgtaaggtaaaaggtgtcttcctactaccagtaagtaacatgctttcatctttttgtgtagtttttttttttttttttaaaaaaaaaaaaaggaacacattcaatgatgccatgaaatatgaatgagttatcttttccaaatttgtagttaacatccttgttattgtcaaagaattcaagactccaaagagtaaatttttgttgaatccaggacaggatgccaagctagattctttggtactgacttacatgtgtcagaactgatctccaacaacattgcaaatttatcaacaactgagttcagtatgcctgaaacactctgtgggtggcagaaataaacaccacacacctgtgactgactagttattattaatttctcagtaactgcaatgaattcagtgagtagaagaaaaaagtgtcagaaaagtgctatggtttacagaccttttttaaaaagaaattcatcccacacaaagccatcaaatgaggatattcttattatctgaaatctatgtgggcttccaaatggtaatgctccaatataagtattatgctgcagagaaaaaattcccaccttataaatggtaatatatcagttttcctctctctctctcttttctctctccagtatttgattacatgctttcctttatgaaatacgtggtaagtggcaatattgtaaagcaaatttttgctgaattaaaaatatagattttaaaggtgtaatgcattatattatatatattactgagatcttcggatatgccacagactgacctccaatgtccatgttagtaattattctaaaaatcttttctttagagtgacagaaccccagaaattttactttgtgttatgcagtgggttgaataggagtttgtaggtttcattgatagtaacgtaccttttccagagcaagtgccaacaattctgggaaaactaaaaatactctaaagcagaatgagcgttaatcggaaagcaagagaactggtttcttgttctcactacattctgactcaaccacccatcagtttctttatctaacaaataggagcactggtatctggtctatctctctgggttgttgcaacctttagtcagatgatgtttataaatgtgatctgtaaaagcacaatgtaatgtacaggatcaatattaggtgtgttgtttttaggcagcactaatgtatttttgttttgtactgtaagctgtgcctgcttgtctacgttcacagtgcttccacctgtccatgcagtggaccttctccttggaaataatcctgtgtaaatatcttccctggaaagtataaaccaaaaagaaagcattctaatctggctgaatttcatatctaatatagagtatttggaggccatagaagtggaagaccattaaggaaagaaattcattagcatgctacatattttcttagtttaagtgacaaacaacagcagagtaaggctaggccatatgggaggaaagaagctaaattccttgtggaaactgtaaatccatgtctccttctcctccaacccaccaaagggtgatctagataaaacatgtgacttaaaccctagatcagcattcagtaagtatgtgattcccaaaatatgcagggaaattgggccaatctgacttttaccttaaatggaaaatcttgttatttccttttggagaaagtaaaggagcaatctaaggatacttctacacccaaatttaaagtggctgttgacagggccagaaaaggagatggagataaataatgtggctggaagtggatggattatataaaaagaaaaagacatgtaattagatgcaagtagatttttggacatccactctacaacggtcacctttagtattcatgtaaaccattttggagatactaaagagaaaaaaggaagagtcagaaaagaaaataaagagagcaaaggtctagtaatgaacaactacatgcaggcaaggatatgctaacacatgtctgtgaacctccacaaaccagaatatttaacagagagaaagagaaggaaaatacaacactgccactgaatgttgtgttaagagaagataagatcaaatgtgtgcctttatgaaagggaaatagcacagcaaggatgatgactatgccaacccatccaggggttttgactgtcacgtgtgacacacagataagagcatgttcaaaggatgagggctgtttgatagagaacagcaccgtgcttataggaaacctatataaaaatctggacgttatagatacagaggggtctatttgcctggaaaaatgtagttcttgtgaaataagaaggtgggagaaacgccccccaagtctacatacaccaactcagaagaggtctttagtctaaggactttgagcaaatgaggctaatgaaagaaagccaccgtgtttgatgtttaagaggacagatgtataaacaggaaaaagttaaaatgggattactactttacacctccaacaaataaaataacagaagaatactatcatggtgctttcatcattagcctcaggaaatatctgcccctgtgtaatgtggatcctgcagaagaataacaacaacacaacaaggatggcaacaaaaaccctgcatactcttttacaaaatatatatgtatattttcttctgcttcaaaaaaaaaaaaaaaacccttaaaggcagagagtcctgtgtttcatgtacagcattgtcaagttgtctggtagagatgagaaagctgacagccctctggagggcctgagctgaggctgcgtgcagaagtctggaatggcagagacctgatcccgcatgtaatgagaccaaacagagctggaagggaaactctgctcgtaagccccttcagacaaagaatcaagcagcagctgcttgcctgtcatgcttcaccttcctgtccatggtcctccttttctgcaacagcaggggcaacacgaaaagactgaagtagattacagttagctcagaggccatataggcactgtgtaaatatattcattcatttatccatttatttgaaatttatcaaaaatttgccatgtgctttgtgctgtgcaaagtatttgggatgcagtggtaaataagacacactttccagcaggaaagttttcatagtctggtgggggaagtgaaaatgtaaacaaatcttcatgtgtacatgagatatgcatgtttattccaagacagctaaaaccatttcccacaagcatttcaatgcaaacaaaaagctagtccattaaatatatatgtatcctcctaggtttgttaatcttaaagctagaggaagatcttataatgacagaagaattttggccctgtacataagagtggttaagaactgaagtctttttaaattatacaaggaatagacatagtcttttagttataaaatttgcattgacaaactaggtgttaactgaaatccttgtcataactaaatcgcatcttagtcatataaaatctttgtcgtgcaagtataactcaggtacataactttgcattctgcagaaggagtataattgcatatctattcctttctttttaagaataggaaaagatttagcagaacaaagaggttgctcaaagcctcccagtgggcaacagtcaaccttaagtgtgtttaagtgggcttggggggggagattcaagtgttaaatcatataattatattaagagagatacctgaggaattggggtattccggttataatcatatacttgaaaacatgaggaacaaggtacaagtaggttctttccttttatttaaaatataaaagacttataattaacaattaatccctcctaaaggcacttagtgatttctcgcttaaaaaaaaagggcttcactccttgtggttggctgcagcaatcaaaaagttcatatttaaatggaaagaagtacgtcccacactaatattaatggtacaatggtagtaggaacagaattgataattgagttattaatcaacattgccatttttaagaatatggctacattcttaaaaagaaaaggacaatgttagtggcactagcaccctgggaacttggctgtgcccagactgactcctctttggctctctgacttcctacataattagaacttaaggtgtaaaattggaacatattacagaacagttgttttcacataaatattaaagcagatatcatgtcaaggaagaaaataaccagtctcacaatttggctgaatgtagaaaaaaactgaaatcagcaataggtagcattttttttactttcatctatttatttaattttttaaatttaattgttttgatacctcagttttctaatcagtaaaatgaacatcagtggattttagagagatactttaagacaactttggaaatcccgtaaaactaaaactgtacttctcaaactttaaggtacatgtgactaactcaccagtggatcttgttacaatgcagattctaacttagcaggtctgggttaagccccaatctgtatttctacacatctcattttaagcaacgagattctaaaaacaccttgcccaactgtaatttccaagtatgtctgcagcaactatcattcatgccacatgccctttggcatgtaaattatttgctgctgctgcatccggaggtagagcagcatctatttctccatctccttaaatctgagtgtgcccttcaaccatttggacaaacaggctatgatgagactgtgccattttgggttatatcccttaactgcactggcagcttcaacttccaggctttgggagccaggtgtcatgaaagtagtatggctaccgaagaccattataacatgagaatcccaagccacttaaggaggcccgggaggataagactaccatatgaagagagacaaaaagacagagagagagggagagatgagacaatgaggctgagagggagaagaatcaaagagcatggaggcaccagtcacaggtgaagaagctacattgaaagtagaacctccagcctcagatgatatcacctggatcagagaaaccatgagccaagcctttcttaaatttctaacacacaaaatctgagcaaatttaaatggttgtttcagaccctaaattgtgcagtgtattgcttctcatcaacaggaaactaaatctgaattaataagtaagggaattttaaatagacataaaagtgaaaagtcagtactttaatactatttacattcaatatatgtgctgataaagcagcgccaaaaaaaaacttgtgagtgacctgtttcatttcccacttctgaaaaatatagatattgtatcaatatccaactgcacaatctcacagttaagaggtggaactgggatttgatgtcaagtgtggctaatgccagaaaaagcacacaggcagggaacccagctgagaatgttttacgaaaagcttccaaaatgagaaggtggttgaacccagtctccatggagaagtaggagttaaaaaagtgacaaagtttggtaggacaggtatctcaatcagagggacagcagataaaaataatgagcagtctgaaagaatggcacattaatgagtggaacaggaagactgaagtaacaaaagataattctggcagtggctcatgcctgtaaccccaatgactcaagaggacgaagcaagaggatcgcttgaggccaggaattgaagaccagcctgagcaacagagtgagaccctgtctcttaaaaaagggggaaaaaagataattctggagcagtaggcttcatgctgtggagagccattgcaaacttttaagttgacaaaagatttctgaccaaatgtagattttaaaagattaagcaatttggttatccaattggaaaaatttcaggctagaggtagacagacaagtgtgaaggttgttgcagcattacaggcaagacgtggttctgttctaaactaaggaatgttaagagggaaggaaaatactggttataaagatattttagtgataatgacaagtgtcatgatatggccacaaccatgacaataataaataatatttattataaatcttattatattaaatataatatttaataatattgatatgataaaagtcaaattagtgattaacatccctgtctctacatagattgtgtcatgaagagagacagggatgttaggaagagacactcaaatttggtaccatcttacctttattctaactcttcttataaaacgctattatattaatatttctcagatgtactaatgataagatccttctccttcagaaaaaaaaacaattccaagaaaaaacaccttcaaatgtgcattatcccacagcataatattaaaactcctcacgacggtaatttaaggcttcttcatgctttcccaactacatccttggttttgtctctctaatcaccttttacttattcttcaatcagtcacatggacctcctcctgtatgtactccatgttttgttatcttgttcctttgttctagatgctgcctctaactcagtgcttctcaaacttgagtgtgaatcggaatcacctacggaaattaaagcacagattgctgagtcccagcctcagagctcctggttcagtaggtatagggtgggacctaaacacaacctcaacaataatataaatattatttattatttataatgataattaatatttattattattattttgactgtaggatataataagctaaaaaatacctctgcctcccccagggatatatgtgttctaattcctggaacccataaatgttactatatacggggaatcaaaggggtctttgcaaatgtgattacctgaatgatcttgacatggagaaatgatcctgcattatctaggtgggctttaaatacacaagtattctcattataggaaggcaaacagagagtttacacacaaatagaggtaaagaggatgtgatgtgaagatagaggcaaagatcagattaatgaggccaccagccaaggaatgttggcagccactggaagctggaagaagcaagaaatgggttctcccccagggcttctagaagagagtaggtccctgccaacactttaatttcagcccagtgattctgattttaggtttctggcctccagaaccataagagattaaatgtcatttgctttaggccaccagtttgtggcagattgttacagcagccacagaaaattagaacacaggaaaataaatcttctttgaatttcttagtgctcctgtaaaaagggccagctttctgggacatggaaatctgtatgatataaggatggagaaatttgccttcatttcccctcaaaactttttccttttcccatactataaggattagatctatagccatttgtcaagttaactgctctgttccaaaggataataaacctcatcaccctgagggaaccaaatgtttacagcctggactaggcatctaggttaagctccctgggagccagggagatgggagctctatctccctatttacatttcaatggtaaataaaacccaaaatgtggtacagtagaaaatacctgacagtggttacctgttgcatccaaatctgagcgagtaagatggtatataaataccaaattgaattgaagataaagatatccctaggtcataaaagccagaaatttgaagtttgtggagagattcaactactgggaaggatcctgggttatcgtaaacccatgagcctttccatttcgtctccaaggagcaaaggtttttctcccttctttgaggattaaaagggtgcagctggctttctcttgtatataaatggccaaaaacaaaaaaatctatttttctttgtctttctctcacttatgaagtatttggccacttgtgtaagataatattttatctggcttttattatgttgctccaggggtaaggactggaacaagaggggccaatttagttattatataagtaataaataatctgtctctggtctagaatacctaatattcatactaaagattaaaattaataaagataaataataaaaaccaaatacctatgttctaaacatttctccaaacctattattatctatattatacagaagacaacactgaagttttgagaatttaattaattttattagaatcacattaatgataagtggtatagccaggatttcgtgtaagacatatttgactccaaagcccttgctttaaaccatggatttaataattaactttaaagaagttaattattatgaggtagatagaatctaggatgattcaacatttatgacttgggctcttgcatatggtagttccatttaccaaggagtgtacaggaactcaaaatcttttaacctggaaagacaatgtattcaatttccaatatgttgattttgataccataaaaatattttttcaaaacattctaaccaagtaaaattgtaatataatcgaacagatgagcaatgaagacatacatttctgaaccactcacaggtaggttataggtaaagctttggtttggatgagcttcttagaaagtctagagtgaatgagaagggaaggcaatggaggatgggccattaagtacatggatggaagaagagttgatgtgaaggagccagagaagtaggtggaatgacaagaggaagtagaaacatggagtgcaaaggaagcagtcaaagaaaggaaagtgatggaagactggggaagagagaaatgggaagctaagtcagggatacagaaaggcaaaacagtatggtgaggaaaatttaagaggagggatgacaggaaagactcataattgcaatgcattatcccatgtaatccataaggatgttttccacaggctcttttattattaatgtcaaaagcatgtaaatagcacagtaaatgttttgtcattctaataagttacttgaagatatttgacatgataatataaatgttgtagttaatttagaggaaaagggcagtttttatatagagggataagttacaactaaaagacctgtattagaatctctttttgttttgcattcagtattgttataaatttctgcgagttaattgtcctctctgaaactcattctccttaactacttgatgacaataatgtcggcctcacagtgttactgtgaaacttcagtaagtaatgtatataaaggtatctaacacagtgtattaacatacaccataagaaatacctgatcaatgtatttcctagtacatgtaggaaatagtaagaaatacctgatcaatggacatcagttgaatctgaagaactataatgacatataaatatggaagcaaattgaaaactacaaaaacatcatataccaactaccgtataacctcgttgtttgtcagtatacaatgctacagtcttaattttgctttgtgtttttattgggcacaagagggcagaataatattaccccttgtcaaaattggactagacctaagcagaaaactttctgttaacagcttatattctgaaaatcaatcatctgaaaaggatgaagataataaaataactataggattaagtgaaatttatttatgttttcaaccaaacaataaaagtaataaatgtgtatttgaatttatctgtagtagtataagttgttgaataccgcttatgtcagattatgtaatagagtagtggaaaacataaaatgttaaaataacaaaataactacacgatcaattccatcaagaaaaataacaaatataaaaatgactcaagtatatggcaaaatattacgatcaccataaaaagacagaaagtctaagggagttccaaaaaaagagattatatgtgatcagcaattctaggtagagctggtggcacttcagttgtaccttgatagactgactttagaacttcagctgaagagaaagtggggaagggcattttaagacagaggggaaaacatgagcaaaggctctgagctttggacagctgagacctatttaggagagcagcatagtttggttggaatgtatgaaacctttgtgggagtgatgaatacaaaagctagaaagatacaaggacatggtttgatagacattgagtgctcaataaaaaaatgcaaacttcctttgtgagacaaaagagaatcactgggatattttgggtaggggagtgtgtggaccagagttgaatttgaggaagagtatttgaagggaaggatttattgggtttgtaacatcaggtagaattgacagaaagttacttaaagctaatggagaccctgagttacagaagagtagaagaatctaagtttctctttaagaaatactataaataaaaaatgaagaaaaaaaaaaaagaatgacttagaatatcatcattgtgcaactcctaatgaatcaatggatttgagcatcaatggctgataacctcccaaaaagagacaagcagatattatgttgaataatggaagcgatttgttaaatgatagacactataaacttgttttgcaaaatacaaaacaaaagaaaaacctgaatttgattgtgcctctagatccaactagtagcttagaaggaaggcataaaacacaggaatatgtcaaactacactctaacaaggcagttgacaaaattacacctatgggaaactctacaagtgaaaaatctagattcttcaacaaataaattgcaaaggaaaaagagtgcagggagggataaacctatatgtgatggctaattttgtgtgtcaacttggctgggccatagtctcagagatttggggtcaaacatcattctggatgtttttctaaaggtgtttttggatgagattaacatttaaattggtagactttaactaagcagattaccctccctgatattggtgggcctcatttaagcagttaaaacattaatagaacaaaaatagaccactctcaagcaaggaggacttctgtcagcaggctgcctgtggacttgaactgcaactcttcccttggactccagcctgccagccctaccctgtgattttagatttaccaagtctccataattacatgagcaaattccttaaaatctctctctctctctttctctctctctctctcctacacatactaacatacacacatttattctgttggttttatttctctgtgttggttttgtttctctggagaaccctaattaatacactaaagatgaaaagagacagaatatacaaaaggaaaaagaggcaaaaataaaatacagtgtttggggatgttcatttgttctataaaactacaaaggaaagagaatggaaaggggcttctgggttgggtggcaaaattttatttcctgacctgtgtaatggtgaagtgtattcgctctatgaaaatgtattaaactatgcatatgttttgtatatttttctagatctgtgttagatttttataataagaaagcaaaagaaactagagaaggaggataatagtcacttgctattaataatagctaactcatatcagtgagtaattctcttggaaaccataaatttgctaagaattttaagtattaaagttcaaaagtaacttattattgcataacagttctctttgcctttgtggaacgactgacctattatttattagaataagaatatgatacaatgacaactaggtaactttttgcataatggttgttgtgtaatacatttaaatgactattcaggtgggttgagaaagcacttcaccattggtggcttaaaagtagtaaaccagttaaggcaatattccttgaacagtccaagctacaacaccacttggctcatgaattcttggcattcaaggccaacaggaagctagatctgctgtccagtttctgcaggtgcacactcagccaaataaagggatgccaaccacattaatgggatcactaaaacacagtctgcaaaatctacagaatgagaactgagcaaggtattaggaacacagcactatctataccagaacaatagtctatgccagcattggccaatagcttacagttaaaacaaacaagcttaatcactgagataccaaggattcctagatcagtatttcaacagcttcgggatggtatgaagaaaaaagtgatagtatagtttaatgtctctatattcaaagacaaatctgcgtttccagatatatgttgccttgaatgtcatgagtacctaaaatcgtgtgtgttcaaaaggaatcacagattcttcctctcactgtctcttcataacatccctgtctctcttcattgtacaatttacatctaaatttccagaagtaaagtcatttcccttcttcttcccacttcatttccaattagaggcaaaatagatttgatttcaaagcttttgaaacacttcttgtaactgtccacttaagcaaataaaacaccacttgaatctactcacttctctccatccctgctttcaacatcctaattcaagctcttctacttcttgggtggaatacaacatatcccctaattcttcacagcaccatcttacctcttttctaactcttatgataaaacattattatgttactatttctcagatgtactaatggtaacatccttttttcttcagaaacaaaaccaattccaggaaaaaaacatcttcaaatgtgcattatcccacagcataatattgaaactcctcaggatggtaatgtaaggcttcttcatgctttcccaactacatcctcggtttcgtctctctaatcactttttacttatccttcaatcagtcacatgggcctcctcctgtatgtattccatactttgttatcttatccttttgttctagatgctgcctctaactcagtgcttctcaaacttgagagtgaatcagaatcacctaggaaacttaaagcaaatattgctgggccccagggtcagagctcctggtttagtaggtatggagtggggtcttaaaaatgtaactttctagcactttcccagggggtgctgacactgctggtctggagatcatactctgaaaaccactgctcaagctaaatagctcccctctatttctgctcctgcaatatggccacttaaggcttcatgcaaatttccttctatccctgggtaatgcctccagtccaaaaccatcaagacatttttttcttctgaatgcctatagtgtcatatttctatcattcttataatacttaggatagcccactattcatgtagtcatgtggtaaaatttaattttgcctatagactgtacattgtttgaaggtggtatccatgtgtaaattttctaaattatagatccacagcacaaagcatggtgtcttatgtacgagaaataaaataaatattttcttcctgcaaaataaatccatctgatagaggacataattattctaccacaaatatctatcggcacaggaactggcaaacgtaacagaaggctttcttttggtgcaaagcttggttttcactttgcatgtattcatgctctgccaatgaatctgggactactgctgtgtgtccatctgttagaaccaatcacaatgttttggggcaaaatactggggcaaaatatttggacaaaatatttaacagctcaaattacaatatgttatatatgatgagaaaaaagctatgacaacatttgctgtacaaatctcatataattaacactttttttccctttttttcagagaaaggtaaatttcagagcaaaatgatcttgaataaaaagcctcatggtctcatgggaaatgcagaacaaggttgtaggcaataggtatgctgaagtgtggcataaccagttgtctctgccaaaagacatctaaacacttaaacaaaaatctgatctatctgccaccattggaactgacttaaccctttatttcttttttcttcttgttacatgcaaaaacttggaagtacatttggtcttcatgcttttcctcttgtccttcatgccccttcctcttgtcattccacctacttctctggctccttcacatctcttgtctttagggaactggcattgtttcttagtatagtatcttggttatatggtttggctctctgtccacacccaaatctcatgtcgaattgtaatccacggcattgggagagggacctggtgagaggtgactggatcatgggtacaaatttctcacttactgttcttgtgatagtgagagagttctccttagatctggttgtttgaaagtgtgtagcacttccccctttgctccctcccctgccaccatgtgaagacaaacttgcttccccttggcccttctttcgtgattgtaagtttcccgagtcctccccagatatgctgcctgtacaagccatggaaatgtgagtcaattgaacctcttttctttataagttacccaggctcaggtagttctttatagtggcatgagaacagactaatacacttgggtatgaggaatctggtgttccagtgttgctactgcccctatctacctggtgaaatactttatctcattaggcgtcacagtttttatccaccaaatgatagggagtgaaatgttttgtttatctctgtcatttcctaaatttattcctcttttgagggaagtagcttccatggcactacaaggtaacatatcattctcctgaaaagattaataggacctctgcaaactagtttttatttgaatcaggaatagcatgcttattatattcattacaactgaaatatatttagttcataaactgccatttctattattcaatcagctctatatatcagcatgacataactgcttgatgcacttaagtaggactcacaacctccagtcacttggttcaccaattacacacctatagtagtgtacatatctttcattttaaatagcattattttcattgtcactatcccattaagaggtcatagaaacattagtaaaaagtgattgaataccactttgaacttagaacaaagctcagtgggatatttgaaatgtatgctaaagtaataagaaagagataattgatatgaagagatgaaaaaaaactaaacaaaatagaaaaagccacattgtgaacacacatgtttgaattctaagagattgatactatccctattaattttaacttctaatagagactttcatatattcttatgctattctgcattcgtttctgaattttttacagcattctaaaggcagggtaaagttaacacagcactagtatttcaaatatttgtaactaaagaaactgaagttcagggagctgaagaatttgccactcataaggtaacacaccagggctggaaatctttttttttttttttccttacaaaccaatatctactctctggaagtactgctgtgcttatgaacaaaggtaatatatgaatatatgatcatggttacatactccgtgagtatgtgaggagctgcttcttaagtgactttgtgtctctcttaatattcaacatagtgcctatagcacaataggacgatatatctaggatactttgttggataaacacatcagaatttcatttgtcctggaaaattgaaactagatatgatcagtgaataaaatccaccatagttttaggcttctggttaagatggagcaacatgttgatttactctcccaactaacatctaaaaaacaacttaaaaaactggaaagaatatatcaaacagtagtactcaagacattgaatatcaggcaatgaagaatgtgacccctgagaaataagccacaagattgctccagcttactgtttaagtaaatttccaggtcacagtgcaaggagagggaatccaagtagagacaggcagtctcctatcttgagcagaaaaaactggaatcccagagaaggcaaagcaagtggagttcacagggcaacagagacatagaatagggaactgtataaggataatccagagaactgcagagtgtccctctttgaggattcactagaataccgatcagtacatggatgtgaagaaactatccaaacccaggtgaagaatcatccaaatttattataagaaaaagtgcttgattttcacataagccctaaataatctctgttcccaatagccagagtagaaaacttcacacttcaggaatcatcaaagaattagaagggtcatgcctcagtattggggaaaaattaactctagactaaatgcagttgtattctggcctaacaaagcttttttaaaagcaagacctgaaagttacttcccaggtaactcagcatctcagaagaaagttcaagaatatctatgggaataaaaataacctaactttcaacaagtcaaaattcatagtaaggtatcttatcaaagatcaaaatgtacacaaagaagcagaaaaataaaagcaataccgaggataaaaaataaattaatcaggccgggtgcagtggctcacgcctgtaatcccagtattttgggaggccaagataggcggatcacctgaggtcgggagttcaagaccagcctgaacaacatggagaaaccctgtctctactaaaaatacaaaaatagccgggcgtggtggcacatgtctgtaatcccagctacgcgggaggctgaggcaggagaatcgcttgaacctggtaggcagaggttgcggtgagccaagatcgcactattgcactccagcttgggcaacaagagtgaaactgtctcaaaaaataaataaataaataaaaatttaaaaaaatcaaaacttacccagaaatgatacaaataatattactagtagacaaagacattaaaacaattactataattatatttcatatgtttaagaagcaatagacatagaagttataaaaaaagaatgaagccaaaacacagggataaaaagcctattggatggaattaaaagcagattaatattgcagaaaaaaacgaatgaacttgaaaatagagaaataggaaccatcaaaataaagactgaaaaaataacacagaaaatacgtgtcaattgatggacaaattaagtaaccaaatatgcgtacaattatagtcactaaatgagagggattaaaaaaaagcgctgaaaatttttcaagaaatcatgttcaaacattttccaagtttgacaaaaactataaatccacagatccaagtaacataatgagccccaagaaaaagaaatatgaattaaactattccaacatcataatcataattaaattgcttaatgtaagtaataaagacaaaaatcataaaacagccggaggaataaaaaagacacattatataaatagatacataagagtgacagcacatttctttttttgtttgtttttcttttgtttgtttgtttttggtttttgtgttttttttgagacagagtctcactctgtcgcccaagctggagtgcagtggtgcgatcttggctcactgcaacctccgcctcccagattcaagtgattctcatgcctcagcctcctgagtagctgagattacaggtgtccaccatcatacttggctaatttttgtatttttagtagagactggttctcactatcttggccagctggtgatggccatcctgacttcaagtgatccttcccctcagcctcccaaagtgctgggactacaggcatgaaccaccgtgcccggccaagaatgacaacacatttcttgttgagaataatacaagtaagaagataaagagcaacatatttaaagtatggaaagaaaaaaataatctgtctatctgaaattctttacccggagaaagtctgtctaaaacaaagataaaggaaagacttttttagaaatacaaacgctgaaagaatttaaaatcagtatatctcacaagaaatgttagagttctaatactgtatgtgaagcagtagaaataccacttaaagatagactgataaattaaaggcacaaaccctaaagacaccattaaaataaagcaacaaagagttatagctaatgaaccaacaaaggagatagagtcataataattaatgaaaaacgggagggaaaaaagagcaaaaggaatcaaagtacacatagggagaatagaaaacaaatagcaagatggtagatctaaatctagttacaccaatgatcacattaaatggtctaaacactggaaaacaaatagcaagatggtagatctaaatctagttacatcaatgatcacattaaatggtctaaacactgatgaaaagacagagattgttaggttagataacacttctatatcctgcctacaagaaacccaatttaaacataaaaacacaaataatttaaaagtaaagggatggaaaaaattataacgtgctaacaataacaaaaataaaatttaaaagactgcattaatatgagacagagtagatttcagagcaaaaaatattaccatgaataaaaagcataatttcataatgacaaaagtgtcaatttttcaacaggacataacaatcctaaatatttatataagcaataacagaccttcaaaatatttaaaccaagagtgaaaagaactacaacgattcttttaaatgtaattatagttggagatttcaacatctatctgtcaatagttcacagaacaagtagaaagaaaaccagcacagataaagaacacttagacattatcaattcacttggcctagtacctaggaaaggcccccttattagtgcatgtatcctcacaacctggacaagttgaacagtccagcagtggctaccataagctgctcaaactgataaaatcagagttctcacatatttaaaaatgttgactgaaagtgaacatagtctgaagctaaaaggtaaaattcaagggtggtcagcatccatcagaccatccacatgggccagagtattggaaggactgttacacaaagagaaaaagatataaggagagataagagactaatgtgatgctctgtggtactctagttgctgattctctttctgatagctactttcatttaccttctttttgtgtcttagttttacaaatcttgattgactttgtgaaatagcccagaatctacctttgcttcaggatgccagatcaacacagaaaggcatacataatgtaaacataaagtcaagatgtaacagtctgctttctgagatcctgcctttttaatctgtcattaaccttgttcgtttatcctttttctgtaggaaaaactatagaccagcaggagagtattcttactctaacaattcaccctatctggaatccatttctcagtttttttcacttcctccttctggcccagctcaagttctgtctcttcaaacaagacttccaagaccaaatcaaattctcagggatcattttcttctctcaagtcctgtaagccactattgtgaaacttagccaattttctctttctgttatacattatcttatatgtatgtcttgtctcctaattcaaacagcaaattctttaaagggattatgctttgtcttgaatatccaggaacatgtcgcaccccaaactcagtggggtggggggaggggggagggatagcgttaggagatatacctaatgttaaatgacgagttaatgggtgcagcacaccagcatggcacatatacatatgtaactaacctgcacattgtgcacatgtatcctaaaacttaaagtataataaaaaaagaaaaagaaaagaaataaaaggcattacagaaatcgtcaggggcttgtggattgatttacggacctttgcatttataattttatttttctaagagaatgtattatgatttccaactggtttataaatgagtatcagttgtttttatatttatgtttttctgtatctatatgtaaatatattcatacacaagaagcttggctctatagttgtatttataacaagatattataactaagcatactatataattaactaaaagtttacagctaatagcaaaaattacatcatccttcttggaactttgtatctgctaactgtggattcaaaggtaaagagtaccttgctttccttttcttttttcttaattaacactgcttgctcccttttcgttcccaggtgcaaaaaagacaattaatgaatgctattaataaatgagaaacaatattaaatattaatttttaccacttttttgtcctcaatagtgtagataaattttccctaaggcattccttttagtgacctcattgtaaattgattctaacacatttaaaacttaaagtcatggtaaatattctcagttgtagagcaacctatgtcgagttaacctcaaccagaatggaaatgacagctgtaaaatatctaagatgcagtagttttctattcaaaatatgaaaatgagtctaatcatcttacagctgttttgcttttgatacgtaacaggtgatgggtgtaggttcggagccttggctttgattttaaacagattttgggtcaaatctcatctttattatttactataaccatccatgaccctgtgcaagcgacactctctctccaagcctcaatcttactccacattacatccacatgaaaaatgtgggtgatgttagcacccaaatcacagacttgtggtgaagtttaaatatgttacaatatgtgaagtgctcactacaaggtaattgctcaataaaatttggattaaaatattttcaggaaaaagttagttttgttttattcaggttgatgaggagatttggtacagagtgtctttgtatagaatataacagcttcatcagataatatattcttaaaataatctatttttctttaaaatatgtttttttcttttttttgtagttttttttattatactttaagttttagggtacatgtgcacaacgtgcaggtttgttacatatgtatacatgtgccacgttggtgtgctgcacccattaactcgtcatttacattagatatatctcctaatgctatccctcccccctccccccaccccacaacaggcccacgtgtgtgatgttccccttcctgtgtccaagaattctcattattcaattcccacctatgagtgagaacatgcggtgtttggttttttgtccttgagatagtaaagctttatttttctgcttaaaagtggtacagttttatgttatccaactttatgactatttatgtactatgttaacctcactggaattaaaataaataaaaaaataaataaatagcaaatgtaatcactacataattattttaattccatgataccaaactgttttggtcaactttgttttttaactgaattaactattaataaatattttggcattatgtagacatacactcaaaacacctccttcagcattgcaacttgacattttaaaaacaattattttctattttattgtacaagccagaatttctgggaaaacaggtgcccccttttccaaaacaatggcgttgcaatgtttccattagtctaaagcgtggatatcactttatccccactggtaaagtgattcagaagctggatatcataaaaggaggtggtacctttaaataactagcagaaaagcctggtagcaagagaatattatgctattactgtaaatttcactgacagtaaagggctgcgggggttatggaaaaggagaggagctacacaataaccactggccagagtaattagctggtgtaatgaagagagaggaaaagtgtgttggacactgaaggcctgaactgtcagcattattgttctccaaggctttggaagaacaatgctctgctgagccttcagtaatcgctatacatgactactcatgaacagagtaattaagaaatgtcagtgcttctctggaaaaaaaattaacactcataccacacagagtgcttccctggaagaaccacatttttttttttgttcttctaaaatactaacagagcagtatttatacttcatgcagttcaaaggaatgagctatgaataactaaacaaacccagcaatgtgattgttccttcccccagcatgtacacttccaatactcaacggaatggctggacatatctgagctacacagaaactatcctgagcactgtgttcaaattgtcccatgttccccagccttcaagctgttctatgtgatatcacccaaatttatttttgcctggtacttgccgtatcttacttatgtatacattcatgtattcctcatttcattagatctttaagcttcatgaggatggagatattgtcctgctcatcactgtattgagagtgcctaaaagaatatctggcagtggaaaatgctgaataaagatttcttaaaataattcaagattaacattttatttaagaaaagtataatgtgaagcctctcatatgccttagaaggctagtttctcaattaaaagcagccaattttattttaaaataagtgtcagagtaagcaaaaaactgaaatataaaatattacaaactttttaaaagatacactgaatttatggtataaaacttacctgaaaaggaaagtagtctagataatgattcaaaatttctacaaaaagagtctgtcctcatcttgcaaataataaattggcaatattttttcctgtagaagtaaactattaaggaaatgaaatctcagacattgcagagtaaaaaggtgagagcaccaatcctgtactaatgaggctaataaaatcaaacactcttctcccattccattccaacttatttactctgctctttgaattaagcagttgtgtctatatggctaattgtagctttgattctccaatgtgctctctaatcagattgcattagaggtaaatatttatctccccaaagttgtagaatttatggctagaaagaaacaaaagctaatcttttgcattttccaggtagaacatattttgattcaggaaggaaataagttgaattccaagaatcaacaagatattttgtcaatttgagagagctttagctgaaaacagaattgaaaatgatttctgaataggattcttttcaccacagctgactgcttattgtttcattaattctataataagaataaatggataataaaaatgttttctaactgcaacagttcattatgatgactataaagcagtataatgcagtggaaatgagctgaattttgggagccagaatgtctgggtttgaatcctgtctctgttacttaataggcatatgactttaggcggcttcctcaattgcaaatttgggataacaataataccaatctcaaagtgttgtcgagagaatcatatgaattaaacgtaaaaaactttgaacaatactaaatgctggctattatagttattataaaaatatggttgttggttgccttgtattaatagctatgttcattttctgtttagtagccattgtcaagcaatttatcattatataatgtcaacaatttaattatttaagtaaaattatacaaattatataaaatcctcattactcataaaattaaaggtaaaagtgaatatgaaggtattgatttaatatttcaactgcattcatatgtatattgtacaacatgacaaatagcatatgaaaggaagctatgcagtactaatgtattcattcattcattcattcatttattcagctaatatattttgaggaccaactctccatcacatcaaggagatataaatagtgatcaagatatataaagtcttgacttttaaaagtttatagtaaatgaaaaaatcatgcaataagtgttactgagaaaatagaagctatctggctactatagcttgaatgtgtctcctctaaaatttaggtgtggccagtgtgattgtattaaggtgtgtggaggctttaagaggtgattaggccatgaggggtcctcctatgtgaatgggattaagctcttattaaagaagcttcacatagcatttggctagtttggtcttcattgggtaaagatataaaacatcttttcctaaaatatgcccattcttggaattaatattctcctcacattgcagttgactaatttttactcatctttcagatccattcccagggaaaattcttctgaactatgtctatgtattatacgtctattcattgttaccattagactctctcatgaaactcattatttctttctttatagcatttagcctaaataagttatatattgaatttatgcattttttccttgatagcctttctttcccactagacaagctccatggaagcaggggtggctctttgtttcctgttgaatgccagcagcattcaacgtatttcactagtggtaattcaaggtatttcactagtagtaaaaattcaataaatggatgacttaattaaaagtagaaagataatgagtttatataactcacctattgtaaatcatgagcgacctagagagagactttcagaagctatggagaggtgaagcattgggcccaggctggaggattaacaccaactcaggaaagtgagtaagtctcattgcctatggtttgtgagacgaagaagtatgggagaactaaaaggagttacgaaagtgtgctgtagacaaactgcattttctttcccttattgccctcttacagctttgcatcctaattggcagtacagttctattaaatagagtggggaagaaagagacatctttgatgttgtttgttctcaagaaaagtattacataatcacatatgcaagcatattattgtttgcctcagttgtgtatagatttaagaacatgaaactgtgtgatgtttcaggagttgttaatttaatatgtgctgttggatagatgagactcctcattctgaaatctatattcaccagagaccctgctaggatcctaatgcgatgctgtctatttcaggatatcctgtgggatttgtgaagtctcttaattcatcaggtgataatgtttatacttctaggacacaaaatgttgacataaaagggaagatttatcaaagactgattctgaaaaactgatcttaatggtttggtggaaatttattgtaagggatttttttctttcaagtggtttagcacaaaccaaattttagaaatgtacgaagtctcaaagggcattttatgcaatcattttgtttcatggataaagaaataaggtctagggagatgaagtaacaaaatcagggcagaatcaggataggtatcaatatctcctgcctcaagttgaggattctttaattggacatgacaattcctgggcattacaattgaacattacaaatggacatcacaattcatttcaataaggctaatatttattgaaaatgctcataagtggttaatacatttaataaatatttagggtatcaatttattatgttttagaactccattctaattataaaactacgtacatcattaaatattgattgaacacctactatgataaggaaactatgttggtttggtaattatgttataaataataaattataaagttcttaggaatggtaattaggaagtaaatttaaaacaaaattagagcctttagaaagtaaactgaatcctcaaattattttgactttttaaaataaatcatgaatgagatcaatggaaacgtttgaaatgttaattgtttgcagaaacatcattcttgttttatttccccacatcatttctgcctcatttgggtcatatatccagtaagaacttgataaatatttaatggtaatgataatgttaaagtctggggattcaaagcttgagacagggagaactacagactattttttacaaatacattgttattgttggtacataggatcctccattatgtattccagcatgaacatgaagatgcccatcacacagtggctaattcaggacatactgtatcacagcaaagacgtgcaaactcaccttaagaaaaaaaaaaagaattaagcaagtgagtttgttttaaactgaataggatatatttaccagctaaagagatgtgtcagtcagaaggctagactgccttgggagcctggaacaaaagtagtttcagtgaaaatattggcagtgtgcctctaagcactttcaaggtaagaagaagtcttcactaattaattcagttattctgattttggggggagcattcaggttttggagtaatatatagatggcaaagtttaaatcttggcccttggccctgccacttctagtaaagtcttggatgaagtactgcatttataagtttcattttccttatctgtaagattaagctaataaaacagtttattgtgaggattaaatgaggtaatataataatctacctaccactgaggacttattatgtggctggcactattctaggtattttgcataaatactctcatttaatgccgatgaaaaacctgtgaggtagagtctacaaaagtaggtaaaataatgatgggcaaaataagtttgtacctgctcagcaagaaatagaaaacaataagcacaacaacaattttaaaaaacagactcaaaagtacattatgagacctttgagtcccctctcttaacctccattcacactgtcaaactatatcttgagtcacaacaactgatataagtaatagcatagcaataatcagtaactattgcggtaataataacattagaaataaaatcaagctgttctaatcagatccactgctaactcaacacatcagctggcttctttggttctgatccttgtttcctaaggatgatcaagtcactaagttcgactttccaaataaatttatctccagctagagaaattgctaatcatgcagaaactagcattccaggctgcctgataataggttttataaattaacaattggcactcaggttttatatgtcattaatgatttcaattaatttaagttggcccagagagatggagtcactcttgtgaggctagattatggataatgaatgccaaactattacgtaatttgagagattatcaaccagctttccattgtagttgcttcgaaccatttttttccttcaaatttctacagttacagcatttgaaacttccctctcaattatttataccatacttttcttatttttatacatccaacatctttaaaacaaattcctaatttattttcttttctagatagaaaactaattgagggcaaaaatgcccaatttaatatattgaacagacaaaacaataaagtgccttcctttcactaccctatttcctttcttaacctgtaatgttgcaattaacatctggcctggataaatgtactactcacaggttggggaaaaaagactcattactaaaaatctcttaagaaataatttttatatagcatacaaagcaaaagttatttgggattctgagaaactaagacacaatgaataaccaaacttaaaatacaaaaaacaaaaacaaaaacaaaaaaaaacacctttgcatagcagtttatggttacattatctcattcaatttaagccacataatcatagaaagtatattatagatgatttgaaatatatattttttcttcattacaattaaatcttaagaaacaaggaaacaatcacttttcagagaagttctacttttaaaaagctcaagatgttaactaggttaataaatcaaaagtatttctggcaatattacatgcttccctaactccattgtttttccaaactatggtctccaaatggcatcagtgtcatctcagaatctgataaaaacacaaactgcctggcctcatcctgacctatgatgttctgaaaagccagatttctaaaaataaagaccctaatttatagcatttgctgatttgcatgatgtaaatactcccaacatggtcaattttgggctacccagccttatttccccaacatagcgttgcccaggctggagtgcagcggtgcgatctcggctcactacaacctctgcctcctgggttcaaacaattcttgggcttcagtctctcaagtagctgtgactacaggcaagtgctaacacgcccagctaatttttgtatttttagtagagatagggtttcaccatattgcccaggatggtctcaaactcctgacctcaggtgatccgcctgcctcggcctccgaaagtgctgagattataggcgtgagccaccgcaccccgccggactccctgttttgagtactagaaatgttgctaacaacatcattaaaatgtattagctcagctctgaaacaagtaagagtgaagttctaatgctaaaaaaaatgccacagcagtaaacatgaacaccaaataaaagtttactttttaaactaatttgaaataatacaaaatgcagcattattatttccctttgacttcactctgttttgatagtgcatagccagtctgtaactgagttctaggcagctgcccgtctttcttttcttcttgatatgctttttgaggaatctctacatgataaagaagacttctcagaaataattacctacttgccacctaatgattctctgaaattttgaaagaagcctgtatgattcccttttaaaaggcgtttgttgtgagttttcaatcacttgttagtttagataagcctcaatattttcaagtgacagcttcaaagctgcatgttatttaattggctgctttcagagggcagctgttcatctgccagtcatctcatgtgaaccaggattcactgtgcacctccttgggaattgttttaggaaacgaactgtgtttcctaataggaaatatgccaaaatttatggtaatcttcaaaataggagaaaaacatctcaaagcattgggacatagctggttatatagaatttttaaatatcatctttctttagaaaactgaataatcatattgtctaaattcttgaataaaagaatatcttagtacttgttttgggagatttaggctatgaaatatattagcaaaaatggggaaaaagtagcaaaaaaaagtataacttaaatgtcttcatagaaactacacttattggacaaggagtaagaagagctatgaaatctgttcttagagataaaaaagattgtttaatataacaatacattgaaaattatatgtaaaacagcaaaatatttttagattaagtgtttaagccattgtgcctggaaaaatcatatcaaaataattgttaaagatagactgaatataataaaaatattatttcttataatgactaataaatgagaacataataattcgccttttgtgtagaataactcttctcttatgagagagctgttaataaatttgtataaggatatgtaaaaacaactatttcatttttctcctatctgcaacactgatgctttttcacatactcattattgtgacaacaggttgaattggcaattcaccatctgtctaaatagcattaaccttcttgtaacctcataatatcactgttacgccttgtctgatatttgaatctctctaatataagctaggaacaaaatatattttcctctctactaggcacacatcagtccatgccagaagacaacgcaaataaagtaccacccacagatggacattaacatttaaaatcattttcattaaaatggattaagcagttctaaaaataatcagagaaaatgaactaacttgtaaataatcttagccagaacagattttaattaatatacagtattaataattattattataaatgtatacaattacaaatttatattcacaaacataatatcatttatatcttaaagagaaacctatataacatgctaaaaacgtagggttgtcctcttctatttctatgatcaaaaataatctccatactgataaatatgttgatcccttttaagttctcatctatttgacccatcaacagcactgacatagttgatcattctctccttcttgaaacatttgatttacatttgattcagtccagttttcctcctacctttcagacagctccttctcagtgtcttttgctggttcttccttatctctctatcatcctaatttggacttcctaattttgagtatttgaactttttctcttttttatgtagtccctccctatgtcactatatactgtttctaggttttaagtaccacctaaatgcccatgagtcctaaatgtgtagttcctgttgaaccactcccataaatagacccctatatacagttccctacttgacacttctgtttgagcctctaatatgttatgtgtgcaaatctgtgctcctaataatctctgccaaatcaggctatgcactagttctttctatatgttaatagcaacaccattcttccagttatcaggtcataaccattgatcggtaccatacttgaaaattctctttctctaacatcacataccttcttctcaaatttctcctaaaaaaaaaaaaatccaaatgatgactacttcttaagcacccataatactactaccctgacacaggttaccatatcatctctcacctcaattatttgattactggtatttctgccttagttctaccctcctcccctatagcctaatcttaatacagaagccaaagattttctattaagatggtggccatgattatctttggtgagcctccaatatgccagaaatatttctgcctcagggccttggtttatacttgtttcttttgcctgggttatcctccaaacaatcacgtttctatctcccctactttcttcatgccttttgtcaagtattctcagtgatgccattacggccaggcaatctgatattatatacacacacacatccctgacatttcatactcttttttcctatatgtttatggtttgtctcctacctcaaacataaactccaagaaggaagaatgcatttgtctgctgtgtacccccagtatgtccctagcacctagaatagtcctggtatagtaggcacttaataaatatttattgaatgcatgcatgagcagaattagacttattacttacttacataatataaatgttgttataaaaatggcaaaatctaaattataattaaatatatgttttgaccaatttttggcatgtattatttccataactcaaactttgtattttaataattcttaagaaatacaggtttttaaaccaaaaagatgcaaacacgagttaaaaaaacaaagatgagcatataatagtggcaaagtgtaacattttgtacttgcttttacattctattccttcatatttctaagtactttcaaaagtacagaataaacactatagtcccagtgcctctgacagtttctgacacatggtaggcattcaatatttgttgaattacatatctacttgtactggcaacctataaaaaaaatcactgataggaaaataagacgtgtgaggatgaataagggcatcacttacttcaacagagatgcccagggaagtgaagcacattataaaaaagttttctaagagaacagtaccacacaaaggaaacaggcacatacattgagtttaaggcaagaaaaattgacaggacttgctacaagtgattgaatatgctatagggaataaaaggatgaagaatagtatttttaatgaaaggatgaggctcttatgagacattatttatttcatggatggtccatatatttgaaaaagtaaataaaatataccttgctacccacactgtataaatgtctgggtctgaaaggcagaataatgtaaagttgcttaatttttcacatagcatctatttttgtctaactagaaaacacagacaagaggaaacttcaaaagcctctacgttcaagttgttcagcggcaagatgaaagatgtatgatgaaagaaatataatgtgcaaggttctgccaatagttcatccatgggtcgctgcattgtgtactatcaccaagagacctgcatgtttttaataaagaagatgccagcactccatgtggagcaccacatgaaacccttctcattcccttagtgagagacttctgtgtctctcactgctttttagtattctaagtctacagtggtctctccacaatatggtatgttgacttctttcaacctaggaacttctataactatcagtgttctaatttgtgctaaagtcttcagtatgccctctcgttacatagaatgagtgtcctattctaggtattcaacacccctaaaggatacagaattggaaatattacactagaagagttacttgtttatttctctgtcattaaactaattatttgtttgactttggtacattaaagttttatatatatctatatacaaaacatgaatgtataaatgtaatattaacaaatcttatcagaacaagctgcttataattatttctaaatatcatcactgccaatatattgtactaatttcccattcatcaaaattctaggctgttgttaaatacacattatgttacataaatgctttgctttaggaccattttttcaaacatcataaggagtaacaattgactccatagtaaaaattccaaattcttcatcaaagagcttttctcatattttccaaactcctcagcaggaaactaaaaacggggtcattcctacaataatccttttcattcagtcatattaccattacaattgacaaagaggccatatgcatagggcagtcttgaaggctgagagacagaagctaggaagctgtgtaatgtgaactaaagcactaccaccattagaaatataatcagaaaccattattagtggcacaaaagtaagtaagaatgcacctgctgacaaggtataactgctgatgcttccctcagggacacagatgaggaacagaagggaattgcccaacaatgggttataatgaggctccacgaagacagtagcctcacctgttacattctcctgtgtaactccagcgctagcacagagcctagtgctgagtaagcatgcaatcaatctttgatgagttctggaatgaataagcaaacacactcatcattcctcctcatactcaatattcctcccttttattaagtgctaggttctgggccagttgccttttatacttaaactccctttttatagatgtgctgcccattttagagatgagaaaactgtgactcaggccgggtgccgtggctcacgcttgtaatcccagcactttgggaggctgaggcaggtggatcacgaggtcaggagatcgagaccatcctggacaacatggtgaaaccccatctctactaaaatacaaaaaattagctgggtgtggtggtgtgtgcctgtcgttccagctactcgagaggctgaggcaggggaattgtttgaacccaggagaaggaggttgcagtgagccgagatagcgccactgcactccagcctggcaacagagcgagactctgtctcagaaaaacaaaacaaaacaaagcaaacaaacaaacaaaaaaaagaaaactgtgacttacagatcttaaatactgtacacacatactaagcaacagagctcagatgagttggttattccacagatagaaacaatatatttggactttgagatcaccaaaatgtgtaagtgtaagagggacttcactcataagcatcagaattttaacaatagggtattttgctttgctctttctaggtgaagatacccccaaaaagttctatttctgagactatataaactgttcccaaaccaaggtggtgcagttataaacttggttttgagaaaagtttttttttggcttcaacctcaatatctcatctcaagaaatgtaggaatgtgtgatatttctgaaacgtaggcactgtgactatcctgcatgtagatgacaagagaatactaaagaaatgcataatgatgtaccctactagtgagtgatgacaatcactagcccctctagttgaacaatggcatcttcactacctgaaacaaccaaacatatgaaagtgtgaagtgagactgatggagatgaaatggtctttgaaaatatttaggatttattttctgtatctggtcatggtacagtcgtctgctctgaccctaagttttataatgacacaattataattgtattcatcattttgttctaatttatagccatttaaaagggtataatttaagccacattacttattcaaatatttgacacaatatagccactggactataaatagcaacagacatttttaaaattctcactgctttatagctagaatagcaatttaggagagctctaggtaatagtctgaagcttatttactgaggaagaaaactcctaaaataggtcatttgattgaaaactgacttagttgccacagtcaagataatttatttaaactttcatgtattaataggtttgattctacaaaaatatgaatctaacccattaaaaatgtaatgtaaagtcaatttccattccactcaaatgatcaaactgcttcttcataatcattagtttatcactgaattatggagcccatgctttttaggtcacttttacgaaatgaaaatgaaacatccaaagagtcacagttgttgagaataagaaaagatcttttttcttttaatattctatatgtaagttatagttagcatttccaaactggttttttttgtgggttagtgcttcttccacaattttttgaaagctaaattttgagaatggtgtttgtacatatctcacactgagagcactggtttgccaggtcattctaattattctatttttaaaagagtgactcctttggtataataggtttggcattagtgaaattaaaggttgtgactgaataacagtaatggtcttacatttcaaaaagaaacatttttcttttctcttcaagtttattttctctcattactttagtaagatttgacatacatatgtcattggaaggccattgtttgttcattatgtgcaattccattaagaacattacctagttaatttacaagaggctgactataaaaataaataaaaagataagtatctactaaaaaaggtaaaagggaaggaagcatttatatacctcatttaaaaaggagtttattaaaaagcaaacttccctcacagaagaaagatttataaaataaacagcataagaagggttggttaatgggtacaaaaatatatttagatggaataagatctaatatttactaccacaatagggctaccataactaacaataatttattgtatatttcaaaataactagaggaatgaaattggaatggtcctaacacaaataaatgataaatgtttgagattatggataccccaactacttgatttgatcattacccatattatatgcttgtatcaaaatatcacatgtatcccataaatatgtacaattgttatgtatccataaaaattaaaaaaaacagcataaatcaagacatttgatttgcttgtgtgttttttttagaaaacaataagatattgttgttttataattatctttagtcctgtttctgaatgtatatacatatggatgcttaagtacatatgaacatattgtatttatctaacacaatatcaagacaaaattacaatgcatataacctcaggtcttccaaaaataataatttaacttacttttaattgtgctattacaatttctctaaaatgtattctatagctttcactattaaatacaatatataaaatctgacctaacattttatattgttaattcagggtcacttttatgaacatcagttactctattctgctgttataaagcaatgccttcatgggcttgagcagtgtgaggccacattaaatctcccagagcatttattaacgacttggctatatttgttgttcctccatatacttttcccctacctgaaatgtaaaatgaatcaaactcttcttagtatcgataacagctagatagcttatttgtaaaatttgttttggatccctgcttacagccaaagaaatgagttcaaaatggtggaatattgggatattacagcaagcagattgaataaactttctggacagtgtagtcactttaatgttcttcataaaggcctttggcacttcaaattccacctgtgtatgagatatgcaacgacaatagtttggagagtttgcatgtgctcataacatacttctatggcttctaacaaacaaatttgggaagaagatatcatttaacaatgcaaaggaagcctattcttgacattttatatactcaaattagggtaatgtaacagaaagctaatatattgagtggataacagtttctgaatctgtctcaaaggttattaattatttcatattgattactcttaacttcagattataaacattcaattacctattagcccacctaattaataaaactgtattataaagcaatctgctattttaaggatgcattactattgaacgaagcaaggcctccatgaacatgagtgtgctacagagctcatatctccctctataacttggaaagttgaaagcctacagacttagagagttctactgtgttttctcatattctttatatctagaaaccataattagattcatgaaaatgtataaatgtagagtacaatgtgatgatattgattacagccatctttgatggctcatttaaggatttataatctatggaaaatctctagctttataaatgccttgtgtaaaacttcttggagtttctcaggcatatttctgacatttttcctgaataagaagatcattaggattagagatggatgactaggtgcagctgggatgcacctccttcatgaagaagagtcacagtatcaggtaagccttggacttcaaacagatttattgaaagaagacactgaaacttaatagagaggcaatggaggacaccgtggttgaagagggaggaagcatggctacttgcttggcctcactagttgccaagatcagcccctggagccagactagacctgaggaatggatgaatgaagaaactctgggacaccacattcccactgcaatcctctgagaccctagttacagaagttcccaccaccctcgcagacctttgggcctagagaatacagagagaccgtttaaaccaaagtggaccccaaaaggcttcagtgagctgggcagctgcagcaaaacatgactctgggcacccaccctgcaaaattctgcatcatgccctaagcggctgcagctcctgctgtctgccgagccaggatagaactgagctggccacattcacatgcccaagatgggtcccaccagcactgtttgggaactgaggagcatctgaaccacatgtccccaggcccgccagtttctcccaagactgccagcctggttgttaccgcaatgggagacccacagcataccccacattgatctgcctgagtggtttgttggcagtcttggagcagttcctcctagtccagatcaggaatggtgtgacaagatagttgcaatttctgcttcagggactcacagttcaaaacatctggacccgcatagcgccttgggcacaggtggctcagaattagcctaacgggtcaggcctgcttcttgggctggatgctggaaggagatccacttgctggcaggtatggaagctgggtgagtccagtggccgactgctgggctgaaaacatcaggtcaccactctttccctgagaaggctctgtggcttaggagaggtgcttcctcctctgcctggagggttgtctcagtggactgggaggaaccctcagacccctgtgaaggccagtgcttgcacatgccttagagagcctggttgcaggattgctagattgatcccaccctttcctgagagtcccatgctctgcccataacctggaacatcctggagcttgccctgatcaacaaagacaaagtaaaaatcccactgtcatcactgcaattgcctctcacctgcaactgccacctactggctgggaggtcaaactgcagggccatttgcaacttctgctaacatcattgtacagtgctcagctggttcttacctgcaagtgccacctactagccagtaggataaattgcactacccaatatataatttctgcagacagaagtgcacagtactgagaaataagataaggctcccaagatcaccacatctccatcctctgtactagacagtgagccagataatatgcacagcacaccactactaaaacctacaaacaatgagcatttgaaaaaaccactagactaaggctatctataaccaaataattcatacagaaccttggccctctaatagtacatagaagcaaagccaaaagaccctacccaacatgtgcaacagctaaaccctcaaagtggggaagaaaaaaaaaaaactcacccaaatgaaagtaaattcaaaactaagatgtaacagtttctacagatgataagcaaccagcacaggaactctagcaccgtgaagaaacaaaatgttgtgacactcccaaaggaccacactagctctctagcaatggatcctaaccaaaatgaaaacttcaaaaagacagataaagaattcaagatatggattgcaaggaagaccaatgagctccaagagaaagttgaaaaccaacacaaagaattcaagaaacaattcagaagatgaaagtagagataaatatatttttgaaaagccaaagagaacttctggacatgaaaattcactgaaaggattttaaaacacagttgaaagcttcaacaatagatgagacaaagcagaaaaaggaatgtcagaacttgaagactagttttcaaatcaacccagctagacaaaaataaaataatttttaaaaacaagcaaagcatttgagaaatatagcatatgaaaagcaaccaaactgaagacttaaaaacattcttgagggagaagatgaaaaggtaacaagtttggaaaacatattagaaggaataattcagaaagatttccacaatcttgctagagattcagatatccagatacaagagattcacagaacacctggaagatactatataagatgaacattaccaaggtgtatagtcatcagactatccaagctcaatataaaagaaaaaattttaaaggcagctagagagaagtgtcaaatcacctctaaagaaaattccctcagactaacaacaaatttctcagcagaaatcttataagccagaagagactgtggaactattttttaacctctttaaaaagaaaaaagaaaaaaaaaatcagccaagaatctcatatcctgctaaattaagcttcataagtgaagaaatatagactttctcaggcaagcaaacactaagggaattgctatcactagactggcccaacaacttatgttcaaaggaattctaaacacgaaaatgaaagaatgatactcaccatcataaaaaaaaaacatgtaagtagaaatctcagagcctataaagtaataacacacttgagacctcaaggcaactagcaaacaaacaaacaaacaaacaaactatgacaggaacaaaacgtcacatatcaacattaacaaagaatgtaaacagcctaaatgcttcacttaaaagttatagacaggggctgggcatggtggctcacgcctgtaatcccagcactttgggaggcagaggcgggtggatcacgaggtcaggagatcaaaaccatcctggctaacacggtgaaaccccgtctctactaaaaatacaaaaaattagctaggcgtggtagtgggtgcctataatcccagctactcaggaggctgaggcaggagaatggcatgaacctgggaggcagagcttgcagtgagccaagatcgcaccactgcactccagcctgggcgatagagcgagactccatctcaaaaaaaaaaaaaaaaagttatagacaggtaaactggattaaagaaacaagacccaaccatctgcagcttataagagaaccgtctaatggctaggacacctaacagacttaaagtaaaggggtagaaaaagatatatcatgtaagtggaaaacaatagtaagcaggagtagccattcttagactttaaatcaacaacagtaaaataagacaaagggcattatataacaataaagagtgcaatacagtaagatttaagtatcccaaatatagcacccaacactggagcacccagattcataaaacaaatgctactagacccaagaaaaaattgacagtaatccaataataatgggggacttcaacatcccattgataacactggacaggtcatggaggcagaaagttaacaagaaaactctgtacctaaactggactctagaccaaatggacctaatagacatttataaaacactctttccaacaaccacagagtatccttttttttctttcatctgaacatggaacattctttaaaactgatcatatgcttggcaataaggcaagtcttaatgaattcgaaaattgaaaccatatcaagtttctgtatcatggtggaacagaattagaactgaataccaagaataactcaatattacaaaagtacatggaaactaaacaacttatttctgaatgacttttgggtaaacaacaacaataaagcagaaattaaaaaaattgaaacaaatgaaaacagagacacaacatactaaaacttctgagatgtagcaaaagtattgctaagaggaaagtgtataatgtttaaaaaactccatctaaaagacagaaaaatctcaaatataatgtcacacttccaaccccaaagctagcagaataaaagaaacaaaaattagagcagaactaaatgagattgagaccaaaaaaatcaatacaagggatccaaaaaatgaagtttgttttttgaaaggctaaatgaagtcattagactgctagctagtttaacgaagaaaaatattcaaataagcacaaccagaaatgataaaggagacatcacaattgatacctcaactgtaaaatacgatcagagattaactatgaacatgtctatgcacacaaactagaaaatctagatgaaatggatgaatttctggaaacatacaacctcccgagattgaaccaggaaggaaaagaaatcctaaacggacaaacaataagtgatgaaactaaatcagtaataaaaaacatctttcatcaataaaagcccaggaccagatggattcatagctgaattttgtcagacttacaaagaagagctagtacctgtcctactgaaattactctgaaaaatcaaggatgaggaattcctgcctgactcattctacaaaacaaataaaaccctgaaacccatatcaggcaaggatacaagaaaaagagaaaactacaggccaattgctttggctattcaggctatttataaagaacaaagcaggaggcatcacattgcccaacttcaagctatgctataaggctacagtaacaaaaacagcatggtacaggaagaaaaacagatacatagaccagttaaacagaatagagaacccagaaataatcccacatacctacagccatctgatctctgacaaagttgacaaaaataagcaatgaggacaggacttcctattcaataaatgatgctgggcaatcctaagcaaaaagagcaaagctggaggcatcacactacctgacttcaaactatactataaggctacagtaaccaaaacagcatggtagtggtaacaaaacagatatatagaccaatggaacagaatagagacctcataaataacacaacacatctacaaccatctgatctttgacaaacctgacaaaaacaagcaatggagaaaggattccctatttaataaaaggttctgggaaaactggctagccatatgcagaaaactgaaactggaccctttccttacaccttatacacaaattaactcaagatggattaaagacttaaatgtaaaaccctaaatcataaaaaccctagaagaaaacctaggcaataccattcaggacataggcatgggcaaagacttcatgactaaaacacaaaaagcaattgcaacaaaacccaaaattgacaaatgggatctaatcaaactaaagagcttctgcacagcaaaagaaactatcatcagagtgaacagacaacctacagaatgggagaaaatctttgcaatccacccatcagacaaaggtctaatatccagaatctacaaggaacttaaatttacgagaaaaaaacaaccccatcaaaaagtgggcgaaggatatgaacagacatttctcaaaaaaagacattttgcagccaacaaacatatgaaaaaaagatcatcatcactggtcattagagaaatgcaaataaaaactgcaatgagataccatctcacaccagttagaatggtgattattaaaaagtcaggaaacaacagatgccggagaggatttggagaaataggaatgcttttacactactggtgggagtgcaaattagttcaaccactgtggaagacagtgtggcgattcatcaaagatctagaaccagaaataccatttgacccagcaatcccattactgggtatatacccaaaggatgataaatcattctactataaagtcacatgcacacatatgtgtattctactataaggtcacatgcatacatatgtgtattactatttacaattgcaaagacttggagccaacccaaacgcccatcagtgatagactggataaagaaaatgtggcacatggcacctgtagtcccagctactcaggaggctgaggcaggagaatggagtgaacccaggaggcggagcttgcagtgagctgagatcgtgccactgcactccagcctgggtgacagagcgagactgtctcaaaaaacaaacaaacaaaaaaacaaaacaaaaaaaagaaaatgtgtcacatatacagcatggaatactatgcagccataaaaagaatgggttcatgtcctttgcagggacatggatgaagctggaagccatcactctcagcaaactatcacaggaacagaaaaccaaacaccgcatgttctcactcataagtgggagttgaacaatgagaagacatggacacagggaggggggagtatcacgcaccagagcctgtcggggagtgggggacaaggggagggagaggattaggacaaatactaattcttgggaggcttaaaacctagatgatgggttgataggtgcagcaaaccaacatgacacatgtatacttacataacaaacctgcacattctgtacatgtatcccagaacttaaagcaaaataaataaataaacaaataaaactgggataactggctagccatattcagaaaaatgaaactggacccctatctttctaaatatacaaaacgtaactcaagatggattaaaaatttaaatgtaagacctcaaactaaagaaatcctagcaaaaaaatctaggaaataccattctggatatcagccttggcaaagaatttaaaaccaagtccccaaaagtaattacaacaaaaacaaaaaatggtaagtgggaccacaattaaactagagaccttctgcacagcaaaagaaactatcaatagagtaaacagtctacacaatgggagagaatattaaaaaattatgcctccaacaaaggagtaatatccagaaactataatgaactcaaacaactcaacaagaaaaataaccaaacccattaaaaagtgggcagaggacagaaacagactttgcttgaaagaagacatacaagcagccagcaaacacatgaaaaaatgaccaacatcactaatcattgtagaaacacaaattaaaaccgcagtgaaatatcatcttacatcagtctgaatggctattcataaaagtcaaaaaacaacagatgctattgaggctgaagagaaaagggaacacttttacactgttagtgggaatttaaattcataaaacctctatggaaaacagcacagaggtttctcaaataactaaaaatagaactaccattcaatctactactgggtatctacccaaaggaaaagaaagcattatacaaaaaagatacctgcacttatatgtttactgcaatactattcacaatagcaaagtcatggaattaaacctaagttgaccatcaatgggtggttggataaagaaaataagtaccacatgttctcacttataagtggcagctaaacaatgggtactcatgcacataaagatggaaataataaacacggggcactctaaaagaggagagggtgggaggagggtatggattttaaaaaattacttactgggtacaaagttcactatttagtgcgatggttaaactagaagcccaaacctcaccattacgtgatatatccatgtcacaaacctgcatgtgtgtcccctgaatctaaatttcttttaaaacagaagacagcatagtgccatgtgccattgactctttagatgattcctactaaaatgttgcactaaaatgaaccctgttctatatttacctttttttgaagttatcattcaaaatactcagaattcatggatcttttcagatgtgattatcttgaaattagaaaatgttttcaattatatatctctctctgaaaagctgtatgattattaaaagtcattagttttctactcatttcatcattttagtattatgatattgcttcaatgactgtgcattttattcagaagcttgccattttttttctcagaaatttctgagatcagagatgctagcaatctcttctctttgaaagaatatgacaatctcatttatttttccttttgtcctgacgtagctttagacattgctagagtatatttatatcttgaaacaatattcaacaattttgaaaatttaagatcacagtataaaatagacaagatccatggtttaaacctaatataccaagagattatgaaaaaaatgaaaagcaccaagggattatgaaaaaacaacaaccaaaaaaacagagaggtaagaatgcttattggagtagttacaagcttaataagctccaagttaattatcaaatcaatgtattagtatattaaactgcctacttaaggccagacagaaatggaatgcactgtaatttaaatgtgacattaaaaattctcttaagtttttagcatatatatagatatatatcccttcttatatattcaatattatctagcattgtatttttcaattataggaccttgaaaaatatgttaagctaattataggtaatgtgatttgacagcaatgtcaaaatttttagttattatgattgtgttacatagcatgattatatacatgttcttgaataaatacagacagatatattacacaaaagcaacactgatattctaagaagtaacacaaaaatgaaaatgaaccatgagtattactgaaagagaataatttaatggaaaatttctgtgatgttaccctgagaaagcaaaacttgagccatatcaaccctaataagaaatgacaaaccttgaaaagctatctataaattttctttaaagcagtatgcttttcagataagcaaaattgttgtacattgttaccagcttctataaatgccagttcaatttcagaatccattgtttaattgtgatcatatcaaaaaagaatcctttctagagagaaaaagcattaaaaaaagagaaaagattatgttaataaaggaaatgtatcttgtaaccacggtaacattgaaactaaaatattcagaaatgtctttttcccctacgccattgttttgtgaggagatgattagttatcagctcttggatccataatcctttaaaatggtgtcatttgaaaagcagaacacaagacttacatggaacaataaggtctaaattcccatgcttctgaaaataaatcatggagacattgtataccagagggtactcataactattgggtggacaggaagaagattcacacagcattggtttaattttaaaattattgtttaaagacattatttttatgataaaccatattgtggacttgaaattcaaaatttgcagacatccttgggaaaaactggcaacattcaatttggaactttcactgactcttgtgaactgcaagttgaagaacgaaagtgcgctcatttatcttctattttagggcagaagtttgagaaactctgagtatgaactgaatatcacctgttccacttgtaagacatagacatgcggtttttccttccaccattaatgtcatcctatatcttattgcaccattctgggagaccttttgtaattaaaataaatatcaaagtttgggtcctctcaacagagcactgatttcagagcagacaggttctcttggtttattattccaaagaacaaaaaccaaaatctcaaaaaaaaaagcatttttatatagaaagaaacttcctaaaaatattcagacatttatattagaaatcactattgcctctgacaagtgaacaaacacaatgaaattaaaaaaaaaactttttggaactatctttgaacatacacaaatttcccccttctaatcaattaaaaaatgccattttcttaatagtaggcaaaacacgtttgcttttcattttcatttctatgtctttaaatttttacaaaacagttaaactcaaagtacaattctttaaaagggcatattgttcttggtaagaacaatcccagcaggtctcccactgccatgtttggagatttgcataataacacaactaagtacctgacccatctctgcatgcagaaattaataacaaagatctgtctcccttctaggtgtccattgccatagttacctcacaagttctgagaatatgcttaaataaaagatgtcgggtagaaattaatcattgactggaaaacaagttttcatgatgaggtcaggcttttgtttctgggtcagactgaaacattagacagtattctgatttgagcagagctgattgcctatggttggagatctacctcttagggtcttacacaaaacactggtctgcttaagtgtacaaagatgattgctttatgtatttgttccctcaagccctgtttaaaaaaaaaagaaaaaaggaaaaagagaactgtcaaccatgctgtttgcaatggtaaggcgtgacgacaagttttacaagtttttagtgagagtgcaatggaaataacaaatcaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaacaaaaaaaaaacactgatcctagaagagtatgtcaatggtcaactatgccttttttcacgggaagtatttgtgttgtgatcctagaccttttgtttaagaattctttcccctctctctatgaaatccctaattatttagccgaggcttgtccctctgattcaattctattaaatttacctgtggagaacttggccctgcaaggtgtaatagcattaagcttggggatagggaagagaatgagcaaatactattcatcacaacattccttttcaaaccccaggaaaagaaacttggacagctcctccagctgctagagtaataggtctttggcaggcgcccccaacccctgtctacgctttgttaacccctaacaggaagaagaaatacaatacaggctcagggctccagactactaaaacaagtgatgaggataatagctaaggtttctttatatttttgggggggattaaaaaattgattaaaaaattgtacagttattgtacacagtaactgtacaaatgtatggggtacatgtgctattttgatgtaatgatcagggatatccatcgtttcaaacaattattattcatttgtgttgggaaccttctaaagcttctcttctagctattttgaaatatacaataaattattgtcaactatagttgtcctactgtgctagggaacactaggacttattctttctatctaactgtatttttgtactcattagcaaatctctcttcatacccccttaccctctactcttccctttctctggtaactaaccactgttctattctctacctccatgagatcaaatttttttggctcccacatattagagcgaacactaacagctaagttttgtttcgatgttgcttctaaatatgaaacctatctcggtttcttggagttattgaaagtaatgtctcactgcaactgaaagaatcaaagtaaggtcagctgagcaaggtgagcctcctctaattcagccagagcctaaattcatggtgtaatgaaagattagtgttttaggctttttagcatcttccaacttttaatattgagcacataacaagaaaaatgttttgagtatattcagaaaaaaaatgaaagaagttgccattctcaaacagtgactcaatcttcactacttggaggctccgtaaggactaattcattcatgcacttactcagtaaacatttattacacatctcatatgtcctaggctctactataaaagatgaaggtgcaaaaatatatattatttttacctccaatcagctcacagtttatcaactgtaagaaaagacacatacaggttgagaatcccttatctgaaatgcttgggggcagacatgtttcagatttcaggtttcctgggattttgaaatatttgtattatacttaccagttcaacattctaatctggaaatccgaaatctgaaacattccgatgagcattttctttgagtatcacattggtgctcaaaaagtttcaagttttgcagcattttggattttgattttccagattagagatgctcaacctgtactaaaattagtgcaataaaatgtttacaggtgctttcattgaaatatatacaatgtacagtacgaaatgaaaaagggattgattactggctggtgaggagcaggaaaggcttcatatagcaggttagcctcaactgattcttaatacaaattggaaagctgcaaaagtatggaggagtttcaggcaaaaagagcaattcttgacaaagacaacaaacatccgatatttctcaagacctggaaattggatgatttagcagagctgaatctgaagggaaccaagaaaaaggaaaattgtgagggggtcttgcccatcaccctggtgaatttgggctttaatatggagacaatttattgaagggtgtgacacagaagtaatagaaaacccattagaacacactgttggatgaattctggcaagaagatgatggtttaaaggtgataaggaagaaatgctgtaggactttcaaaattcccaaacacagggaagttttaatcagaaatcttattaattccagatttctgacttgcaagtctggatggacaggggtaatgtcagttgagtagactgcatattagaagagagtctaaaagattagaaagagaagttaatgatctcaagttagacacattgaatatgcctcggggatgttagatgtttggaatttggcttgaagatgactaggttgcaaactcactctgtgaagacacccatttctctgctatcgtgcaagggtaatatttaacataatccagtatggcagggcaaagaacaatcagatagatgctgctcagagcacagggatgtggtcctggatgcccctactgtaccacacatttccctttaattcattgattgggaaatgcacagaggaagaagccaggcagctaagtcaagaaagtataagggtatttgcagtctttgaggtagtgactgtttagtaacttatataaaaacatatattatatatatatatatattttttttttttttttttttgaggcggagtcttgctctgtcacccaagctggagtgcagtggcctgatctcgactcactgcaagctctgcctcccaggttcacgccattctcctgcctcagcctcctgagtagctgggactacaggcgcccgccaccacgcctagctaattttttgtatttttttagtagagacggggtttcactgtgtcagccaggatggtctccatctactaacctcgtgatccgcccgcctcggcctcccaaagtgctgggattacaagcgtgagccactgcgcccggccaacattttaatattttcaccaccacacagccatatctgtaggtaacacattaatttttagccttgcttatggaatctcttttgtgggtttgttaaaactttatttcttcccttttttttcttttttttttcttttttggacggagtctcactctgttgcccaggctggagtgcagtggtacaatcttggctcagtgcaacctctgcctcctgggttcaagcgattcttgtacctcagcctccagagtagcttggattataggcgtgcgccaccatgactgtctaatttttataattttagtagagacgggaatctcaccattttgcccaggctggtcttgaactcctggcctcaagtgatctgctggactcagcctcccagagttctgggattacaaacatgaaccactgcgcccaacctgttatgactttatttcatccttaactacttagtaaaacttactaagaggaattgaaactaaataagggtgaaaggagtctttctcacgctgcagtcagagtgtatataaggattattgcatctctaagggacagatttcacggtagaagcaagaagtagtagctctgaagcaaatagaataggagaacccttgagtaacagtgatgtgaccaactctgatcattgattgttttctactgaggctaatagtaatccttctcaggcacagggatagagaatggatttgctccatcaatgtagccaattctttcccaccatcaggttctgaatctcaccaattttctcactgagcttctaaagaaaaacattttagagtgatgctcctacagtggaaaaagctattcacttaggagtaggtaaacagcaaattacaatttctccacttgccccatatacacttttgttgatattttccaaaacttattgcagggatagcacattagaataaaaagcttatggtactgggaattaaaaaactttggttctagcaccaaatttacactttctaatcataaaaataagactaacataaaaataatatgtttctttaatataaaataagactaaatatccttatctgaaatagtgataatgataccttctcattcaatttttataaagttgctataagtagtatctttgaaatatctgtgaaataagtgacatctttcacttttgcacttctatgaatcaattatgtcatttggctactttggattcctattttcttatctaaaaataagggttatttcttctaaatagtttcctgtatcttttctaaagctaacattttgcagtgttacaaactaaaaaaagaacatttttatgggtgaaagttaatggtgagatagcttttttcctttgcctcttttcccatggtccctgccttcataaaagattaggcacaccttgcctaaatgaagagagctctgtctctgacatttacattatttcctggctaggagaagatgaaatttgtacaaattacaagaaagcgaatcactgtgcttacataaattacataaaaatccaagacatgcattatagagacatttgcaagctgcttgtacttctgaaatccagaaaattaattgccatttccaccaaggtaaataatgacacaaaatagaggaggtagattttatttttgatgtctcctatgttgataattgcagagaattgtgagatgacagcttccttttatagtcaagcctctcaaatcctatcttctcaaaatagttttccatgagatcctcgtcactttgccatcacttcatttctttatttctgcctggtcttattgtacaagtgtaattatttgtcctcactaatcacaccataaatgtatctactcttattatctataattcctcatattcctcatatttatgtaatatgacttttcttattccatagtattaaatatggactaaggacgtgaggtctggaataaaactatgtaacttctaggtgtctcagttttctgtacctataaaatgggggtaaaaattctcccaacttcaccagactgatacaaaaattaaataaaatagtccacagagagccttgtactcaataagagctcagtaagtgttagctattattattctgcaaaggaagtaagaacaattcattaagtttgtcattgaatttgtgtcctcttggaaacacactaggtcaaggaatttagaaaagagtttgtgtaatcccagcactttgggaggccaaggcgggcagatcacaaagtcaggagatcgaggccagcttgaccaatatggtgaaaccctgtctctactaaaaataccaaaattagccaggggtggtggtgcacacctgtaatcctggctactcaggaggctgaggcaggagaattgcttgaacctgggaggcggaggttgcggtgagctgagatcacgccactgccctctagcctgggtgacagagcaagactctgccaaaaaaaaaaagttagtgtgattctatgtaaagggttttgtttagtagatgacttatattaggctgtagacgattttaaactgtatcctgtgtctgagatgattgatgtcataatataaactctgaaacatacaaaatggccataattattgaatgaatattaaaggggtttttttgtcaggcttaaattttgaaaatacaggtagagtgtttagcatcggttcactaaatattgggtaatttacttatttttaaaattaatttacacttgaatttccatcttccctaaaaggttagtcttcactcagccctctctctgtcttcaggggaaggttttgcttccttgccttccaacttccagttgtgaggatatcagtagggatttgggaacaggcaaagacccctgcattttctcacttccctaaactgtctgccctgagtggagctgaaccagtttgagtgagccaagttatctgtcagtggctccgtccaagcatcttggtggtaaatgatgacaaattatgtgaaagaatgctgtataaatttagaaagttttaatacagtgacttaatttttctttattgcataaatatttttgcattatttaaggtaattatagcccattagtttggaaatgtcattgattggctacatcctattaatatagactgtagattggctgtaaatttctcttttctgtttaaagttgtagatcaaattcacatagctgtgtgatggcagacataattaaagccattccctatctcctccactgccatgggtaccaaagactttccatctcgaagcagatggctactgaagccacaacactgctactgcagtgcagatccagacgagttactggataatagcttaaattttctcaaaaagcaaaagtggttcatattccaaatttcagacaaacaggactaaaggatatgtagaaaaatgttgctgaatatgaaaggtacaaattcacccaagcaaaacagttggacatgaattaaaatagggcaaaaaagaaaaaaagaaaaaaaacaggaaagaaaggcaacacaaggcacacatgtatgcatttgtacttgcatttctaattgcatcatggaaagacaaatagaaatccactgtaaatatttttatatgtatcaactattgtctagatcctggtttagctaaactagaaatacaaaaacactgttatcgaaaagagctatcctgaccacttcaccactgaagaaaacttgcttgctccatgcttgcatgtatctctgagttttgtcctaataaaaaggaataaaaatgattttccaaaggcccttatctatcagtgatacctcttccatgtgaggaggggaagcctttaatatactgctattgcaggtcacacctactcttctacttacctagattaatttctaattggatcatgtttagaaagggtgtaataaagatgagaggttagctttagaattttttttgaaaggtatgtaatgtgctttagcaatacatttgttggtaaagtccatcccagttcattcaaaaggaatggaattttggttttgtttcatacggggtgtttgcatttccagattttatcaaaagacaacatttttaacaaatggcataattccagtcaaatttgctttatgtctaggaaaatacattttaataaatatttacagtctttcagtattgtcagactgttacagggagaagacgacatattcaataaagaagagattatgtaaaacatgggttggcaaaatatagtccttaggccaaatctagcccgtggcctgttctgtactgcctgcaaactaagaatggtttttacatttttaaagggatgaagaagaaagaagagaaggggagagggttaagagagagaaagaaactagtgatcgtatatggaccacaaaccctacagtatttattatctggcttgttacataaaaagtttgtcaaaccttggtctagaaaaacagaaagtaataagaggtacaggcatacttctttctaccgtgctttagttgattgtactgcacagacattgcattttttacagattgaaggtttgtggcaaccctgcattgaacaagtttatttttctaatagcatgtactcactccacatctctgtttctcattttggcaactcttgtaatattttaaactttgttataattattatatctattatggttatctgtgatcagtggtctttgttgtcactattttagttgttttggagcatcatgaatcatgcccatataagacaatgaacttaatggataaatgtaggttctaactgctctaccaatcagccattacccaatcttttcccatctgctggggccttcctatcccctgacatacagaaatgttaaaattatgccaattaataaactacaatggcccctaagtgtttaagtaaatggaagagttgcaagtctctcattttaaatcaaaagctagaaatgattaagcatagtgaggaaggcatgttgaaacccaaggtagactgaaagctagtccccttgcaccaaacagatagccaagttgtgaatgcagacaaagagttacttagacaaactaaaagtgctactccagtgaacacaaatgataagaaagcaaaacagccttattgctgttatgaagatcattttagtggtctagatcgatcaaaccagccacagcattcatctagaccaaagcctaatcaatagcaaggccttaattctatgaaggctgacagaagtaaggaagctgcagaagaaaagttggaagctagcagaggttggttcatgaggtataaggaaagaaggcatctccataacataaaagtgcatgtgaagcagcaagtgctgatatagaagaagctgtagcaagttatccagaagatctagctaagataattgatgaaggtggctccactaaacaacacattttcaatggagattaaacagccttatactgaaagaagatgccatctaggatttttatagccagagagaagtcaatgcctggcttcaaagcttcaaaggtcagcctgactctctttttaggggttaatgcatctggtgaccggaaattgaagccaatgctcatttatgattctgaaaatccttgggactgtaagaattatactaaatttacactgcctatgctctataaacgaaacaacaaggcccagatgacagcacatctgttgtcagcatggtttgcgaaatagtttaagcccactgttaagatctactgctcagaaaaaggaagatttcttcccaagtataatggctaattgacaatacatctagtcatccaagagctgtgacaaaaatgtacaagaagaacattgtttttatgcctgctaatacaacatccattatctagcccatagatcgaggagtaatttgactttcaagtcttattatttaagaaatgaatttcaaaagggtataactaccacagataatgattccctgattgatctggacaaagtaaattgaaaatcttctgaaaaggattcaccattttagaggctattaagtacatttgtgattcatgggaggaggtcaaaagagcaacattaacaggactttggaagaaattgattccaactctcatggatgactttgaagggttcaagatttcaatggagaaagtaactgtatataaatgtagtggaaacagcaagataactacaattagagtggagcttaaagatgtgactgaattgctgcaatctcatgttaaaacttcaatggatgagtagttgtttcttatggatgagcaaataaagcagtttcttaagacagaatctactcatggtgaaggcgttgtgaacattattgaaatgacaacaaacgatttagagtattatataaacttagttgatggaggagcagcagggtttgggagaattgactccaattttgaaagaagttctacagtaggtagaatgttatcaaacaactttgctagctagagataaatctttgatgaaaggaagagtcaataaataatggcaaacttcactgtcatcctattttaagaaatttcaccatcagaaagattctgactcactaaaggcttagacgatcattctctttttttagcaataaagtattttttaattaaagcatgtacactgctttttagatataatgctattgcaaatttattagactacagtgtagtataaacataacttttgtactgggaaaccaaaaagttttcatgacttgctttattacagcattcactttattgaagtgatctggagctgaacccataatatcgtggaggtacacctatacttggtaacttaagagtttggtggtaagatgcattagtgatcttactgtagcaaagtgagaaattttggatacattttagaaaggcaagaggataggaaataacactggatagaatgaaaggggtagagcaagatggtggaacagaaggccccactgacagtaccccacataggaacaccaaattcaacaactgcctaaaacaaaaaagcaccttcacaagaaccaaaaatcaggtgagcgctcacagtatctggttttaacttcacattgctaaaagaggcactgaagaggaaaaacagccttgaattgccaatgcaacccctcacacatccccccacagcagctgcttagaaatctatgtgcttgggaaagggagagtgcagtgcttttgagatgttgaatttaactcagtgttgccctgtcacagtgtgtccagaattggtgggttcttggtctcgctgacttcaagaatgaagcggtggacccttgcggtgagtgttacagctcttaaggtggcacgtctggagtttgttccttctgatgttcggatgtgttcggagtttcgtccttctggtgggttcgtggtctcctaggctcaggagttaagctgcagaccttcgcagtgagtgttacagctctcaaggctgcgcgtctggagttgttcgttcctcccggtgggctcgtggtcccgccggcttcaggagtgaagctgcagactttcgcagtgagtgttacagctcataaaagcagtgtggacccaatgagtgagcagcagcaagatttattgcaaagagtgaaagaacaaagcttccacagtgtggaaggggacccgagcaggttgccattgctggcttgggcagcctgcttttattctcttatctggccccacccacgtcctgctgattggtagagccgagtggtctgttttgacagggtgctgattggtgtgtttacaatccctgagctagaaacaaaggttctccaagtccctaccagattagctagatacagaatgttgacacaaaggttctccaaggccccaccagaataggtagatacagagtgttgattggtgcactcacaaaccctgagctagacacagggtgctgattggtgtgtttacaaaccttgagctagatacagagtgccgattggtgtatttacgatccctgagctagacataaagtttctctaaggccccaccacagtagctagatacagagtgtcgattggtgcattcacagaccctgagctaaatacagggtgctgattggtgtgtttacaattcctgagctagacataaaggttctccacctctccaccagactcaggagcccagctggcttcacccagtggatccctcacgggggctgcaggtggagctgcctgccagtcccacgccatgcgcccacactcctcagcccttgggtggtcaatgggactgggtgccgtggagcagggggtggtgctcgtcggggaggctcgggccgcacaggagcccatggagtgggtgggaaggtcaggcatggcgggctgcaggtcccgagccctgccccgtgggaaggcagctaaggcccagtgagaaatcaagcgcagcgctggtgggctggcactgctgggggacccagtacaccctccgcagccgctggcccgggtgctacgcccctcattgcccggggccggcagggccgccggctgctccgagtgcggggccgccaagcccacgcccacccggaactccagctggcccgcaagcgccaggcgcagcccagattgccatttgcacctctccctccacacctccctgcaagctgagggagccggctctggccttggccagcccagaaaggggctcccacagtgcagcggtgggctgaagggctcctcaggtgccgccaaagtgggagcccaggcagaggaggcgctgagagcgagcgagggctgtaaggactgccagcacgctgccacctctgaacagcagaaagtaaaactgggctgaagtcagcttatgcctgctcccatagggagcattcagagaagacctagccaaaggagaactcaccatcctagtggccagaagttgcattccagcaagcctcaccactgcaagctgaagtgttctgggttcctaaataaaacttgcaaggaagtctgggccacaaagactgcaagtcctagtgctgagctacgtactgagccagtggacttcgggggcacatgacctactaaaacaccagccagggcagctaaggaagtgcttgaaccacccctcttgcaaccccagacaaaaaagctcatgactccataatagaccacttccttccacttcaggaaaggagagggaaatgtaagaggatttctgtctttcatcttggataccagctcagccacagtaggatagggcagtgttctaagttgtaaggcctctattccaggtcttagcagccaaatgacatttctagacacactctgggccagaagaaaacctgctgtcttgaaaggaaagacctagtcctggtaggatccatcacctgctgactaaagagcccttgggccctgaataaccaagaacgatatgcacatagtatgccatgggccttagatgagactctgagatgtgctggcttcaggcaccaggtcggccacacactggagtagggcaccaaacaggttcttgaagtccccaattttaggccttggttcttggatgacatttctggactttccctgggccaaaagcgagcccattgccccgaagggtgagtctcaggcctggcagcattcaccagagctgaccgaagagctttggggccttaagtgaacatcagcgagagtctggcaatactccccatgggcctgtagtggtggtgaccacagggtgagtctccccttcctgtggaaaggggagggaagagtaggaaggactatgtcttatggtttgaaggccaaccaaaccatagaatagaccaccaggtaagcttctatggtttttcactccagtccctagctgccagatgggggaactggatgcctactgcccatggcctgaggaaactcgacaccctgaagggaagaacataagcctggctggcttgccacctgctgattgtagagtcctagggcctggagcgaacataggtggtaacaaggtaatagtttcagtgggacttgggtgagactcagggctatgctggtctcaggtctgactgagcagagtcccagtgatggtacctacaggggtgcttgtgtcactcatccccagccccaggcagctcaacacagagggagagactccattttcttgggagacagtaagacaaaaaacaagagtctctgcctggcaacccagagaattcccagattttatccacagatctaatccacatcttatccagatcttgtccacaaccaccaaggcagtacctctgcaagtctgaaagaacaagcacattactgcccttggagatcctcctgatgcagatatggcttagattacaacagtcatgtccttgtgaatacctggagaaccttccaagaagaatgagtacaaacaagcccaaactacaaagactaaaatcaatacttaactcttcaatgcccagacagtgatcccaccaaataaactaaatatcccaccaaggaccaatcctggagaaataaagatatctgatatttcagagagagaattcaaaatagctgttttgaggaaactcaaagaaattcaaggcaacacagagaaggaattcagaattctatcagataacttaaacaaagagagtaagttaattaaagagaatcaagcagaaattctgaagttgaaaaatgcaattgacatactgaagaatgcatcagtctcttaatagcagaactaatcaagcagaaaaaagaattagtgagcttgaagacacactttttgaaaatatggtcagaggagacaaaaggaaaaagaataaaaaacaataaagcatgcctacaagatctagaaaatagcctcagaagtgcaaatctaagagttattggccttaatgaggagacagagaaaaaattatgggtagaaagtttatttaaacaaataataagagaacttcccacacctagagaaaaatatcaatatccaagtacaagaaggttacagaacactaaccagatttaacccaaagaagactacctcaaggcatttgataatcaaactcctaatggttaaggataaagaaataattctaaaagcaagagaaaagaaacaaacaacaaacaatggagcacccacatgtatggcaataaaattttaagtggaaaccttacaggccaggagggagtggcatgacatatttaatgtgctggaaaaaaaccccaacttttagcctagaatagtatatctggacaaaatatccttaaagcatgaaggagaaatagaaattttgccagacaaacaaaagctgaaaagtgttatcaacaccagacctgtcctacaagaaatggtaaagggaatacttcaactgggaagaaaagcatattaatgaacaataagacatcatctgaaggtacaaaactaactagtgatggtaagtacagagaataatacaaaatagtataacactgtaactctgttgtgtgaaccactcttattttaagtagaaggactaaaagataaagcaatcaaaaataataactacaacaactcttcaagacataggcagtataataagatataaatagaaataacaaaatgttaaaaagcagagggaggaagttaaagtgtagagtttttattagttttctttttgtttgtttgtttatgcaagcagtgttcagctgttatcagctaaaaataatggatgataacaggttatctgtaaacttcatggtaacctcaaattttaaaaaaatgcaatggatacacaaaaaataaaaagcaagaaactaagtcctctaatcagagaaagtcacgttcactaaaagaaagacaggaaagaaggaaagaagaaaaagaagaccacaaaacaaccagaaaacaaataataaaatagcaggagtaagtccttacggacaataacattgaatataaaaggactaaactctccaatcaaaagacagagtggctgcatgatgaaaaacaggaaccaatgatctcttgcctgcaagaaacactcttcacctataaagacacacacagactgaaaataaagtgatggaaaaagatattccatgccaatggaaacaaaaaaagagcaagagttgctatatttatatcagacaaaatagatttcaagacaaaaactataagagaagacaaagcaggtcattatataatgataaaggggtcaattcagcaagagaatataacaatcataaatatatatgtactcaacattggagcatccggatatataaagcaaatattattagagctaaataaagagactccaataatacaataataattggagatttcaacacccccactttcagcattggacagatcttccagacagaaaatcaacaaagaaatattggagtgaatctgctctatacaccaaatggacctaatagatatttacaaaacatttaatccaatggttgcagaatacaaattcctttcctcagcatacaaattattcctaaggatagatcatatgttatggcacaaaacaagtcttaaaatactcaaaaattgaaataatatcaagcatcttctttgaccataatggaataaaactagacatgaataatgagagaaatttttgaaattatacaaacacatggaaattaaccaatatgctactgaatgaccagtgggtcgatgaagacattttttaaaaattgaaaagtttcttgaaaaaaatgataatgggagaacaacataccaaaacctatggaatgcaatgaaagcagtactaagaagaaattttacagctataagtccctacataaaaaagaggcaaaacttcaagaaaataacctaatgatgcattttaaagaaatagaaaagcaagagcaaaccaaacccaaaattagtagatgaaagaaaataaaaaatctgagtagagataaatgaaattgaaacaagaaaacaaaagatcaacagaacaaaaagttgggtttttttgaaacaataaacaaaattgaaaaaccattagccagactaactaataaaaaagagaggagacccaaattaaaaaaaaaaaattagagatgaaaaaggggacattacaacttgtactactgacattcaagagatcactagtggctactaggagtaacaatatgccaaaaaattggaaaacctaggagaaatgaataaattcctagacacatacaacctaccgagattgaaccatgaagaaatccaaaacctgaacaaacaagtaataagtaatgagatcgatcataataaaaagacttctagcaaagaaaagcccaggatctgacggcttcactgctgaactctaccaaatatttaaagaactaataccaatcctattcaaactattccaaaaactgcaggaggagggaatagtttcaaattcattctatgaggctagtattacactgatgccaaaagcagacagacacatcgaaaaagaaagctacaggccaatatcgctgatgaacactgatgcaaaaatttttaacaaaataccatcaagccaaattcaacaacatattggaaagataattcatcataaccaagtgggatgtatcttaaggacgcaagaatggttcaacatatgcaaatcaactaatgtgatacatcatatcaacagaataaaggaccaaaattatataatcatttcaattgaagctaaaaaagtgtttgataaaattcaaaatcctttcacgaataccctgaaaaactaagtgtagaaggaacacacatcaacattataaaaggcatatatgacagagctacagctagcatcatactgaagggagaaaaactgaaagcctttttctctaagatttgaaacgtgacaaagatgcccaccctcaccattgttattcaggatactggataaaagtggatatctgaatagaggaatcagacaggaaaaataaataaaaagctccaaattggaaaggaagacgtcaagttattcttatttgcagatacaatctcatacctagaaaaacctaaagactccaccaaaataaaactattggaacgaataaacacgttcagtaaagttgcaggatacaaaatcaagatatagaaatcattagcatttctatatgccatcagcaaacaatctgaagaagaaattaagaaagtaatcacatttacaatagctacaaatgaaataaaataccttgggattaaccaaagaagtgaacaatctctataatgaaaactataaaacactgatggaagaaattgaagaggacaccaaaattgaaaagatactccatgttcatgaaccagatattcaatattgttaaaatgtctagactacaatacctaaagcaacctacagattcaatgcaatccttatcaaaataccaacgatatttttcacagaaatggaagaaacaatcttaaaatttatatggaaccataaaagacccagaatagccatagctaacctaagcaaaaacaacaaaactgaaggaatcacattacctgacttcaacttacactaccaaggccaggcagagtcgttcacacctgtaatcccagcacttgggggctgaggtgggaggattgcttgagtccaggagtttgagaccagcttaggcaacatagtgaaaccctatttctacaaaaaatagaaaaaaattggccaggcctggtggtgtgtgcttgtagttccagatactcaggaggctgaagtgggagaacgcttgtgcctagcaagtcaaggctgcagtgagccacgatcatgccactgtactcagcctgagaaaacagagtgagaccatgtcttcaaaaaagaaaacaaaaacaaattatattacagagctctagtaaccaaaacagcatggtactcacataaaaacaaacatgtagaccagtggaacaaattagagaacccagaaataaatccacacatctatagtaaactcatttttgacaaaggtaccaagaacatactttgggaaaacgacagtcccttttataaatggttctgggatagctagatatccatatctacaagaattaaactagaccctatctcttaccatattaaaaaatcaaattttacagtggattaaatacttaaatcgaagacatcaaagtatgaaactattaaaataaaacattggggacacgttttgagacactggagtgggcagagatttattgagtaatactctgcaagcacaggtaaccagagcaaaaaaggacacatgggatcacatgaagttaaaaagcttttgcacagcaaagggaacaatcaataaagtgaagagacaacccacagaatgggagaaaatatttgcaaactatccatctgacaagggattaataaccagaaggaactcaaacaactctataggaaaaaatctaataatctgttcaaaaaatgggcaatagatctgaacagacatttctcaaaagaagacatgcaaatggtaaacagttacatgaaaaggtgctcaacatcattgatcaacagagaaatgcaaattaaaactacaaggagatatcatctcaccccagttaaaatggtttatatcccaaagacagacaataacaaatgctggcgaggatgtggagaaaagggacctctcatacgctgttggtgggaatgtaaattagtacaaccactatggagaacagtttggaggttcctcaaaaaactaaaaatggggtgccatatgatctagtcatcccactcctagatatatatccccaaaaaggaaatcagtatatcaaagagatacctgcactcctatgtttattgcagcactattcacaatagtcaagatttggaagcaacctaaatgtccatccacagatgaatggataaagaaaatctggtacatattcagccataaaaaatgagatcctgtcatttgcaacaacatggatggaactggaggtcattatgttaagtgaaattaaccaggcacagaaagacatactttgcatgttctcacttattagtgggagctcaaaattaaaacaattgaactcaaggagttagagagtagaagaattgtcaccagagtctgggaagggttgtggggggggaaagtaggtatggtcaatgggtacaaaaaaatagatagaatgaataaaacctaacatttgctagcacaacaagatgcctatcgtcaataataatttaattgtacattttaaagtaactaaaagagtataattagattgtttgtaactcaaagcataaatgcttgatgtgattgataccccatttaccctgacgagattattatgcattgcatacctgtattgaaatatctcatgtaaccataaacatatacacctactatgtacccccaaaaataaatataaaaaattaactaaaaaagagcactgaactttataatttatggttttaatgaaaaggaaaattgaaaaatatatatagcagttatagagaatctgggagaaaaaaggagctatgttaaacattcggtccttagtaccatattatgtcaacaatgatctctacagatagaagatgataaccacaatcaaatggggatctccacagatggaaagtgagacaattttgtgtgccagctgaacaagacgtccggaaatgacaataacaataatgagaagagaaaagatatcaaaagatatccaaactccaaaaggttcaatgactgacattttgagtgtttaatcttgcattttaaaataagaaaccacccacgtaaaacagcacatagcaaaaaagttattatttctctatacttctcaaatatatgctattcttcagctatagtaaacagtttttagcttatataaactttcgtatctttttctatgcagttatttacaaatgtaaatatttaacatttatattatttagcataaaacaaatatatttcttttatttaaaataaaaatatttgacattaacatatattataaataataaagtggttgctattggttttacacaaatgggaatatatcatgtagatatttctataccttccttttttcattttgtatgttacatgattctcaggtcttgcagatagatttttccattcagtaatatgtaggtagacttcattttttaattgttccacaaaattccttaggtgtataccataattagtttaaactatttcttttcttttagacagaatgttttactattttcctgttatgaattatatacagtcttgtgaccatgtcttctgtaattttacaattcctcctgttgtatccctgctcagttgtcactttcaaatacctatttttcatagacagttcactttatcattattcttaagcactatacctaatagagctcgtatgtctttaaagaaatggatattcataatccttacttattttaaagttgaattttggaaatgaaaaactgtttgacaaatattgaataatctgtttgaacacagatttgagtattgttaggcaaaaaaccaggattatccaaatatacaatcttctgcctcagaaaatggtgtgctacttgtcactggaaatatttaaatatggaacagacaacattttttttacagagccatttcagatgagattaaagtactgaataagtggtaaatctagattatttttagggatttcccaaccttcaggtacttcaaaaagaaaaagttggggctatttgcagtgcatgactatttgtattttcttttaaattcattcatatatgacaaaataacagtgagctgaaaaacatggtcagtaatctttggtcaaacatgctataaaaacaaaacttaaaaaaatacagaaaatctagtcaaacatcttcatgctcatgcttactgaagagtagaaagttctcagaagactgactttcctatgatttcttataaaccagaattagatatcaatagtgctcccataaccattgctccaacgtaactaattatatatcattgctagaaatgcagctgtgggattatttggtgtgattttttcttatctgcccttagcaaataatcctttcagttttaaatccttctcagagtaggaatccgttgctatcagttgctactgtgtaagtaattatttcttcttaattgttgtgaagtaagtgtactggttgggtgacgcaggctaagcctcccacctttcttcatagcattgagacaggatttacaggtatacttatgacttgattttattcaaagggataacagataagtgggtgttctgcgtgctagtaaacaacatggtcaactcgggagaaaacctattttatctctcttatttttctctaaaaggtattgttaaactaggaacagtgctctcttcaagaatctcctttggatattaactctgcaaattgtccacacaaaattacataaaccctacatcctcttatagggcatcattacattttggcctctgatgataatcatcatgatttgaaatggccagtggcaactacatctttgacatttgttacactatctttagtggtctttttgccatagccataagggatgctgctttgtaacagcagtaatattaattgctaccattatcttgcttctcatgttaaattttcggttaaatcattgctataagtctaaatgagcagtcagggataaaaaggacaaaggagtaggaggaaaatacatgactagactgagccctgctgcatactgagaggtaatttacacaaataggcagacgaaaacagatgggaagagggagagagcgagagcgttgactaatgacacctgactgccaaatgaccctgtgggtttgaacgctggcaggacacctaaaactgtgccagcagccagttggaactgcccagttctcactcacatttcatttaacaggctaaccttggtctttctattgttaccatcaccagggaaatttatactatgtctaattatggtccagaaaatatacattctaactggtttttcttctttgagaagctatgtgctcctgaactgctcaggagtttattgttacagtcacctttgtttccaacggggaaaatttgatgtatttgttcttttaagagcttcttttgtaaaattatagtatgtggcaccttttgtggcttaataaaagatgtggagaaaaaatgaaatttattctaagaacataactatattgttaaatactttgctgttggtaaaatatgtttgatcctgataggtaaggcgttcctggaactatatctaatggactcctacctgtctcttattctcattctcacttttaacttttaatctcttttcaactaccaacattaatgtttacggatgtatattaaaatatactctgggcttggaatcaagagtcttaggtaccagcattaggtatattaccaagtagctaactgaactaaaaacaataatttggcattcctgtgcttcagtctttccatctccgaaatgggaataatgtattctctctagtgctgctgggaaaaacataatgagaaaaaaaaagagagagagagagtgtatgtgtgtgtgtgtgtgtgtgtgtgtccatgcacatgtgttgtgtatagaaagtgtaaaatctggtctatggccataccaccccgaatgcacccgatctcgtctgatctcggaaactaagcagggtcaggcctggttagtacttggatgggagaagtgtaaaatctggattactaaaatcatatgtgtctgtctagagtttatttacagtaaaagttcagaagtactagccgattaaaaactaattttaaaaaacattgaaatatttctataatagctaagaagccttagattgttgatagtaattatgatattgtgtgcatttataaacagcatttatggatattaacaggcctacacatgttcttgaagatacatttccctgtttttttaaatttaaagaacaccaagagtatactggaaaagcgaatgggaacacagactgaggtctaggccatatttaatatttctaagctatataatgttaaacaatcatctctattgtcatttgagaagtgattctcttcctgtattctcttcctgccctagccctttggagaagagattaaaatgacaccaaaagaaaatgagttacattcgataattaaaaatttttcagctgaaaggaaattcttaggaatcaatcagtttaacccagaaatgaaattacacaccttccacacctcatttgtttaccatgtctgaatctaaaatgaactgcaagtgtagtgtaatctattttgtcagaacaaataaatagaagtcattgggtatggaaatcaacaaaccctaaacttgaaagatgggtcttcctgactcaaactgtggacattactccggcttcccattggggaagaggcaggtcttcagacattacaaacatgacttgaaaggcaaacacttggaaaagtcccactctccaggccctggagtccagagatgcctgagcgaatgattgggcagtgtgggaaaataggaaatatcaaggacagccagagagaatatcccaaagaaaagggagaaatatatagaaccaaagaagatggagggaggttcttgaaattaagaaagaagcaggggagtgggaaaccaaagagaagcaagtcatcgaagaatgggagtcagaaataaagaaaacaactaaatagctgaggaatatgtcctcacattatgaatttggcctgcatctcactctgaattcttaggactcacaggtttctggatagcctattaactttaactggagctctttggctcacattgcaacataacgtccatcaccctctctctctccaaatcttaaatctttctcccaacctagtaaggtagagcaggaaaaaacaaaacaaaacaaaacaaaaaaaaaccacctctgtaaagacagttttaatattaaagacaaaagcttttctttattccttggttgcagcaatgctaaattctaaagagagaatactgcaaaatattcaaacaaagtaagagtaaaacaatttttttatttttaaaattaccctgaaaattagtgtaaaattaaaattttaaaaaatcaattttcccaatggcttgtatccatccgtgtttactaagagcattctcaaaaacttcaccattttctcaagtatcccaatggtaaagatattatgcatttttccatctactacaatagcttataatgatgtttataaacagaaaaaatgaataaaatatgcaattgctgtaaggtctggctcaatttgtttggaaatttctataattatttgacatttctcaaaatagtaaaaaagctttccttttaaaataaatttgtgaggaaaatatcttaaaatcatttagtttggcaatgagagaggtaggaatataagagaatttggaaagtatttctcagagttataacatgttaagtcattcgttctcttaactcaggcccttcatttttgaaacacttttcttcaaaaggaaagctttaggtttctaggtacttttatgttaccacacttctattcaggaaaacaagagaaggtggttgaagaaactgtatttcccttaagtacattcctgtgatattaagataaatacagcttccaaatataaagtccaactcaacattaaaaatattttagtaagttttaaaacttatgcctgtatcacacaaaatacaggctgaattgagttaaagggcttaataaaaattcatcaaagcagaaaaatcaagattgaagtttatttcttattttatcaatgtgtagttgtaatacaaaagaaacttccgtataaatttctctcattttccttttctccaatcattttcaaaaaccctttaagacattttttaaatgtgaaattttatatgtgcacctgcattagaaaataaccatcatgttcaaaatattgtttcagaaatggaaatgacaataatttgaggccaacagatatcaattaaggcagactcagaaacatccaataataggtgtccatacagggttattgcttattgtttactttaacaaaaataattataggatttgtagtcctttagtattctttgaaacataatcagatcatagaatcttaaatttaaaatgtacactgaagatcatctagtactgccttctccttctacaggtatcccttttgcaatacttcacgcaggagatgatatagtctttacttaaataccttccagtggcagagaaatcattactttatgaagcatcccattctatgttatacacgaatttaatactgtgtgtatgttccttatacaatagatagaaaaatttgccttcccagaaattcctaaaatttctgtatttggcctttttccaccatattttggatgacaattttactctttccagcttacaacccttcaatattttaaagacagttctggaatcctggggctctcttttctaggcataaaattcctcagaaaagaatcatatgattctctgaccattcaccagtctaaattgctttgtctccatttcattatacctgaatttgacacggaattaagtataatgctgtatgtgcaatctgtacagtaagtcccgtaatccttttattctggacattgtacatatgttacagaggttcaagcatgaatttgtattttagaacaccacagaaaggcactcataaaaagattcttaatattgggttcgtagaattgatggtatacatagatgtgacatccagggaatctgtgattccccatgtatgtaatgtgaatatgaatatgtgtatgttgtgggacagaaaacgcataacttccattattttaggagttaatgattccactatagttcagaaccactgtctctttaatatgcattactgtgtaaccagttctccccatcttgattatgtgcactgactaaatgaactaaagtataagaatctgaattttactcatatttatcatagtactaactccagatacatgaaacttgatttttcatctaaaaagttattaattcttcctggctttatctaacctataacattttttgaagccaattgttctgaataacctataacatttttaaagcataacttctatcttcattcatgaaatcaataaaacatttgacttaacagagctaagaataaattttctaaaacactattagagtcacccaagttatattggtatattaatcaaagctatttggtagtattattagtaccaagacagaattgaaaaaccataattgctgtatgattttttgtgcttccatcaattgtaaaaactttgcaaatgccttaataaactaaaacataccacgtctgtagaatttttctgatatatccatctaataaaccaatagatttgatttgttttaaataagcacatctgcgtctttttgtgcaacccttccttacctaagtattcaaaataatgtttgttaactagtgactcatatataatttgtcctcctattctgcatttttaaaataaatacataaatgtcattcacacaccttaaagctttatggctccctttctgccttctataatattcaagaattctggaaagggtagctcatttgaattcatttaaaggattaagtgactccttatagttctttacttgtctgatgtttcaatgccatactatacaagcctcctttaacctttccagtgtgaatgtgatcctccctaagagagaaggcagaaatacaaagggaggtttttttatgttcattgtatcacgtcttaatgttcctcaagcaatggaaccattctttcttatgctgaaaacttcaatttttgaagacatttccattgctcgttgcactttacatagcctccattcattcagcacattaggttatgtaataatgttatttttcaagataatgccaatctttatcatttgtccttcattttatatgatgctttcttgtgaacatcctggatatatccataagtcatgcaaaatgtctaagtcagtctagtaagtcttgatgatattgctgccatcaaatctattgcctgtgtaaacaatgaaaggccattttgctcattatctgttttctaagtactattataaagatacctgcacccattaatattgtccctgacctacatgatttatatatatatatatatacacacacacatatatataatacatatcacatattcactgtatatttattttgagcacctgtgctgcaggaagcattgcactggctagtggaaacacacacatgaataatacacagtggctaccctttaagaatcataatctggtaggggagagcaactcgtacacataattgcaatgcaatcgaataaactaaatagatgttttaagttccatgaaagcatccaggagggggaacgacacctgatggggactgaaaaggagctggataatatttaagaagatgatggcattttaagctgaggtttttttgttttgttttgttttttggtgtttttttgtttttgtttttgttttttgttttgttttgtttttttggagacagagtttcactctgtcatccaggctggagtgcagtggcgtgatctcagctcactgcaacctttgcctccagggttcatgctattcttctgcctcagcctcccgagtataagctgagttttaaatcctgaatagggtcactagagaaatatttttttttccaaaagatattaagcagctctctaatggttattcttttaaatccatacatagtacagtacagtaactcctcaatgtcatcatttgtttttaagcaaaacaacttactgtataacaaaaataattttaccataggctaattgatataaacaagagttaacttcctatggtatacagtatgttgttgtgcttaaagttgcagcagtttctaagaatcttttgatgatgttaagtgagggctgactgtagccataatatatatcctattagtttctagagggaggtgtcaatttgctctctccctctctgtgattatatctaagaaactgtatcaattgccatttccttttcgggggaaaaggtacaatgtggtctttatttttttaaagtctctttgatcaaatacaaaattttccagttaaatatacttgtcttggcgctcaagggatttatgctatttcctcatagagctttgataagctataaaatatttaggctctgtctgcatggctagtcattcacttccaaattcttctttcttttcaaaataaataagaagaaattgagctactttttgtgtctccctagactatctttgaatgtcctactcaggttttaaagtcccagtcctggagatatagctctgttattttaatagtactatttgtttcactatgacctacagttaactttgcttcatttcactggtctttttttatacccagaaagacagtgtgcccatgaatattcctatcagatcatgtagctgctgcccttttctttagcaatggttaaatgactaccaaagctcaaccctggggaaaaagtctttataataggttgtctaaatccttttatttctccataatacaggtgttcttcttcatcaggactttatccaatggaataaatgaggaagcttatagctgttgcaatttccactcatgggtatttttctcttcttttctacactagtttgttccaattgttaaatataacatttcatcagtgctatcattgtgaagttcagcagtttctccctatgcatggggcatcattaaactcttactatgtaacgagctctgtgctaaacttaagttctttatgcatgttaactgtcacgtgagtttcatgttaacactcacatctctaccaggtaaatacttgtattatcaccactcaaaaatgagcatgagttttagaaagactgactggagcaaaaccaaagatgtaataaataattaatggaggtagggtccacattttttttattgttattgatctcattacttagattgttttgattttctgggcttctttttggaatatcactttcatttcacctaagaactccattctatttaataaactaaaacatagaattactttcacctcaagaagggagattggcttacatttatagaacatataattggtgagtgccttagggagaaagacaaacatagcacatggcctgcaggttgctggaatggtttctcagtgccagactgcttgagcatcagaatgaagcagtcctttgtggatattcctcctctaaacaagtgaaggaaaactatctcttagctctgggctcccagttgtgacactatggagtggaagaggaggagaaaggctcttcttggattctgacttcaacccaacttttccatccccctctgctttccccgttagttagtctgactgcatccaaagtaactatgattcacgtgacttgtttaggctcttttctatggctctgtcatactttgtgctaatttgggtgactatgcttctcaatgcacttaaatattaataaaaatagaaaataagttagaagatgttctaaaaatttgtattttaaattttattccattcactttagagaattgagaatattatttgacaggtttgactaagagtggccaggggaataaaatttccacctagttttttgcatttttttaatctcccattatatttaaaatacagatttccctttaaataaacaaggataaattttcaagtgctttagaattattaataaccacaactctcccaggagtgatttctttggagttcctaaaatcacaactcttcaaggacataaagtggagctaatttacccgcttatctgacccaaagtagagatttttagattcgttcaatcccaaaagggaaaagtacaccctaggtagtatttttctgtgaaacaactcttatttagagtggtgaattagtaagttggcagaataaggcgatccatatttttcctgcctgtgttatatgtgttttggggatagaaaaatttagaacttccaatgtagcaatttctgttgacaagaaatttagttactatgttgcaatggggattgttttgctgataaaattcttgattctagtagtccacccctattaagtttataaattgtttatcagcctttttcgcactcaccagtaggaaaagcaaaaaacaaaacaaaaaataaggcactatttctaacggcagcaacatcagtagctttgagaatattatttctgtgggttgcattttcagtctttattataattctcccttgcctacaatctaatttcttttagacccatatagtgccaatttctttaaagcatattgtagtaatattaaaaatctcaatctaaatatcaaattagccctcaaatcataagaaataaatccatgtgggctcacagaattctcccttcaggcactgagattttagttatttgtttctttgtttcttaaaaagaacaaattgttttaatgttgcattttataaaggacttcaaatgtgtaggtgtcccccaaagtacttgacttttgtggcattttttttaaaaaatcataacttggagaatctcagtatttgagtgatgataatcaaaattattttgggctgaaattctgtattttgtatcacagtccataggagaatttcacagccaagtaataaacctggaaaatatgggtttataatggaaatgtcgacagactctagcaggcgctgctgtaatatcttgaatctgatttaaaagaagttttcaataatgtttctccaagccagtcttttgggaaatgcaagttaaaaaaaaaaaagaaaaagaaaaagaaaggttttctactacctctatctcaatgattgatgaaaatgtgagtattttgtggccagatacctcagggcacctgtgaataagatcatggtaacaggagaatatgcatggagagactgctgtcctgtcctgtaaaaagccacccagttaaagtctcactgcacagatacattttgatataatgataatccatagattcacatggattatacttgtatgttctcagatgagggtagtaatggaataaattatcaccccacctagtcgtgttttaatagaaacttttcataggaggacaattacaagagcagctgtgactaagatggtgattctggaattactgtaatttattatattgacatacatagtctgtgctctcccatattctctgcaaaattatggtataaaatttctgcctttggtatatttttatacttcaaatgttattgattatgacaggaaataagagcttttttccaatcatttaattaaggcaaaaaatcaattaggcatgggtaccatcaatctgagtttgctgccttgccccactcgtagagttatacaatagagtgtccctgagagacgtagcctgtggaaacgcttgggtcgagctgaagagactttgggcagaatcatgcctccatgcttaccagctatgcaaccttgaacacacttaggacctctttaagtcccagttttttcaggtaaaatgagaaggaagtaaacaataataacaagagtgagaaaataataatgatagcaaaacgttattgaatgctgatatacatcagatactgtgttaggtactttgcatacatcaactcatttaaacatataatagtatcaatctcataactttgttgtaagaattaagagaagtactctatgtacctcgtttgcatgacttcagtgaaaatgttggctagttttattactacaagattgaacttgtttcaaacacaacacttagattaaaaagacacaagggtcattactttcccttatggtttactgccgtggattgtcattatagatctatatgaaatcaaactataagacaacctgttccacagaagccccaatcacaatcggtcaagggcttgaacatcaggggctagaaggaattcatgaaattttctcaactcctacacaaaggacctttggctgtacactcttgatttagagacttcccatattctagactggccctacattcttccagtctatagtagaaactgagtcatttcaggctgctgttgtgacttgatatgccaaagctttaaagaaatagccatccaaaatatttaaagcaaaatttaaatggctagacgcttaacattttttttaaagtacaaaaagataaagtagaaaagaacacatcataagtatatacaggtcaataacccttcacaaattgagtgcacccatgtaagtgtcacccagattatgaatagtaatgacatcatggaagccaccccatccatattggctagatttttatggaaatcttaaacttacatagaaattagcacaagactattattttatttagcactcaaagcattcttgatgaaagctttgtaaattctacttcattttagtagaataacttcaataaatcttaatatgtaccacaaaggatataaaaatagatgggataaatcattcattttatttttaaaaataaaataactgattttagggctcaactcagtctggcatttaatctacaagggacttgataataaaatccatggcttaaagcttgtgtactacaatttctaggagtatggccccattagtaaactgcattcatgctaatgtgcttgcttggggcgataatcattagcgttcctagttccagttcttgccagggaaagtacaccaggagtgggtgatgtagtattgtaattatacaattagccttgtcaaggcagggagcattgggaatagtaggatcttgaaacctgaaatgtggctagctgatagatgactgtcattaagctaatcttttgttcactttgtgattgaggtggagactgagcttaggaaaaggcttcttcatgaaggataaaatccttgaccgagagccactcttcttcatgtgctcatcaccactcagctcaccctccctttccataactacacatatattttgttcatattttaccttagccaaataaaacatcatgaaccgttgccaaaaagctctttttaatcaatcaaatttagataatagaaagtgaaattacgtagaaatagtgtttagcctaatacttttaatcatcacaataatagctatcaacattctacatcccttttcacacatacatatttcactgggtattgtagaattgtggctacatagaatgactctatattcaaaatataaattattcttactagtatattgatgtttaaggtgtgtaaaaataatacatatgcatacatatatatttatgtgtatatgcatgtgtacacatatacacacatatagtatatattttgttttatcacatgatactaataagaattaccctaaatttttaaactttcttatagaagaatagattggcataaagccttaactgcttgctctcattcactttcagcctgtattcattattaacctaagtttcctcccttgtggctcaatgccctttggggtttattaggctttcttctgtaaccagagtgatctgctaagccactttcttatggttaaatgagggtgtacaagtaggaatttagatgttcccactaggtaagtattagaggatataatactacctgtttggtgttgcaccccttctaggctacataactacacagacccttttcttcatagccaccattatactatattttttgtacaaatccatagaggataccctttcaaggaagactgacaaattgctaatgctagaatcaagcttagtgtccagaatattgtatgcccattttagcgtgcaaaacacaaacgttcagaagatgttttaaaaataagtcattattacaaatactgatcgtgacaaggcttgagtgcatttagaaacaaataagtaggaggtggatgcggttgtaaagggatgggatgaggccatgaaatagctctatatcttgattgtggtggctatatgaatctacacacgtgataaaacttcatagaactacacacgcacatacacacacaaatttgtgtaaaaccagtgaatctgaaaaagttatgcagattttattaatgtcagtttcctgactgtaatactgcacttatagttatacaagatgttattattggggaaaatggatgaaggacaaatgaaatctctctttaaatttttggaaacttcctgtgaatctacaattatttcaaaataaaaagctgtatttttaaagagctatctggagaaaaaaaattggttgtgatcaattgtggaagtaagttaatctgtgtttcatcttcagtcccactgtagtttttctgtttccaagcaaatcacttgacattctcattctttgtttctcctatttccagaaaaaggcaaatcttatctccagattactataaacatcttgaaatctgtgggaaaaataaaatcgcatgcacacacctgaaagatcataaatatatatcacaacttcctgagagcactattgttaacacccgtctacctctacagttttagaaacaaaagccataggggagcaataaactagatatgccagtcctcctactttgattttgcatttgagaaaatcactgtgctcctaaaatctgctacaataccaagcctcaaaaagttatgactaacagatgaaattgtgtgagcactttacacacatgaaataaaatttaatccatttggattggggtagctttcacttttctgttaaaaaaaaaaagtaccgtaaaagtactagctgaagcataaattcacagtaaagaaattaagttctttactttctggatgtgaatggcagctgaataaaaaccctttgccatttatagaaaggagtaacttacaagctgaattagagttgctcagcatgccaaacaaagccacaggcaaagcaaagcaaaagggaagcttgctattttataggttagacaagaaaaagcctaaatgactcctctaagtgagaaaccttcatatttcatgcaaactccaggaaataattaaggcttcagtgggattctgggacctgtgctctataaaccgcctcaataaacttcattttcatctggtagtatagagattctctcttaccccttactaccctttaaatattgtcctcctttgaggcaatgaaaatttggcgcataaataaaaagcataaaattgtttcagggagagggtgaacatgattcaaattcaaccaggtgctttatcaccgatttgggaggttgcaatgttattagacaaactgatagaaagatcgagagggaaaactattggtggaaagggaagattaaaaaaaaaaaaaccttgggagataaactaaaaacacaaaaagtatttcaaagcaaaagtaagctagccaattcaaataaaattctatagagaaaaaattcataagctcatttaaaaaattatcacaagaggtatacgacctcatattttagaccaactctccatcacactgtagtagttatagaacctaaattacaaacaaagcgtccacaagtgttgcagtcagggcttggggatggtgctggatgccagttaatctgaactgggatatcagggtggcagagcagttatggatccaggtcttggctctgacaccaagaaccgtgaccttacctggactctgtcacctgcttatgtttccgtttccccatctccaacacagcacattagatgatcttaaagctggtttctgtgaggatctagagaatccttagggttccatgaagccctgtctacacccttctgctgctgcagttaggttcggttatatttgtttcgattttaaactaagatttcacatgaaacaaattcatgcctcaagaaaatttaaaatcactgaactagaccttctggggctccttcctgcaccaacatttcaatagactctgctaatcatttttaaagattcaccagttccacaaaagaaaattttcttttgggttcttttgggctgggttctctctgcgtcattttttaattgtttttctttccttgtgtagaaacagcagcaaaatgtattattaaaatatcaattgacgttttgtgcttgctacttctgaataaataggaaagttttcgtgtttctaatctgggctccctatgtggaaagggtttttgtactgcaagatgtaaaattgcaattttgaagcaccagcacccagaaaataagtctcacttaggttttgttgtctgagaaattgacttatttctagcaatggaggtgggaacatagaaaaggcagaactcaaccacctagaaaacaaaaggctagtttctttaagactgaaagggaaaggtagaatcactggtggcagttctagagggggctggtagtgggattgggtagggagacctatgttcctacggtcacactgcacccacaaaagtgctcggcttctcaagggatggtgaatgcatggatatccaggccctggaggactgagtagcatgagtcaagggtatataggactatgccctagccacgttgatcgggtacaagagttatgtggcaaagagcctcatcaccctagtcaccccagtctagttcagctgatagaaagtctatacctctgacacgtaagtgagcccaggcaaaatcccagagtcacccagcagaccaccagcagatttcagattcctgagcaataaacacttatgtgtcaaataaaatagagaggaagacaattatttggaagctagataattgtgcatgcctgactgagagactggagggttctgctgtgatgggagtgaaccagcagtacctttatgagccaacgacaaaattcacaaaaatggaatccctgctcctgtttgctcagcactttgtgtgcctcttcaggttcttcagtatctctagaaagaaccctgtcgggacttccttatacatgataaagtggaacttcaagccaattctaataggtgctcaccaagccagaataatttttccccagctttattggggtatgattgacaaataaaaattgtatgcatttaaaatgtacaaccagatgttttgatacatgtatacattgtgaaatgctgaccaccattaagctaataaacgtatccttcacctcaccctagtccccatttttgtgtatgtgtatagtaagaacattgagatttactctcttagcaattttcaaatatacaacacatcattgttagcaatagtcacccttctgtaccttaagtctgtacatttattcatcatataactgcaagtttgatcacagctcttttcttctaacccaaagcccctgatagccaccactctactctctgatactatagaataattctaatttagaaaaaaaaatgtactcttccttaaatctgatatatctgaccatacttatttctgattaacatgaggaaagaggaaatgacgaggaaaatttgtctggagaagacttgtctttcagcttctggctttcctgggtctccagcttgccagttgcttattttgggactcatcagcctccataatctcatgagctcattccttagaatatatatatatatatatataaatatatagatatctatctctatatatgaatatatctatatatgaatatacttaggaatatataggtatatatattctaagcttatttcttagaataagtatatatataggaatatatatatatatatatatatatacacacacacacatgcatttcattggttctgtttctctttacaaagcaatacacttaatatgatttctaaattaatcaattaattgttcctggttagatcatggctgtagataattttcctttgggattcaattctcaaatctctaattatgacatgtcctaagaaatacaccgagacaccgcaagaattccattattaggttccccccgaccaccttttttgttgggggacagggtctcgctctgtcgcccaggctggagtgcagtggtgcaatcacacagctcactgcaatctgcgcctcaccggctccagtgatcctcccacttcaggctggctttttaattaaaaaaaattaaacactgtatctccatgaaataatcaatgacttgtccatatttctgagtttagttcttcttccttagactagtatgcagtgtgaccctggtagagtcactgaagctatttactgtgaataaaatcttaccatcaaattagattcatgccgctgacatacacaaaaggtctgatgacaattaatcacactatatagtgtattcaaatttaaatgatcacagtaaaaatgataaataataagctatcatcttttttcttccaaaatgtggttatataattacaataaatttattttgattttaagggtgtattgtcattaaagggagtttagctatgccactaatactgtgacttgtaattttaatatttatcttttatcgtgcctttataaaatataaaaatttttctgtgtccaaatatacccaaggaatccattcaaacaactggtattcacaaacttccaaacagtattaaatgtctctattacatgactgaatatattaataagtgccaattttatgttttctatgatgttagtagggttatttctcttctctagactattattttttaaatttctataatttgcatatacatgcatatgactgaggccatatctacacatagcatctggtcttgaccagaattaaactagaaatgtcagcacccagttcaagcatttaaatgacatcagacattcatatttgaatttaattttaattcatgcagaaggaaatggctggattgaataagaaattaagtttcttgtcacccatagttactactggagaaaaatggaaaagaggaaagaaggtaaatgaaggctctgctcgtgtaacatattcaagccttaaggaagctttcacatctgtcacagaagaggaatccatttcttaacacaagaatctgctctctttccaatcattgtgaaccacgtttttaatgtgaaagaggttcttctctcccatttgccccttccactaactcccactctgccaccaatagtaaagaaaagtaaagcgcacagatacctgtccctgggccacaaaaataatcaggttttattagctccaattagaaatatgacatggatattcaaggtaatttggtgataacgtagagttggaaatgaaaaaaaaaaattgagaaagtctattaaactggtcccaaattacactaaactttgaaacagtactaattttctctgaaaatataaatggtagaatcagtctgtttgcaaaaatacactgaaaaattctttatttataggtagaatctaaattattttggctagacacactaattcttaaaaatattgaataaattttttaaaattttttttggaagaagtttaagttgagtatacaacttaatcaggtaatctgtgaatcatcttgaagggtacgatggaccactgacatatttttagaatcaccctttcaactagtttcaatggcaaaacaccaaaaaaaaataaagaaagcccatggaaccttacatctgagtttaacctcaaatcaattagggcaccggaaaaaaaaatctgacaaggtaaataggccagcaaagctctgaggaaggttttaggattttgaaaggtaatagtggcctatactcagtattcaggctttacaaatacagcaccagtgatatatgtatcataaaaaagctacaaaagatagtttccttagagcaaagtcagaaactaaaatttttgcaggaatagtaagtcaaacaaatattaaccttttctagcttgagattgaaaagttagaattttttctttgctcctcttcagtaatagattgtcttaagaatttcccctgagctcagttctttgccagttcactggtggtttcacatgttttcaatattacaaataatacatttttttttttttgagatggagtctcactctgtcacccagactggagtgcagtggcatgatctcggctcactgcaacctccacctcccatgttcaagcgattctcctacctcgacctcctgagtagctgggattgcaggcacccaccaccacgcccggctaatttttgtatttttagtagagacggggtttcaccgtgttggccaggctggtctcgaacttccgacctcacgtgattcacccaccttggcctcccaaaatgctgagattataggcatgagccaccacgcccagcccaataatacaatttttaacataaaaattagaagccaagttaagaccacaagcatcctaggaacctgtgtaggaaagcatatgtggatgagagactcaggttccttgttccaaaggcaaaaaatattgaatattaaacatgagattccctgctctcctcagcctggtatggtctatgaacaaatgctaaatactttgtatctgaaattttaaaagtcatatttttaaatgacggtattttttacgtgtcataattagggtattctaactataaacatatgtctgtccttattgtagtgatttcagatattatctaaaataacacatagtttacattcttactttatgccaaacagtaagcttagcacattacaaatatcatcttatccttaaaattaccctacaaaataggtagcactgttatcccccttttcaagagcacagagagattaactaacttattaaagttcgcacagttagtaagtgatagagatgagatttgaacccagaatctgtaggctaaacacaaactagtaccagactacacattttaaattcttattttacagtgtcccttgtaattagtatctatgacccatagtagctcccagaattgttttgagtttgctttatttcaatagttaaaacattgcttgaagaagttcctccacaaatattcatctagcactttctcctgaaaatgcggcatagatgttaatgataaaacatgttctcatgaagacaataacaagtattattcatgacagtttttctcttatggaattaatgatgagacacaactacagataaaatggtatgctccccttcagtcctctaattccggagtgccgttgaagaagagcaggtcactttaagctgcagtgatgtgtgtgtgtatggagaggaaagaatgcagagtggtttggagacctggctcaggagtcagagttatctggcatagcactcaggcatttcaatatatttgtgtgtccttttggacttaacttcccattttcctcatctataaactggggaaataatgagccatatctgctagagtttcagtaaagatttaacaacacaatgtacgtaaagcaccaaggatatgccaggtgtgtaatacacacttgatctacatggactcattcattgtcaatgttactccaatgcagctctggacccagagccacacattcccacccacacagcacacgcagtgctggagaggaagtgggcctaggagggcctgcaggtacaggcagctgtagagctgctagaagctggggtgatgctcgccccactttcctgtagacaccacaggtactgtctgcctgttgtcacacagttcatatgcttgcttgtgatggaaccttggtcccaggatctgtgctgttttccactttgttacactgtctaaggtggcttttaactggaacccaagtgcaaataaaggttggtattcggctcctgactttgtgtagagaaaacagtccttttggtcactcccagaccacagcaatcagtcatgattttgttgaataatcaaagctgaacccatacatggtagggtcagttaaggatgtttgctttgggcaacagcctactttttgtctcatattaaattaatacctgagttaaacaaaaacagaaacacctcacatacactattcagaatctgctaaattgtcttttaaaaactgcttgcccaacttattagcaacaacgataaaagacgaaattttcatgatttcctagtatcctggattcataaagcatcaagaaggcatatggtattatatgagcatgaaataataacatggactgctctgcttaccaaattcagtcaagtccaaaggcagcacatgcagagggagcatgactgcctataagaaacaaacaattttggtgtttaagtctgtgttttctttttttttttgagacggagtttcgctcttgttgcccaggctggagtgcaatggcacgatctcggctcaccgcaacctctacctcccaggttcaagcgattctcctgcctcagcctccctagtagcttggatcacaggcatgtgcccctatgcccggctaattttgtatttttagtagaggcggggtttctccatgttggtcaggctggtctcgaactcctgacctcaggtgatccatccgcctcggcctcccaaagtgctgggattacaggcatgagccactacgcccagcctaagtttgtgttttctatcacataaaatgtcgtagaatgatgaactaatggaagaatggaaagaaaacttacaatacaaatgaaaatattttacaaaatacttccttataaggaagcccatcagactaacagtggacctctcagcagaaaccctaaaagccagaagagattcaggaccaacattcaacattcttaaagaagagaaattccaaccaagtatttcatatccagggaaactaagcttcataagcaaaggagaaataagatctttttcagacaagcaaatgttgaagtaatttgtaaccatcagacctgccttacaagagctcctgaaggaggcactaaatgtggaaaagaaagaccattaccagtcacagaaacacactgaagtacacagatcagtgacactataaagcaaccacacaaacaagtctgcatgataaccagctaacatcacgatgacaggatcaaatccacacatttcaatactaaatcttgaacgtaaatgggctaaatgccccaattaaaggcacagagtggcaagctggataacgagacccaactacatgcaatgacaacaataggctaaaataaaaagatagagaaaaatctgccaagcaaatggaaaacagaaaaaaataggggttgcaattctaatttcagaaaaaatagactataaaccaaaaaagatcaaaaaagacaaaaaggggcattacataatggtaaagtgttcaattcaacaagaagacctaactatcctaaatatatatgtgtgcaacacaggagcacttagattcataaagcaagtgcttagagacattcaaagatatttagactcccacacaataatagcgggaaacttcaataccccactgacattatcagacaaatcattgagacaaaaaacttaacaaaggtcttcaggacctaaattcagcactagattaaatggatctgatagaaatctacagaagtctccaccaaaaacaatagaatatactttcttctttttttaagaaaaataaaattattttttattttttaaactttttgtgggtacataggtgtatatacttacagggtacagaatatacatccacctcattgccacatggtacatactctaaaatcaaccacataattgcacataaatactcctcagcaaacgcaaaggaactgaaaccataacaaacactctctcagatcacagtgcaataaaaatgaaattcaggaccaagaaagtattgacattcttcacagaactaaagaaaactattttaaaattcatatggaaccaaaaaagagcctgaatagccaaagcaattctaagcaaaaagaacaaggctggaggcaccatgttactcaacttcaagctatactacagggctatggtatccaacacagcatggtactggtacaaaaacagacacataaaccaatggaatagaagaaagaacccagaaataaggctgcataccttcaactatctgatctttgacaaacctgacaaaaaacaagcaatggggaaaagatttcctatttaataaatggggctgtaataacaactgcctagccatatggagaagattgaaactggaccccttccttacaccatatacaaaaatcaactccagataacttaaagattgcattgtaaaacccaaaactataaaaaccatggaagacaacgtagacaataccattcaggacataggcatggacaaagatttcatgatgaagataccaaaaggaattgcaagaaaaacaaaaattgacaagtggggtctaattaaatcaaagagcttcttcactgcaaaagaaactatccacagagtgaaaagataacttacagaaagggagaaaatttttgcaaactatgcattcaacaaagatctaatatctagcatctatatggaacttaaacaaatagacaagaaaaaaacagaaccccattaaaaagtgggcaaaggacatgaacagacacttttcaaaagaagtcgtacacgcaaccagcaagcatatgaaaaaaagctcaacatcactgatcattagagaaatgcaaatcaaaaccacaaaaagataccatttcacaccagtcagaatgctggtgaggttgtgatgaaaaaaggaacacttatacattgttgttccttataagtgtataaggaacacttatacatggtgggagcataaattagttcaaccactatggaaagcagtctagcaattcctcaaggagctaaaaacaaaagtaccattcaacccagcaatcaccttcctgggtatatacccacaggaatataaataactctattataaagacacatgcacacgtatgttcattgcaacagtatttccaatagcaaaaacacagaatcaacctaaatgcccatcaatggtagactggataaataaaatgtggtacatatataccttggaataccatgcagccataaaatggacaagatcatatcctttgcaggaacatggatggagctggaggccattatccttagcaaactaacaaggaacagaaaaccaaataccacttgttagcacttatacaggggagctaaatgatgagaatgcatggatacacggaaacacacactagggcctaccttagggtgaaaggtggctgaaaacaatgcaaatttattctcttacagctctgtaggttggaagtccataatcagtttcaccaggctataaaatcaaggaacagggaggcctgtatttcttctggagattctaagagagtctgtttccttatcatttccagcttctagaggtgcctacattcctcaatgcatggtcccttcctccatcttcaaggtgcactgctcagctctgatctgttcttatgtcttctgtctcctgctctgatccttctgcctcccacttacaaagacccctgtgactacaatgggccgatctgggtaatccaggataatctcatctcaagatccttaatttaattacatctgcaaagtcccttttaacatgtaaagcaacattcacagattctggggatagaatgtattagcatctttgagggtaagatattattcaacctaccacaggtagataccatttattacattctttttgcacatgagaaaaaaatatagtaattattaataccactatatacaatgagaaacaagaattcagaggctaaacaacacaaactcacaaaactgaaaagtaggcaccaacatataaacatagtgtttctaaccctaagtctgtttccactacacaattctgctcccgaagtagaaaaaaaaaataaaggaaggactccctgcttaagggtagattttgttattttcttggattaaaaataattactatatatttattgaatggctaactacatgtaagatccaattttagattccgggaataaatgagaatcagatacagtcagtctcaaggtaatccttcatctttccatatatttaaatacctataattcctaaatgtatatatacagtactgaccaaatttaactacctcattaacattcccagtttcatgttctataaacttttccaatgtgccaagtctgaaactgaactcttgattttttcctacaaatgttcatcccccatccttcaccacctcaggaaatgatctcaccgtactcccctccctcaccactcatagctaatcaataattgaataccttaaattttgccccccaaatatatcttaattccatctacttctccttattggcattgcctccagactcctaattagtatcttcattttcattcttatatcgcctcaatctaacctccgtacatagactgcatgatctatttagaatataaatgagattatgtcaattgcatgttaaaatacttcagtaactacctacagcacttaaaataaaattcaaatttttcttgctatactgggtaaccatataatatgttctgtttaggacttttctgtgcctgttgtcctggcataactagtaatacagtctcctttcatgcctaaaattattccacttggatgataagtctcttgatcaccacatctgtagagccctgtgtgatctttcttttgcctaaatattattctcatagctgaagacttctccctcaggactcagtgtcttctcttaagtctccctagtagttggctttctttaaaatctgaaccactgtattcaatcctatagttaattctttcatttgttgaatgtctgttcaatccattagggtgcacagagagaaccaggctcgtatctgcattgtttactcatacatacctcagtcaacatcgtatctgaaacaagataaaagcccaccaatatctgctgaagattaatgactaaataagcttaccatatagacagagagatagtaaaagtatagtatgacatttacgtaatatgaatgtgttcaagatatcaactaccaaaattaatacaaaaaagaaaataattatttctgcctccagagaagggttgactaggaaagactccataaatggaggatgcccaaacaggcttgatggatgaataagatcatgcagcatgaaccaagaagccaagagaagacttctaagcttaggggatggcatttgcaaaggcaaaaaggtataaaactaattattcaggaaactcaaagtagtttctcttattagagtgtacaatgtcatataaatgatatattaataacacaaaccttaaggacaaaacctaaattgtagagacacagcagaaaatacagacagcactaacaaatttgaagcttagctttttttttttttttttttttttttttttgagatggagtttccctcttgctgcccaggctgcagtgcagtggtgtgatctcggctcaccacaacctcagcctcccaggtacaagcaattcttctgcctcagcctccttagtagctgggattacaggcatgtgccaccatgcccagctaattttgtatttttagtagagatggggtttctccatgttggtcaggctggtctcaaactcctgacctcaggtgacccacctgcctcggccccccaaagtgctgggattacaggtgtgagccatggcacctggcctgaagcttagctttgttttcatttatagtcctagaatgatttgataagttctattgcatatttaactcaccttataaattatagaagttcttagataaatccatttcggaagtgctatatttcaaacttcattgccataaagaatcctcacagttgcagttattacataacagttacaaaattataatacacagtccataaggaaactctactgcgagttatggtgtatagaactaagctgagcttttctgtcaagtaaaatttttggtttaaattttaataattatgtcaaatttcttttttctataatgtgcttttattcattattacattatttaaaaaaggccaaaaccactatgttattattttggcatttatattgtacaaacgtatagataaaaatatctatggaatcttaaaagacttcgggtcatattttgatgtaactaagagttgacataattaaaactcatcattgacctatttctctagaaatagaaaattatcaagatagatatctggtatagataatcatagatatttgttttgaacatttagaatgtatactagaagttgcacactagcagactgcatgataagaatgctttgtttagactccagtgtttcaaaaattgacttaagatttaaatttgggaaatcacaaaaaatccagaattctggccactcttaaaaaaattaaaagatcagctaactctagtaatattccccaattcacagtcccctagaaactagtaaatgctctctgtaaccacagacccacctcccctatcaccccagaacactgcccttatatatgtgacatgcctaagcctttgtgtaagactaaaactctcaaccattaaaaaccaattgaagatcatcaaaaagactaagaatatatttagactttgctcatttgtaatagtgagagttaaacataaaggctatttttaaaaatcatctaaacatgaacaaattcagacattcaaccctttctttcttggattttattagttaactagactataccgaaacaaataagccaaacaaatccagtataacaattcctccccctgactaccaagctatttgttttggcacctagtcaattcaataaaaatgatacaacacaataatctaaaaatatatatcacgcatttaatctgtagtttacctaaaagtacctctctgttatgtatctttcattgcagcaaatatactttattttatttaaatgggaagacaacatattttcaatatgaaaactgttccaggttaggaaatattaacctaaaaatgtaatttccatagaaattgacaggcacttaccttagctatctggacacaccagttaagcagcagttgtgatccaatgttatccttgtgctcgtggacatactccaacaggcagccatggggcataagttgagtaaccagctggatggttgggctcagacacacacccagcaaccggactaggtgtggatgatccatacttgccatgatcagagcttcctgtaagaaaaaaatgcaataccatgatttcaactcaaattttcttagatttagagttacttggattgtactaatggtgctgatgatttttaaaaatgtactcttactcaatggaatcaatcaaaatgaaaagacataatttcagttattctatctttaaagtgatttcattcaataaaattaaataaacaacaaagtctctacatgcattaacatggaagctgttatacaataactgcctacacaattaatagcagtattttctcctttgtaatatgagcaatatgagattttacttattgccaagtaagtcaaaatgaattccagcttatattatggatttttaacctttgacctttgctctggtaaaataatgtatacaaatttagttagttgcaggtagagtaaggtgagctgaactttgaagtcacccattattggtgtagagttggacagcttacaacggtgtcatgtataaatcgtaaatatggaaatgtagataattacaagtaatatgtctattgtcaatttatataaaataataaacattttaataagatattttgtttcataattttacctttcctcaaatttatttcattttcaaaattataagtgatgtcttattcatagattcataaaatttgagagctgagactataaaaatttgactactccaacttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatgttttgtatttttagtagagacggggtttcaccgttttagccgggatggtctctatctcctgaccttgtgatccgcccgcctcggcctcccaaagtgtactccaacttttatatttcataaaatgagaaaactgagttataattttgcatcagaatcataaaggcaccactgcttaatggggataaaagtggacatatgatggttatttagtgcataccagttagcttctaataaaaagttattataagactcttgattgtaatttgaaatagacataaccataaaataaatgtttatgtactttgttacggcttgatatgtgcttttatattatgaaagccaataaaatattgttcatctcctacgaaaacaatagtaaatttttgcttttgaaaagctatgtaatatcacctacgtagtattcttgtcaataatatctgaatctaatcatgaggaaaaaatcagacaaatccatattgtaggacattctgcaaagaaactggcctgtacttatttaaaatgtcaatattaggagaaacgtaaaagaagtgtatgatgttcaaactaacatttattacagaaatagagcaatgttgcatctttggctcttggataaaaaaatatataaaacattcttgggataattgaggaaatctaaatagggactatatatcatgtactattatatcaatgttaaatatttgagagtggtaatggtattgcagctatgtaaagtagtattctttgatcttagaagatcctgaagtctttatagatgaactatcttgtgtctgccatttactttcaaatagtttactcacacagggagggagagagatatataatatatgtatacgtatctatgtttttgatgtgtctatacatatatatacacacaaatgcacatacacatagagggtgtaatatgtatatggcaatggattatcagttggtttttctatatgaaggtacagtgttcattgtattactcttgaacattttctataactttgaaacatttcaaaataaaaaattaaggacacaaattatattgagtttccatttaacatggtatggcagattgaattcacaaattacttccctttcatttcaacttcattatactgacaaaaaaagagttaattttaaaagacagacaccaacaatcacagaaaggaggcaataaagatagaatagtaaaagtaggaagtggcttatcagtgttagccaacttggtaaacataagcaatctgaagcctaatttaatggggggaaactgagaagcaacccaataatgtataacaccaaaggctgaggagtagtagtattacaaacctccctaaacagagcaagaagaactgttttcagcgggaatgcttcagagtacatttaggaaacacttagactacacatctccttcttccctttacctctaggaaatcttaaaccaaaagaactgtggactgtggatatcaggcaaaatggaaagagaagtactctggggaaaatagaagtattatgtaaatttacatatgataaaaatatggacgatttcttccattccatctcccaaatagagctgtgacttcaaaattctcaaagttttgtttcaacctagaattttacacctagcagcatttcaaccaagtgaatgcatacaacagacatgttcagacatgccaaatcttgatacatgtaccttccatgcttcctttctttgtaaacgtgctcataaaaaagggagggggtgttagaagagtacataaaatcaaggaaacaaacatcaagcatgagatatggaaatacaaaaaatacagtgaataattttctagaataaaagctatacaacaaacggaaatagcagccagcccaaactggaacaggacaaatagctctgggaaaggtgacccaagaagatggaattgatagaatgcctgatgaacttaaaatacattaagaaagtatttatttttctagtgggagttgaaggtcaaattagtgatagatacatagaaaactaagctaaagtaaaaaagaagaaattaacctgagataaaacacaaagatatgcacaagaaagactcagaaaggtgaggagctaagaggggagtggatgatgagagattgctcaataggtacaatgtatcttgagtgatggatacactaaaagtcttaacttccccattaggcaatctatgtatgtaacaaaattatacttgtactccataaattaatacaaataattaaacagaaaatcatacttacgatacagcacaactgggaatagttacataatcataatagtttaaacatgaaatactgatataatcagaaatcatatagctgtgggaagatgggacagagtatgcccttctgaaaggtggtgatgggaatggagtgaaaggtacataaccattgctggttgcaaaaagttagcatatgatacataggctaaaaagaaaaaattaagacttcacagtataagcatattatttaaatgtatggagttaagtaacagaagaaatttccaaagatttgaaagtgattgatttgggcagtggaaaatgggggcagggaagggacagcagggtagctagcatctttcatcattagtcttgtcaaagtatttcacttttttataattaccttaaagctacttgggaggacattatcccctttaaccgtccctactattttaccgctgttgagttcagctgtgccttacaagagttattcacaaatatgcagtgtttgatggggtatgtgggcttcccagatccagccaagggtttatcgtgaggtttaacattttattttttcagtaaggaaaagggggcagcatgggaacacgcctggagaaaggagtgatagaagaccaaacaaaagaagtaagctggtaaaatgctgtcactctccctcaaaagactttttgtttctgaggtttggtggcaaaaactgaaatcattgtttttcacatggcttccaagtaaaaaagatacttcaattatctcttccctagctgccccagggaacaagaagagtcacagaacagagaccagtttctatgctttcttgctgagcccaccaggactgcaacaagatgatgactggaagttccgggtgcactttgaggcgtcacgcctagcaaggacttcagcatcctcacgtggtaccagtcagcagtaacaggagtaggtcctctccaatggctcagagagaagagaattcaacatagggaccagaactggtaggaaagatcactgtagaaaccacagaagcatccttacatggtatcagtcagcggtaacaggagtgggacctctccaatggctcagagagaagagaattcaacatggggatcagaactggtaagaacgatcactgtacagggagactgcagctggaaggccagattataggtaaataggagacacccaacaagtttccaaaatatctgcggagactgcttggggggccagggttttgcataattagcagagccagaaatctacgttattactattcatgtggcctcgtctggattcacgaggtgaaaacatttgctttcacttcttgtgtatctcagtaaacatttgaaataaagcaaagcaatgtagttataaagagagtatagatgaaaatgttagccaacttaaatgatctattattacctattatttaatctagtattaagtgtattcacagtgtaaaccagagggttccttcattgaattataacatgcacatgtaaaaatatacacataccgacaaatcagcaaaacatctaattagattaaatcattaatttaattatatatttaattgtgtattaagttagatacttaaatattagatatcagattaaagtcaatttatacttatgttatttcttttttggtggctctgaattttttgtgtatatgaaagtcacctaggtttacagttacaagtgtggccccactcccagatactcaggtttagaagaagatcttaggagtctccattcgtagcaagtacccttgttaaaggaacttaggaaatataaaatgttgagaacctctagcacatcttgatgtctccatcgaatgtgtgcttctataatccattgcaaaagcaataacatctaataattatttgatccttattataatcccatgaagcagttcaaactcaaaattaattctcagctgcaaaatgaggaaaccaaaactcaatgagattaccggcccaggtcatgtgacttgttagtagcaggatcagtaaacactcaggatttttattctgactgtactgttacgacagtagaaatatcatattttttacttcagtttcatcagcatattacagtgtcaatctttatgtttttagcaagacagccccaagcacctcacattagccctacctgcatgaattgggtcaaattatgctttgcttcctgagaaggaactaaaatcaaacaatacatttgtgcttacaggtaaactgtcatcactttacaatgttttcagaaaaagtcaaataaaatatttctctctgatttactgagggtagtatttgataaatgttatttattaaggtaaagagaatgacaaaatgtaaagtagaagaaagattttggggttacttttgcatttgaaaagtttacattaagaggtgtaaaaaagtcacacggaagctctctttttaaaaatctgttagtaagtcctggcaaaaaagctgggtttctattaagaaaaattgctcatcacactacaaagagtatttgaaaccaaattgcagagtatttgcgtaatagttctctttttctgaagaaagaaaaacgaacaagacactaattgtagcttgcatttttttttttttttcataaaagaaatagcagatggctggtttggaggataggagagtagataaagaaaagggaatatgaatttatttagactgatgagtgggataaaaaagggaaaaatcccaatattttaatcatagagtgtcggctttcaataaattactctgtgttaaacttaatgtcctctgttagttatctttgtgtgggacctatggaggcaattttggaatctttgctgctgtcactagaaaatgtcgctgaagaccatgggaataaatacaacctgacagggacattatctatttttccagaaaaaaattattctgtcttttttttcctttttgctttacaatttttttttttcttgtaggtaagtttcagagttttctcattgaacagaagggaataatgtaacaggtgctacagtaaaaattctaaaacaaaaatatttttctttataatgaagtctggtgtaaataaggtctttttaaaaaaaccatcaagggactactgaggtatagattaaaaagctctgaagcatgtatgtcaagtctctagccacatattatctatatctctatttcagcctgaagggaagacatttttgtacaataataagtgagcaataccatttttttatattcagctatcgttttgcacaaccaccagatatttatatctttccactttagtttttcatattatttagcggtttcacaaagacaaaagggaagaaacaaccatattgccagtgaaaacttataggctattctgtttttaaaaatgttaacttcagccaaactctgtttcattgtatctatggaccattaatgcaataccctccagctgaaaaccaggaaaatctcattgcatcagagatagggaagattaaaagagagatagaggaaaagaaaagagacaattaatgtagacatataaaactacacatcatgcaaccatcagcagatttgtgagcgcttgaaagaaatgctgcccctaaagatagtgagagtgctagtgatgaagaacacaaagaagataatgacggccacaatgatgaaaaatgaaataaaatcactggtccataataatttttttactaacttgctttgctgcagatggtatgaagataataaaataaacgaaatctgcatctgttccttcatgtctagaataaattataatttatctgggtaaataggtgagcagtaattagagaggctgaattaatatgccttcaatttaaatgtgtccacattgctcagtagccttaccactcccttccaatccttggtatcatttttgtggactccaacaatcagatcaggactcttctaaactttgaagtcagcacttttccatctctattctacatcattcacccattgggtggccatacgttagatttagtcactaacactgccacttcattgaagaccttttgaagaagtctacatcgggaaagaattctactttctgttttccctcttttttcttccactccggattacactgaaattccatctttatgatattttttatcccgttagttttatatttcttcacctaaaaatgtttattgagaacttgctaggtgcctagcactgtgattgaagttgtgtctacaaaataatctccagcctcaggaagctttcattctacctggagaggcaactagtaaacaggaaagccaaataaacataaaacagatgcataagtatttttaaatgagattaagaggtatcacaaaaataaacagagtgttgtgatagataatgaaacggtggtcgcagagctactttagataaggagagccaggaaatgtgtcctgagatcagatttatgaaacaaagtcatatatataaatacttggaaagagcattcaaggaaaagcatgacctaagagtctggcatattttggaaggtctgagaaggctcatgtgcttggaatttagcaagggctctaatggcatgagatgggattgaaaaggtgggtagggaccaagtcatgtagggccttgcagtcataaagggtttaagtcttaaatccttaagaagactggatttattcataaatcttttaatgcctggtttctgttgtacttcatttacctctatcatagcttgatctccaatattaactattacaataaagcacttgccaatatcatataattttctcccctctgatgtttccattttgctgctctttggctgaaggtaaatgcccccatcaccattctcaaactttcaaatgttagagaaaggcacagattcatgagattttgcctaaatctcctgatttgatcctccaaaaattactcttttagttgtttaaaatttatttatttttgtgttttttatgttttattattttgtttttgagacggagtctcactctattgcccaggctagagtgcagtggtgcgattttggctcacttcaagttctgcctctcaggttcaagctattctcctgcctcagcctcctgagtagatgtgattacaggcatccgccaccacacttggctaatttttgcttttttttttttttttttctcagtagagacaaggttttaccatgttggccaggtggtctcaaactcctgacctcaagtgatccacccaccttggccccccaaagtgctaggattacaggcatgagccaccatgccaggcctcttttagtttttaatttcttactgatgctttattacacttactatggcttctatctctgggcagggaaaaaaaaaagctttctacctttcttaatatctactctgtgaaatgtacttttgacaccattttactctgtttcactgaatcattttaccatgatttatctctagtacaacttcaccttcactgtgcttaccaccttcactgtaactacaaggacatatatgtgtcccatcccatattccaaaaataaaagttccttcaattttgccctatctgtacattagggatatttgtcagtccccctttagctatttcttcatgttatcctcctttgtgcctttgagatccggtttttctgccacttttctaaattcttacccctcaaattactctggaaaatgtcatcaaatacctcattttcaccaaagtcaacatgtttctcatctcattacatttccccagcctgcattgttttatctcactgaccatccttcttcaaaatccttctttggctgatattagcactttatcctacctgtcctgatttttcactctctgagtactcttcttcttttttttttttttttttttgagacggagtcttgctctgtcgccaggctggaatgcagtggcacaatctcggctcattgcaacctccgcctcccgtgttcaagcaattctcctgcctcagcctcctgagtagctgggactacacctcttgtcccttcaatgcagaaatactacccgggctttggctgtacctcactttgttttagtctgcagtctcttacctccttacagatttgttctccaacctcctagagatgaaaatattttccaacattaagaaatatgacagagttgtcaaaaacatatggaattgattgcaaagtttttgtggtttgtcatgatttgatttagtttgaagcaatgtaaacagcagggcattttttttctctcgagataaaaaataaaatccattatcttcacgtccaaagtatctgtgcccttccaaacatgagaattatgttatgcccatattccaagttttctcctccactcctataatttcagttgtcatttctgagcagaaactaataagcttatctataatataactatacaaaaccatgttataacatctatcttattttattagaattatcggtgaaatgtctggcatctctgtttttttctctggaagcagtaatgtgagtcagtcatattcattggtttatcaccaaatccttgttgaatatatggcttataagaagaatgcaataccattttatgaataaatgaacaaaatctgtattatatcctcccctcccacacttactccattccaggaatcaacccgtatttcaattgctttctcatctcttaaaatagatactactggatttgtaagataaaagaaaacacggtaaataattttcccatacgagcttgcctgctttactttactattttttttttaatttcagaaacatttcctaattcagttttaagatcttggatttatatttggtatttgcatttctattttttccattccactttgtatctaataatttgccaagtcctattaattgcttatcccagtgtagctcaaatctacatctttctgtgtcttttcattctgactcctacttaaattcaggctcacatcactactgtaaaaataccgctttttttaattaacatattctgtttatgctacaaacatacaaaatatcagtggcattttttgattgacaacatagagtcgtaacattgcacgtactcaataaacacatgttgaattaaattttatattgtgaaaattgcaataaattttagaataaagaagtttagagtatatttccaggtatgacgctaacaatctgtgacattggcctgtatatttttctttgtccctcaagctctattctccaccattttctaccaatactcaccctgccacgtgctcagtgagactgacccaaatggatgatgacaacgggctacgacgctccctggctttcatttgggttcagccagtgcaaagcagtggtacaatactgaatgaagaacagagtgagtttggtacttatcccccaccctcactttcctgcaaccccttagtgagggtcacagctgccgtcaatttgaggtaaccttcccctggtttcttcaagcctagcagtgctgttactcatcttgaagtacttcaacaaaccctgttgctgttacttaatcctgctcctacttttataaagactcttttgctaaactctgttcaattccttcaactttgtatgccatgtgtttcctactgggatccttctaatgtagtcatcttgaacaaggcacttgacaacagttacctgtaaaatcacagatatggtcattgatggcaaatacgtggcttgcatgttaccaacactcccctcctcctacccatgaaagatactgctaaacagtcattgtgtggtaggctgatgatggctctcaaaatattcccacatcttaatcccaggtcatattcatccctgaggtgaatactaccttatttgggaaaaggtctgtgcagatataattaaattaaggattctgagtttaggagatcttccttgattattcaggtaggttctatatccttataaaagagaggcagaaggagattagacacaggcacaaagaggaaaaggcaatgtgaagaaggagacagaaattagagtgatgcccccacaagccaaggaacatctgtagccacccgcagctggaggaggcaaggaatgtatttttccctagagcttctggagggaatgcagccctaccaacatcttgatttcaaatgtctagcccccagaactgtgatataatatatttctgttattgtaagtcaccaaatttcagttaaattgtttcagaagcaccaggtgcggtggctcacacctgtaatcccagcactttgggagtctgaggtgggcagatcacgaggtcaggagatcgagaccatcctggctaacacggtaaaaccctgtctctactaaaagtacaaaaaattagccgggcatggtggcaggagcctgtagtcccagctacccgggaggctgaggcaggacaatggtgtgagcccaggaggcggagcttgcagtgagccgagatggtgtcactgcactccagcctgggtgacagagcgagactccgtctcaaaaaaataaataaataaataaaataatagaaaatattaaaaaaaaatgtttcagaagctacaggaaacaattacaattactgtattctttcctgcctggactggatgaggactcataacactcagtgctagagacactcagtgctttaagcaacaagaactgatttattgggaggtgaaggtgagctgaaatattgttgccttgattttttcacatattttaaaaactgatgttgctaccaaatctttagtttggataagctatagtagtctaatctaaatgatgcagatacttttaattcatttggtaagtaacatatatatgtaattgctaaatgatacagtacaagaaaagagcttatcacagtgcctagtagatacttaaaatgttagctattattatttttattaaaccaattatatctaaagggaataaaatcgttaagcaataaggcatgactgaatctggaaaaaagctgcagctgcagggtgagtggtcactttgatcttttaaagtctggaggggacattaagcatgcaagacaggaaaactgacagaaaacagttttgctgtcagcactttatcagctattcttttcctagttaaccccagggagagctagcagtatctcttcccatctcaacatataaccatgaagagttaaaagatggctaaagtagattttggcattataagagaacttcaaagactacataaatttgttctttaacaaaaagtaatcacaataacactaataataatcaataacaatatggaacaagtagataatagagatcaggatactaatgaattcttgtagttttaggcataggcagtttacagtttacttattaatcttaccaatgctacataaagagaaacacaaaagtgtctgcaaacagcatttcagaattgatgtgaaaaattcttagcaagctccaacatggagtttctcatgaagaggatactgtaatgtgctataaagaaggaaaacacaaacatactagaactagaataaatcattccaggctgtagatactaccactagggagaaagaaataattattaacattcatttttctttctccatatgaaaatgattttctaaagagattattagacctgtcacttggttcacttgtagctttatttagttcacctgtagttttctaattcttaacaaccatactgtggtccctctgaagtcacatattaaagaattctaccagagcttaataatgactgctacttcttgttgaattatgtcagcacaatgctattgatttacacctgaactcactgagttctcaggacaatcttgtccagtataaaatatattatgttaatttactgatagcaagacacatttaaaagggataaaccatttgccatgattctaaattccttaagtagccaagctgagatttgaatccagttcacattgcatccatagcctagtctctttctgccatgttttctctgcaggagctattcatgtcagttaggtaactaggtagatctagcagattttgtggtgattatcctagtgtccataggcatgatcaatataagattaactagttaatgaaatatttacaaagtgacattctaacaggcattaactaaccttttttggtatagatcaaatgagcccaacttatcctcaaccacttaatcttccaataataaaatgctaaatagtcttttcaggaggaactaagactactcatgtctttattctcagttgtgaatgggagaatgtgaatctaaaagtgctgaatcaatatttttgaaacttaaatttgacttcaatagaacagactttagtaaatttgttaataacttttatttaatcacttagagctttactgtttactatttagtataacttgggaaagtagtatgcatttgttttcctggacactgcatcttgtttaaagggagatatctactctgcttttaatctgtaagaataatctcagttaattaatgacattcatattaaaggaacttaataacaagcaactcgacaaaattagaaaaatgctacctttatacttaataaactatatcaaacatacctgtggtaaaggagcaggcaggactgtgtcattctgactcttccaagataaaacagtgagtgactttaattaagttttccatttttctcttatagcttcatgcttatgtaggataatttatatgtagaaatcatttgtctgtcattcacatatttttatctcctctacttttataatgaacttattaccatcatatattaaatttgaaactgtgattaatatgcaagtttttatattaaatattaatgctggtgttattttaatattctacattgatcctgatgtcaaggggatccagttggaggtaacagcaatgagtacaaatctgcgttaatgttatttattattttatatttttaatatagtagcagtaaataatattaccacccactcaggcaaaaggggttataataaaccctgaaagaaaatatatggtgtcacaaaagactcttactgctagtgcctttgtttcagggggctgagtcaaaggaacatgtggctttttgtctagacgcacactgtgagagggtaagcaagtggcagtgggaaaaggagtacctcataaagaatctctgcaagagggcatccaattctggtccagtacttgaaaacagccactgaaaattaaccaatactttagaaatggcatggtatcttgggtttccataatgcctgccctaggaaaggtcaattcatggccattatatttatcatcagcaacttcaaacagtagtgcagggtgctatcatagttattttgttgtatgttaccttattaataactgtattgactttgggaatgtttgcaggaaataactagccatctttcattcattaatttattaactcatccccgatatggattgaggacttctctatacattcacaagggtacaattattaaaaagacatatatcctactcttaaatagccaatatcctaggataagtctttaaaatttagtataaaaattataaacattagtaattataattataaatgtatgatataaatttcctatgataactctttcaagagagaaattaccttctaacttaaaaaactgaatgcaagtaaacaaaaagctgtgttcagaagaaaaatatgaatatggtatttatgtgtgggaagaatgttaaaagcaaaaagataaataacactggtagggttgtaccatgaggagaaaggggtgtggatgatacaaattccttccagagtcttccttctgttttactagttgtgtgacataaagcaagttattcactctgtcaaaacctcaatctgaggttactcagatatataatgggaactataatgcctatcttctgaaaagaacaatttcaggtaatatatgtgaaagagtctagcacagtgttggtatataacagttgtccaatataattagtttcccttgcttctaaaattaagaaaatggaaaagtgtggcatgcatggggaatacaaatagatcagcttcagtgaagcatatggtacatgacagaacacagtaagaaacaagatggaaaaggcaggttggtactagggcttggaggagtttgaatggaaggctgacatttggattttattgtaagcaaaatggggatttcctatttctgctcttttttttaccctcccataaataacagataatcaagtaccttgtcttgcggtggataaaaatatgatctacattcttccctaactcattttatgaggccagtatcatcctgacaccaaaacctggcagagatacaacaaaaaaagaaaacttcaggccaatatccctgatgaacatagatgaaaaaattctcaataaattcctggcaaactgaatccagaagcaaattgaaaagcttatccaccatgatcaaactgacttcatccttgggattcaaggctggttcaacacacgtaaatcaataaatataattcatcacataaacagatctaaagacaaaaaccatatgattatctcaatagatgcagcaaaggccttcaataaaatttgacattccctcatgttaaaaactctcaataaactaggtattaaaggaacatatctcaaaataataagagacatttatgacaaactcacagtcagtatcataccaaatgggcaaaatctggaagcattatctttgaaaactggcaaagacaaggatgccctctctcatcattcctattcaacatagtattggaagttctggccagggcaatcaggcaagagaaagaaatacggggtattcaaataggaagcgaggaagtcaaactctgtagataatatgatcccacatcaagaaaaccccattgtctcaggccaaaagcttcttaagctgataagcaacttcagcgaagtctcaggatataaaatcggtgtgcaaaagtcacaagcactcctatacaccaacaacaggcaagcagagagccaaattatgaatgaactcccattcacaattgctacaaacagaataaaatatgtaggaatacagctaacaagggaagtgaaggacctcttcgaggagaactacaaaccactgctcaaggaaatcagagaggacacaaacaagtggaaacatattccatgttcctgaataggaagaattaatatcgtgaaaatggccatactacccaatgtaatttatagattcaacgttattcccattaaactaccattgacattatccacagaattagaagaaactattttttaaattatatggaaccaaaaaagagtccacatagccaagacaatcctaagcaaagagaaaaaagcttgaagcatcatggtactagacttcaaactatattacaaggctacagtaaccaaaacagtatagtactgttacaaaaacagacacatagaccaatggaacagaatagaggacacagaaatgagactgcatgtctacagtcatctgattttttaaacagctgacaacaagaagcaatggggaaaggatttcctatttaatacgtagtgctgggagaactggctagccatatgcagaaaattgaaactggatcccttccttacaccttatacaaaaactacctcaagatggattaaagattgaaatgtaaaacccaaaattataaaaaccctagaagaaaacctaggcaataccattcaggacataggcgtgggtaaagatttcatgaaatcaccgaaagcaattgcaacaaaagcaaagattgacaaatgggatctaactaaactaaagatcttctgcacagccaaagaaactaccttcaaagcaaacaggcaacctagagagtaggagaaaattttgaaatctatccatttggcaaaggtcgaatatccagaatctacaaagaatttaaacaattttacaagaaaaaaacaaacaatcccactaaaaagtgggcaaaggacatgaacagacacttctcaatataagacattcatgtggccaacaaacatacaaaaaaagtttaacgacactgagatgttgaaatgcaaatcaaaaccacaatgaggtaccatctcatgcccgtcagaatagcgattcttaaaaagtcaagaaacaatggatgctggagaggctgtggagatataggaacacttttacactgttggtgagaatgtaaattagttcaaccattgtggaatatagtgtggcaaatcctcaaagatgtaaaaccagaaataccatttgagccagcaattccattactgggtatgtacctaaaggaatataaaccattctattggaaagatacatgcacatctatgttgaccgcagcactactcacaatagcaaagacatggaatcaacccaaatgcctatcaatgatagactggataaagaaaatgtgatacatattcaccacggaatactatgcagccataaaaaggaatgagatcatgtcctttatagagatgtagatggaactagaggccattatccttagcaaactaacacaacaacagaaaaccaaatactgcatgttctcacttataagtgggatctgaatgatgagaacacatagacacagggagaggaaaaacacacactggggcctgtcagggggtggggttgggggagggagaacattaggaaaaatagctaatgcatgctgggcttaatacctaggtgatgggttgataggtgcagcaaaccaccatggcacacattaacctacgtaacctacgtaacaaacctgcacatgtagcccagaacttaaaataaaaataaaatactaaagttgtcaactcatatccaattttatattaaagaatatcaaactgggggactaaaccagaaacgtgaatacccacaacggacccttaattggaaactgttggtgctttttaaataagttgttttgaggagagttcaaattacagtataacaaaattcatttagtgaattaaagcagtctgtggttagcatatcatacagaggtattatccgtttaaggaaaaacacagttgaaacccacagagtgggagaaaatcttcacaatctatacatctgacagaaggacaaatatccagaatctgcaacgaaatcaaacatattagcaaggaaaaaacaaacagccctatcaaaaactgggctaaggacacgaatagacaattctcaaaagaagatgtacaaaaggccaacaaacatatgaaaaaatgctcaacatcactaatgatcagggaaatgcaaatcaaaagcacaatgagataccaccttactcctacaagaatggccataatcaaaaaatcaaaaaataataatagatgttggcatggatgcagtgaacagggaacacttctacactgctggtgggaatgtaaactagtacaaccactatgtaaaacagtgtggagattccttaaagaactaaaagtaaaactaccatttgatccagtaatcccactactgtgtatctacccagaggaaaagaggtcattatatgaaaaagatacctgcacatgcatgtttatagcagcacaatttgcaattgcaaaaacgtggaaccaacccaaatccccatcaatcaacgggtagataaagaaattgtgatatatatatatatatatatatataatatatatatattatatatatagattatatattatatatatagtatgcatatacatatatatatatatatatatatatatatatatatatatatatatatatatgatggaatactacttagccataaaatggaattaattaatggcatttgcagtgacctggatgagattcaagactattattctaagtgaggtaactcaggaatagaaaactaaatgctgtatgttctcactcatatgtggaacctaagctatggggatgcaaaggcataaggaagacacaatggactttggggactcagggggaaagggtggggagggggtgaagcatacaataccacaaatttggtgcagtgtatactgctcaggtgatgggggcaccaaaatctcacaaatcaccactaaagaacttactcatgtaacaaaacatcacctgttcccccaataacctatggaaataaaacaattaatatagaaaaattaaaagtaaaaaatttaaaaaaagaaaaacattacattttaattccccaaaagtaaagtaataagtgtaaaatcaccactgaaagaacatggaaatagtcaagcaaaacacacctacagaaagataattatcacaaaatataggaagtacatctacctgcctgctcacctcttcaagcctatgcttaccacacatgcaaaaatacaataaaaaactatgatctacaagtcagatttaaaacttttttttgttctttccagagttacctttttcaactctcattctctgtagtggggaataatttacctccaatatgagtagaattttgcttctaggcactgctctttcttcccatcattcccacagttggttgtattttctttatagttcacttcacccctatggcctcatttttttcccaccaaatttcatgtagtggccggacatggtggctcacacctgtattcccagcactttgggaggctgaggcaggcagatcacgaggtcaagagattgagaccatcctggccaacatggtgaaaccccgtttccattaaaaatataaaaattagctaggtgtggtggctggcacctgtagtcccagctactcaggaggctgaggcaggagaatcacttgaacccaggaggcggaggttgcagtgagccaagatcatgccattgtactccagcctaggtgacagagtgagactccatctcaaaaaaaaaaattaatttcatgttagtattggtcaatcttgcccattgctgtgtttgcacatatcttctggtgactacaggcatgacaattactctttgaccattctgctaaacaattctaaaaagggcaaaagaagttacagcattcaatggtcaatggtaatttcaataatgtctcagttctttatagacatgtaaaaagacagctttttaagggtaggcgtgccggctttcatctgtggaggacattaattgttattgctttgtttttggtctattcccacataacaaactctgaagcaattctacttatctgttctactgttggtccttcaaagtattatagcttccagaactctccaaagaaatccctgtgcaaattttagctaattttaaggattggatggccgtgatctaagtctttcctttaagaaccagatcaaactgagatggaaccaggactagaagactaaatatgagattcttttgaaagttaaaaaataaaaattttaaattattagaaaatgtttctgtggtacttcaactctcaaagaattatttgcacagtctgtttcatcagaggaaccagaacttatttatgatatcatactgacataggttacttagattaaaagaattcatatattcagagtaattattcatcagatctacaaatggtatgaaaaacccactcataaaaaataaattcttcatcttttagctatttaactgaaatgtctatacattaaaattcacagatgtgttaaaacatgtactggaacaccataacctaacatttacttcaattattaaaaatgtagcatgaagaaagcaagtatttaaaggttcttccaaaccaatttcagtgatttttaagtgcaaactaggcaattatatgttatctgtaattaaagcaggaatgcacttgagaatatttgagatatcagtatatcagtacagaattacagtgctttttaacattagggcatttttgcatgtttaatatattttcttttgaaaatgtgatggaaatatttaaatacttcattcagtatttattgaatgatttaaatggctttgaaagtaaatatctacagatcttctggttaaaagctagtggtttctagtggacagtgtatttttcagagaaaacattaaataatgaaattcactttatcgacaaacacaaatatttactgagcacttactatgtatccagccatattctaaaaataatacatttcatactacatgacattcagaaacaatttaatttcataaattttcatgttttcaatgtctacacagataaaaaacattgttatttggtattttgaaatagtaccactgggtggtaaaaaagttgagaggaataaattttaattaattgttcaaaatactagagccaaacacatcaataaaatgattaatagttattaaaatatcatgagtaagttatttatattcccaagatttttggaagtatagtagaataaattattttccctagataaattactttttaaattttttgatagttttattttctaaaataaattcaaaattaactgtattcaacaatatacctattaaaaaaatttaaggtacagcactttgttgtaacaaataagtatctataggactgtcttttatcacctttaaatttaaaaaatgcaagagtaatgaaatctagtaaaatattttttgtaactatgacatgttaatataaacaatccaatttacgaataaagaaatcataaagaggtcacagtagttattttttgtcaattattttttgtcaattataatatcattattgtataattgttgctgtattcttcaacgttccccggaaataagaaataaattattcttttgactttgccctataggtttcctttaatagtacaattcaaacaatttaaaatgcaattttaactactatttttcatttggctatgcatttctttgaaaagaatttaaaaagaatgtattatgacaggtgagatagcatactagatgctttcatttccccattaattttaaagtaattgcaagagcaaaagccatgtccattgtgcatgtctgatctgcctcaagaaagatccaattataaactgacatgttttcaacatacatatcttgcatatttaattcaggtaagcctccaaaataaaacatgtctctggttttgttaaatccacaataggtttcagttgaactagaattttcaaatatattagcactattttggggtattttgtttttgttgttattgtttatatttcataggtgcatatatataatatttgatgttatggataggtaattcatttgtacatttgaagataaatatgtttatcaagcacttgagagcagaataacaatatgtttaacgaaatagcatataccataaatcctaggactcctatatgacatttttcaatccagatgtataagaccccacagtgtgtaatggagcaactttatttgatctaatgttggtttcttgatccgtgaaaagagtgtgatatattttgatttagaacatagatcaaaatatattttgagtactagttttctgtattactgaattttaagtctttgtccaggactttggcacataaagattaaaattacatactatatatgaataagaaacacaaatgaggtacttcatgtttaaaagctcacatagaaaaaagtggaaaatgtatcctaactttaaatatatgtatattaaatatttacatataaaaaatatatgtatatgtgtatattttatgcatctatgtatatacaaaatatataccatgaaatccagttattttgttttcttcctcctaatgtaatatatacagggatccatttataattttctttctacaacttttaaacatgttttatttatttgtggcgcattttttctctatgaaaaaaaaattaccactatattctacactaatatcacgtatcaataaaaatgtataatgattagctagtaacccaggcctataaattaacaaaacaagaaagaataataaaaagacttccttaggctggccgggcgcagtggctcatgcctgtaatcccagcactttaggaggccgaggcgggcggatcacgaagtcaggagatcgagaccatcctggctaacacggtgaaaccccgtctctactaaaaatacaaaaaattagctgggcgtggcagcgggagcctgtagtcccagctactcgggagactgaggcaggagaatggcgtgaacctgggaggcggagcttgtagtgagcggagattgtgccactgcactccagcctgggcgagagagcgagactccgtctcaaaaaaaaaaaaaaagacttccttaggcttagaaagacattcaattctataaaaatgtgttgtttaaagccaaatctacctaacttttgtaaattgattaccaaattaaattgacattaattcattgataattgatagcataaataagaaattgactttgaggggtcatgatttttaaaagtcagaatatttatatatttaattatacatgtttaaaaattaaatcagtttattaacttcaatattatttttcaagtattcagtatattttacaattatttacaaacagcttcaatatagacactgacttagaatggataagttgagaaaaaaagcatttgagcaaatagggttttaagaaaatattttcttaaggtataatacatttgtattaggtaaagcataggtacctattattcaggtgcagactgtctattctcaatgctcaataaatgttatcaatattattatggaaaaattactccaaaataaagaggagataattaaagccaacactcagcttctgtttcatgaaaagtaatctttgaagaaaataattaaagttatacatatccagttactgagattgggattatcattttacttgaaatacttcaatagcttatttttgtcataattttccaaagttcaagaaatttacatcaaaatatttcctgccttccttccattacctcttcttcctatcaaatgtgatgaagtagagttttatcagataaataatcaaattcaataaaccaatgcaaaattaaaattctaagaaattgctttccacccaattaagaaaaagaagccaaacaaaaacaaaactgatcaacttcatgtaaacatagttatgcacattacatatcaccataacacaccaaaaaccaaatgacaaacaagaaaaatatttgtaatttttatcataaaaactaatctctttaacatataaagagtatatatatagaacttaagaagtgaaagtcaaccaactcagttaagaaaaaccatagatataaaaagaatttacagcaaaagaaatagagttgtataacatcattcaaaataagggaattcacgttaaaagtaccctggaagtattttttaaagttagatattgatctggtcagcaagttgttttcggttcctgccatatcttgtagtgggaaacccttttcttttcttgccagaatacttccttttacttctgcccatacgcaatcctagagaatacaagtaggaactctattcctccttttacacataccccagggaacacatggtgactggaaatgtagggattcctggaggattgtttttgagtctattctggtttctttttatttgctgaatataggacctctatgaatttgaaaccatagtaaaacttatggatatggaaatattgtgccttggctttggctgtagctgtttgtctcccatacaaaatacacttcagtcagtctcacccagattgataagaaatatcatttcaagactcacttattctttccgataatatttatctggtgctgttctggattaaatgatgtctcccaagaaaaatatatattgaagtcctaacatccagtacctcagaatgtgaccttatttcaaaatatagatgctcctcaacttatgattgggttatgtgccaataaacctattgtaaaatcaaaaaattaagttgaaccattgtaagtgaggaaccatctgtaggtcattgcagatataattatttaagataagacaccctgcagggagaccaaggtgtgtggatcaaggagatcaggagttcaagaccagcctggccaagatgggtgaaacccaatctctacttacaaaaaaaaaaaaaatagccaggcgtggtggcgagcacctgtaatcccagctacttgggaggctgaggcaaagaactgcttgaacccgggaggcagaggctgcagtgagccaagatcacgccactgcactgtagcctaggcaacagagcgagactgtgtctcaataaataaaaagatgagacacgctggaatagagcatacctctattccaatatgactagtgtccttataacaggatggccatgtgaagacacagaagcatagggagaatggcacatgaagccggaggattgcagcgatgcggcctacaagccaaggagctaccagaagccagaagaggcaaggaaggatcctcccctagagacttagagggagcatggccctgccaacaccatcattttggaattctggtttccagaactgtgagaataaatttctgtcattttaagggaaaaaaaaaaagtacagtgaatatcatttgtcactttttaaattggaagaagatcctaagatttgataatgacctatcctcgataggccacgaggaaacaaatgctggcgtgtattgccagtagaaaggtaaaatgaaacaacctctatgaaaggtaacctcgtattatctgtaaaaattacagatgtatttagccttgacctgggattatattcctggaaattcattctacacttgtaccttcagatatgtgaaatgacacaggttcttaattgcggcattgtttgtaataacaaaagtttagaaaacacccaaagttctagcaataaggacaaattaagtaaattgctgtacagccacagagtgtaatgatctacagctgtttgaagaatgtgaccgttttctatgtactaacttaaaaagatctctaaaatatattaagtgataaatagcaaggtatggaattatgttttaatgtgtttctttttgtgtattaagaagaaaaataagaatgtatgttcacatttgttcacatttttatttttaaaaattggaagaatatacaagaaactaataaaatggttcattctggagggatgtttgggcaagcattgagtaaactgagataatatgggtatgaaaattcatcatgtaatttttttcatattgctgtagtttggggctatataaatgcatgaacacttcaaaaaataaattaaaacaaaaagtaatacgagcaaacataaatgcttggaacaaatgaggatacgctttcaaatccaatttaaatagacaatctaataggtagctaaaagaatgagaaaatccaaattttctttcttttggcaggtaaattttgactaataataattataactgacatttaaattattactattgtaactacattttatattttgactcatctaattcccaaaacagccttataaaataagtgctattattattactaccattttacagatgataaaacttaacccagagaggttaagtaacttgacccaggccacttagctagtaagtagtggagctgaaattctaacctggcattttgtcttcagaaaccatgatgttaatcactccgcacttaaccattgagaaaatcacatgatatatactagttttaaatgttagccattaggcactgaaaggcagattgagaattaaaatcttctaataagatttagaattttctgtcaacaaaaaaatcttgggcacatgtccttctgcagtacttaatctatacctttgcaaggggtggaaaaaggtaatacctgccactgctatagaagatatgagaaaaaatatgtttataattttatattatgagtatgtggaaaatacaagaagaaaataaatataactgtgttcaaatcctgaaaatctataattgcaatctgagctttaaaattatcacaggcaattatcagctttaacattattgtgggccctaggtaagatctcaagccaacaaaagttaggccaagtcaaaagtatttccagtttgtccaatcttaacataatatgaacaaaatgttcatttttttagattgtaaaatgtaatcacagcaaaagatacacattcctattccctcaagtaattgatgatctcttctttccttaggtgtattttttaattaaaatgcagtatctatatctagaaaatgtatcagcctgaagataattgtcgagtcaatgtgaaagaaaatataagaatgtcagtatgtctaaaagcataaacctagttaacatttcaaaaacattaaaatgaatgtccacatataatttccttaaatcaaccagactcagttcaaaacaaatttgtagcccgaatgagtagccctaatagcttagccatcagtctcttcttcattttccgtaacatccactcccatacaaaaatgttttcaatcagttccaacttttaatttccaggagcagaaacctgattaagtattgataatatagaataacttgtaactgagaatacgtatcaaaacgaatagctaattttttaatgatgtcagtcaaaaatttgaaaaatctatttagaagtattgcctaatacttctgaattcaaaattgatcattaactataaaaaaaactattgtaaaaatgattacaattgggtaactatgttcaaaatgttcattttatgtttagcattattaaaaacatctatgtccaattatgagagaagagcatctgatcaatttgtgaccacagttattagcatgcattttagaattatcattataaaaactattaattgcctcaataggtacagttcctcattattgatctacaactacaggaagttaatgatgttaatcattttcaaatgtacacatttattctgtttctagaaaaattactggcagaaaaataggatgaacatattaacagaagagttctcatgctaaggataaccacattttccagataatttacactaaaaatatccatagggatgaaacgcctttgcaaaattatgactgtgacagtgaaagaggtccaacttaaacgactccatcgtgcctctaacctccaagctgtccttattcattcctgagcataggcagaactaactttgggaggaacttagtttatagtttaaaacaaagacgataatggccctttcccagaacaaacttccttcttgcctggggactagactgctaacattagccataagattagaaattatggtttaggagtcacatagctggaggctacaagattctgcttctccctaaactgctcctaagatcagtgcctgagatattttgcagcctctatccttgatggatcaaccagcaccacccagattaagaaaccagcccatctgatcttgtgactcccatccaggaactgactcagggcaagaagacagggacccccctccccacgatttcaccttcgacccaaacaaccagcactccccaactcactgcccctcccctcccaccaaactgtctttataaactttgatctccgaatgttctgggagactgattcgagtaacgataaaactctggtttcccgctcagctggctctgcgttaattactcttttgtctattgcgattcccctgtcttgggaaatcggctctttctaggcagcaagtaaggcgaacccattgggtgcttacaaattgggtaagctgaacccactgggtggttacagggagaggtttctgttaaatgaaaacttgctatcttgttatgcaacaggaagagcagcaacttaaaaactttttgaaactttctctacaatgatgattatactcttaaacaatataattcttttcaccaaacgtgatcttaaaacacttaagcaacataactgactacactttccctgtaaggatctctcatggggtctgttatcacattgttagcaccaaaatgctaaaactgtgaaatattctagtggctacccagcaaattaataaagatattgatttatcatacatataactgcaaccctgggagctaattggagcatcattatttacttattaaaattagatccttgattgtaatcagaattatgtggaaagtcgctagtttcagttttccaattatacattacaaacatccatttatctgccaacgaagggggatagattaggggaggggaggacattctagtttaacacatgagggtcttaatttttttccctacttacctctctggttttatctcttctcacttcatccaattaactacatttccagacaggctttttgaagctagatttcaacatgccagggctttccataccactatactgttgcatggaatgttgcccttctctcagtcacttgatcattgacagactaagtcatactcatccactgcgacctaatttaaacatcacctcttctgtgaaatcatctccaagccctctgggcagagtaagcactctgttctccaggctcccacagcatgtaataggtaccgctattatagcactaactgcactagtggttccccacactcagctctgcagtcctcaaagcaaagagagtctcttaaagctttgtgtatgttaacacctgacactgtgcttgccatttattttttgacaagttgaaagtttccaggtgtcagagtcataaaaatcccagtgtgaatcctgcctgaaatataaaaaccatgtaactttagctagtaaatgatttaagccgagtctcagtttcctcatttttagggtaataattacaatacctaccttgttgaggttgtgttgttgtacctgagcgagttagagaaaacgccactctttgagacgaattaagagtccaagagacagctaacgctcaaaattctctcggccccgaagacggggctagattttcttttatactttggtttagaaaggggagggagggtctagttaaaacaattttacagaagtcggcaaaaaagttaaaaggataaatggttacagggaagtaaacagttccagatgcaggggctttaagactattacaagctgctagacgcccggtagacgcagggctttgggcgttatcaatcggatgaattcctgggaactgcgggtattgctcgccacagtatcttatcagttaattgcattcttgaacgtgctgggagtcagcttgcacaagttaagtccttgaggaaggggctgccagtgaaagagccaagacggagtctgtctggctctcttagctaagggagagtcaattcaggtggaaacaaggctaggtgattaaaggaaagggagagtctaaaaacggggtagtaaaaacaaagttgggcattacagtgtaggcagtaaatgtgttatttatattgtaaagcgtaatgtctgacatgtcagcatccagtgaatgattgattgctgcaaaggatgcatgaaaaataaaactgaaagacaaagaggatttcaaggttccaaaacataaaagcagctgtaagcagttaaactagatgaaagaaaggggaatctccctggatgaagcataaaaagaggtctttaagtagtacaagggccaataaaatggagtgaacttaaaatagtataaaagggccagctgggcatggtggctgacgcctgtaatcccagcactttgggaggccgaggtgggtggatcatgaggtcaggagtttgagaccagcctgaccaacatagtcaaaccctgtctctactaaaaatacaaaaaattagctgggcgtggtggtgggcacctgtaatcccagctacttgggaggctgaggcaggagaatcgcttgaaccgggaggtggaggttgcagtgagccaagattattgcaccactgcactccagcccaggatacagagtgagactccatctcaaaaaaaaaaaagaagggcccttctgcacactgaaggggcttgctccatcttggctctcgtagtgagaagaatgtgtctttgggtttagcatggatggcagctggcaaggtgactctagcagaaagtcaatggggcaaaaaagcagattggatagccttaagaaagtagttaaagttactgacgatggaacaagaaagtaaagtaggctatagcagctaacaaacttgaagaagagagaagggttaagggctctgagtgaagccaagagaatatttattgaagtgtgggagtaaaataaatgtaaggcaaggtaattattaacagaaagtggaaacgttgagtgtaacttctcaaaggtagaacagtttttatgaaatgcaaggcaaatctatcttaaggatttgagaaatgcaagaaattcactgtgccctaaccctatccaaaccaaatccacatcaaaacaatgagctcaagttgtatctctttcacatctccctggagttccagtatttcttaagcttttactctctgaagcaaaaaatacagcactttgtattattctgtcttgcattattctaagtatcttagcttctcccatcaaatgcagttagccatgttaatttacacttgtatctgttgtcacacaaagatactctagcacctttcccctaattacatagttaatgttgaccagagataggtttatttattgatacactatgtgcaaaacaaccaccaccctgataccctttcaaggaaagacttatccgagagcgctgctggcaaacagccttcattcaccctacagagatttcttcagctgcaaagagccaatttgcccaaacttacaccccttcccagagggaccctaattaatgactgattgatgccaaccaggataactttgatgggtcgttccagcaccacagctaccgaaagagttagacaaggctgctgtcaggcatgactcacaacctggtatctctctatgtccaatcctacttcctactgcccagccacagctgttaatcccaaagtcattctccaataacattttgcacactaaattccatcgaggcatatccttcttggtggaacccaaccgataacaacaacaacaacaacaacttaaaaataaactagctgggcgtggtggctcacacctataatcccagcactttgggagaccgaggagggctgattgactgagctcaggaatttgagaccagcctgggcaacacggtgaaacctcgtctctactaaaatacaaaagaaattagccgggcgtggaagcgtgcacctgtagtcccagctactcaggaggctgaggcaggagaattgcttgaagctgagaggcagaggttgcagtgagctgaaatcgcaccactgcactccagcctgggccacagagcaagactccatttctacaaaaataacaaataaaaaaaaaaaactaagcaataatttgcttttatcaaaattttgtagaccattcagaaatagctatgacatcaaatatggaatgtttatttgatgccatagctatttttattttttctcataatactgatagattagtgtaaattagagagaaagtaaacataaatagcatagctgtttattcataagatattcacaatgatatcctattttattctaggaactagagtagtaaccaagatggacatggtatcttacatcagaaatttactgtatctacagaaaaagtaaaagcctttaaaaattaaaataatgacaatttaggtaaagggtcttgttgcattcttttatgtattctttcattccctaaagaagggctttttaagttcacattatctcaaacttcatgaagtgactgaaggtaaaatcaatgcaatccaagactgaaatagtataaacattataaagggtgtggcagtcgtatgtctacataaatatatccaatctataatgaatttattgtcaatcaaattgcattctctcatattaccttcttgaatagaatgtctttttgtctttacatatacctaggaagtggtttaagttacaccctgaggaaattcagttcataataaatttgtttgagaataagaaagattcaaataaaatagtcattgaagaagtacaatatcatttctgggataaatttttatagaataaggtaataatccatcttaaaacgataggcattaacttgcctagaaagcaaacaacttggagaatttgcagtgtgagagacattgtgttggctgctgaagattatttggcaagaccactttaaaattaagagctaagatccctgacaagttttaaaatcttaaaatacatttttaaagacttgaaaaacagatgtactagaaaaaaatcactaagttgacagaaaagggaagacaataaaagaaaaatattaaatggaaatagaaaaaatatatgtggtctgagatataccagaggatgagagggtcttgtaaatcctgataaagaaagagcaaaaagtacaaatataaagcattaataataagaaaagagataaaactataggaattatatcagaaacaagatgaaaacatcatagttataagaaccagatgttattagactactactaacagaccacacagaaatacagttaacctctgaagaacaacagcccatgggtttgacctgcacgggtccaattacaggtggatttttgtttcaatacagctgaccctctgtattagcaggtttcacatatgcaactagtactgcaatatagtattgctgagaagcaaatcatgcagatatgaaagggtcaagtttttgtatacgtgggttcttcaggctgactgtgggacttgagtatgcgtgtattttggtatctgcagaggtcctggaaccaatccctccctggatatagagggataactgtatgcaaaacaagaagagttaatttatgccaacaatatccaattaaaaatatgaataagaaataagataccaatcacaataggaacagaaacaacaaaatattgacaagtaactccaatgaaaaaaatacaatcatatttcaagaaaattataaaactaaagtatatctgaatgaaatgtttcaatactgtaaagtttcagctttctccaaattaaactacatgtttaattcaatgttatataagatgtcatttgggagaggaagggatgttaatgcaattatagacttcacagcaaaaaaaaaaagtctgaatgctttgaataataatgaaagcatacttgctctgacaaatatcaaaatgtccaataaagaggaagtacatgaaatggtgttttattttcatttttggaagtagaaacacacagctcaatggaacagaaaagaggcttcaaaataagacgaatatattctggcaatttagctacatagtagttataaatccactagttctggatgcttaggtctaaaaatattcatttttaagaaagcaacaacataaatgaaatatacaccttaactctcacttttctctatgtgtcagatggttctaaggtataatctgtagaaattcctaataaacctctgcattctcttctcttttccagcaccctgagacccctgggagcctccttcttacccctgaagacctttctctaggtcctagttttataatctttttctcttgatgactttttttcccccctctgatctatctcttcatgaaatgcccttctcctacatgtgtaacaactaaagaatgatgtagctttttacccacttactctttttttttttctgagatggagtttcactcttgttgttcagcttggagtgcaatggcacgatctaggctcactgcaacctccacctcccgggttcaagtgattctcctgtctcagccttctaagtagctggaattacacgtgcctgccaccatgcccagctaatcttttgtatttttagtagaaatgggtttttgccatgttggccaggctggtctcaaactcttgacctcaggtgatccacctgcctccaattcccaaagtgctgggaatacaagcatgagccactgcatccagccccacttactcactctatcgagcgagtatttttattcacttgttatttctgtcctaaaaacatgaagaagcaaggaaaaatgcaatatccaaatggtctatagagaggagggttaggaaaaaacctgtaaaataccatatattaatccattattgtctatggcatatatgatttaggggatgaggcatatctaatcagtcaagcaaaaaaagaaagcctcaaagatatatttcaaatttgttatagcaaacatcactgaacttaaccagaccatcatttgtacatattttctgcatttctatgagtgtatattagtttataatcagaacataataacataaatggattcatttgtacagaatctattaacactctttttcaatccacacatatacatctatttgataaaataatgttttcctatattgaaacacagctgtccaaaatttatcaagtaaattttgagagctaaagaagttttgtaatataacaaattgttaattcaaaggaagcttattatggaatatggttaaattctcattatcaaggtaaattgactgtattatacaatatttcagaaaaattacacaatacaaattcatcttttcattagagctatactcaattgaaatctaaattattaaaatggtaaagagacatcaagtcactacttcacaattatttcaatttttattttttaaccttcacatgatagtaaaaatattacttaaaaatgatcagttgctaaatgaatttcatcaatagattttttaattcaaaaaaaatcagctttttaagagtaactaaaatttccccaaaaagaaagattatatctttgtatgttattatttgataagagaatctattttatttcattaatcaaaatgctataaaaacaggcaaaagaataattcagttaaagtggcagttttgtatgtctgtggggaataaaagagaacttcagctagagccatctgacatgcttggtggcctctaaggcacaatccactttagttaaactcactatacacctcaatcttttgaaacactgactgccaagagaggctccagagctttagaccacgcatctctccacgtcctcctcctgtcccctgtcctttcaaatagggccaatacttctaagcctgcttacacagaaattctagataagtcctctgcaactagatcatcagctttttgtggtccaaagacctcactagagggcatgtgaagcttgaactggaaaaaatgaaccctgaaaacaggaagatcaggcacagatcaaaatggaaatgtctacaatgtcgtgctgggctgagaaatagaggaaagttgcagataacttgggtgactcagttgatggtgtcaacattcattacaataagaacatgggaaaagcaagtcgggcttaggagtaaaacttacatctgtttggaatatgttaaactggggtatgttgaatcctctgtgtggtttcaactagttagtaaacagttgaatattctggtctaagtttcagaagaaaggcttttggaagaaaggccttggcaaaaaatcaagaaatctattttatttcttattttcacctgatacattcttaccattggaatactcctatttatttcttttgtatagactttatattaaatttacctattttctcctacttttgaaattcttctagtaaagtgaaaacttggacatatatacatgtacaccatgtactaggaaaaggggaaatgaacattcttttttctttttagttggtgttactctttatttattagactgcccatataaatgtacccaacaatttgagtaacgtcacttggcagaaggagacatttttgagtcatgccatagatttgagccctgctccatcatttacttgctgtgggactttggacctgcatccaccctctcagaacttgtgtcttcattgtgtatcacctattttacagattgttgtgagattaaacaaggtaagatacaaaagggtcctaatacactgactgttaaaactgagcagtgacttagaataatctcttgagcagtccagggcacatattgacctcttaagtctcctttagagttataatattagcataataacactgagctttaagaaaagtctttaagccagtgattcctgtgtatataccctccagagggattccaaatccccaggaactgaatgaaagtcatggttgaatgcactcgtatgcatactttttctgaacaaaggatccatagctttcatcagatttttcaaagaaatctctgaatggaaaaaatgctaagagtccttgctttgggctctttttacttctgcctacaaagaaaatgtctttggaataaaaatataactggtcacgctaatttcaattaccgtcagcctgtgtaagaagatactctttgagctaacaggctcacagaaaataatttcttctgtgtgtgtgtgtgtgtgtgtgtttcctgtcaagttagacagactcagtgtgttaacatttagagtcctgtcaagaagcatgcagttgttaaatgtcttctttcaccttggtaatctttatacctctatagtctatgaaaacaatggccaccataaatatttctgtagctgttaataataaggttgacagtactactgccaagctctatccttagccaaattagattgcacatattatttcctataaaacttctcttgtatttaaatcaaaaaggataacttttaactattcccaatattttaaaatttcaacttatgagaaaaatcaaagaagaatttcacttttaactgcaatctagtgggtattttcttagacatttttcccagcagtgactaccttaagtaaagttataaactaccacttctcaatatgggtgcttcttgtctttcttgtttccatgtgaggatgacaagatcatttgcttaaggagcctgtagttctcaataagcaatcattgattgtccaaagaatgtatagtgctgttcattataagggaagctttccacaatagaatgagattattgaatggctgaaattagagggtacttattctttcattttaccttcacaaaacccaataggaaaaaacaaaacaaaacaaggtcagaaggagctctcctaggatttttcaatttcatttccttatgattctcccagttaactgttttaagtacatgcattttctctgctccttcccaaatcctgctgaaacaagagtgaaggttttaaggtcgtaaaaagatacaaatacaggaacaaagaggatgggataatagcaagtgaaaaaatgacaacagatctcagaaaaatgataagaaatggagacagcaaaatgagaaaagcaaaaagccaagtgcctacaaagagggatgccaataatacaaaagccatttccatcaggaaaaaataggaaaaggtataaaaactaagaaatttagtagcgcagatggtgaagttgaaaggtaggactgaaaacaagaataacaattaaaatccttataaattgctattaaactctgtaaatatctctttattcagagtaccaggtgtaccaggtgactaactccattctggcaaaaaactataaatttttaaatggagaaatgagccaaaaagtcactacatttggggacaccacacacagtggaaaatggggaaggggaggctaactgtaaaaataactttttgtttctttttggttttttttgaatgtccacatggtgagccaaactacttggaatcatctgtaaaaatgctggcagccagatatgtaatttagcagcagacaaactgacagatttctctctggaaagagagaaatcttttgagttaactaaggtgggtaactcaaacaaatggtcacacacctgctcacagtaaagttcaaatcaacagatatttgtgcaaaaactctagctctaaaaacagacccgatttaaacaaacagaaagaaaagaaccctgagggaggagacaattcagggacttgaaaataacatttaagaaattagcatcctaaaacatatgaaaaaatatattgtatctatcaaccaagtatcatgcatttaaagaaaaatgatgacaagaaagatggttttagaaattgaaagtatcatatatggtattatcatatacaataactgcgaaggaaaagtcaagaaaattctcagaaaaagaaaaaacatacacctggaaaatctgagaaaacatactagaaaattagaggatccatttagaaggtccagcatataattagtaagaattccagaaaaaggaacaaaaaaagtgtgaaaaatattatcaaagatgccatgggattgggggtggggacgggaatccccaaactgaaagacataagtttccggattcaaagtttccagattcaaagcatccctcaagagctcagaacaatgaatgaagaaaaaaaaaagccccaactttcattgcttggaaattttggaaataccagacaggagaaaagatccccaaatattgccaagagaaaaacagaaatttggcatccaaatggcattggactgcaataacagcaatactggaagctagaataaattggaaaatatttgcaaaatattgagggaaaagtactatcaactgaatttcatacccaggcaaactatcaaacaagtagggggtatataaaaagtatttttgaatgtgtcaattctgaaagaagacagaaaaacaggaaagatgggaagacaggaaagaagggaggtgggatggagggagggagggaggcaaaagaaaataaatattaccatgtataggaaataaatatcatgtaataagaaagtattgggggtcatataattgtgtcaattatgaattcattacctctcaactataaatatacctttcaatgtgtcctctgtgataaataagtgagttcttttaaacatatcttctttaaagagggcattatgttaagattttaggtagcagtctcaggagggatgctgcaggaagaagaggcttcctgcaatttctggcacaggtttgggagtggagtaggcaggtgttgggtgtaggggggtggtcagcagtttgagtgtgagaacacttggtacagtccatcctagtcacaggcccaggacctgatttgtcctctccgaccttaaagtcttggcctgatgataaccttcccatagttctttgacatgaaaacctgagatttacacgatctgcctgctctccaggcctccttccagtgcaggtgcttggactctgtcagcaagccctcacaccatctgcactcagtggcgtactttgcttgggctctaccagcaagccccctcacaattaagcacccactcccccacagcagcagctgctgatcacttgttcaccagcctgcaatccagaggatgcttactgtttgctcaataaccccagaacaactccaacctggctaaaccagtcaacttttctcctaccccctggccaaaacacaactcaaacaaagtatggaccccttcaagttgacctttcttaggtaatctccctcacccttagggtaccatataaagtatccttacatagtacagttactcttgccatgtttaatgattattcacattaaatgtccccctctttaacccatagtatggattgcattctatctcctgattgggcatagactactacagatatactttcagtgaaatgaaatactaaactaagaaggaggaagatatggtatccccgaactaaaggatctaattcagctgagaagcaaagggggattctgaatgacgagaaagagagaacttagaattacagctgggccaatgacctagatattacccatccagactgcagcatgagagtggaattcttaagaaaggatttctctgtcccggctcagtggctcacgcctgtaattccagcactttgggaggctgaggtgggcggatcactaggtcaagaaatcaagaccatcctggccaaccaagatggtgaaactccatctctactaaaaatacaaaatttagctgggcatagtggcacacacctgtagtcccagctactcgggaggctgaggcaggagaatcgcttgaacccgggaggcggaggttgcagtgagccgagatcgcgtcactgcactgcagcccgggcgacagagcaagactccgtctcaataaataaataaataaataaaggattaaaggatttctcccagataagaaagaaaaaggaaagagtaactgatagatttcctgtaagtatctgacattgggcaaaagagaattcgagtcatacacttcggaagaattagatgtagggatatagaatataaaggaaaaaggtcttaattaaatgattaccaacagtgaacaacacctacatagcaatcatactgaaaaaaaatcatccattacaaaaggtgaataagaaaaaatatatacataagagaaaaatgaggcaatgtagcttgaaataaacatttcttttggtctctggttagactagaagtattaattaagtttttagcagtcacttatcaggttgcctctcaagttcctccctctcccttttattaatcttggtcttcactcaatgtacatgataaaattcctggaccatcagcagccattttgaaaaatgggattatgccctcttcatttgatccagggatgggcacaatcccaaaagaggccaatgagaatcgttttcctaaactctgcttccttgactaggggttaatggaggtacttcacacaagctgggcagaagctgagatacacgaggtctctatagatgcttacagtgttaaatttctagttccaggtcattcctgaggcatagctgtattcctgctatttgggttccaccagctttccatgaattgttcaagtgggcatatttaatttactttcttttgattgaactattacaggataccacatttctaaagaaattctttctaatctctcaaaatattcattagtttatatcattttatgttttttccttgacacactgcagattgagtcttgtagtctaacatataggtcaattgatgttgcaatggcaaattaaaaatgccagttatcaaggatgaaatgtaaatacattattacattctgtaaggtgttatcggtgcaatcaacaccctgagagaaagaaacatgatttgagactcagcttatataaacatagtgggtcacgagatgtccccacatcttgattgagcttctaccaatttttgcgtttgtttcctgtttctttaaacagtgaaactgattttgttcttacttacatttaaatttcaccttgaaattatgccactgttccttatcaaatactgacatattcctaaatttaaacacttgagaaggataaacccaaatgataaatatcacttagtaatcctccaaggtcccttgtccctgaatactttatgctcgactgctgatttgtaagtcaaatagtttaggtgtatgccagtgttcacagtcagtcttatcaacctcatagcacagagaccttgtaatgtaatatctcatcaccaaaacgacagttagataacctaggatcatgcttcaaagaatgtcttagctggcaaatacatatttttcaacagattgtttggttgacttaaatatcagaactgtctttcaccaagtcttgatcgaccgactgttaactttgaaccagcactgccttgttttgaatgcatttcacttaaggtgatgaaaataaaaccctgtagtattaatagaaataccttaaaaccttcatttactatccacaaaataactatttggcatatatataaccctttagaaatcgaaacatcttgtatctatttgaattgctaatgtgaaaaaaagacatgcagagaaaattcctaaataataggaagttcttaaatacaggctttcattttcttattataaaaagttggcactaattatgtaagtctttctgctaacttatagtttaaagctggatgatggtctttggtgctttattaccatgatgaatggaagaaaacgtattcaacacacttggatcacagttaacagactacagaaattgtttctctttttgttcctctgatattgttttatgaagttcaagctaatcaaaatctaaatctaaaagggagaaaataatttattgattagaaatgggcaatggtgcctaagccctgtaatgagatgaatactaaatccaccagaggaacattctgaatgctatttttactcattataggaaatggttattgttaaacctttggaaagaagactatagaaagatgcttggagatgagggtctcttgagacttatcagtaatttcagatggaacatattaagaaaaaacaagagttctcacccactgtgcatctcattgcaacatatgccctgctgcagtcctaatctgaagtcaactaaagtcttggtatatgtcctggaatttatttacccctaagagagcttacagacattgaaactgaattcaccacatctggttcaaaagtgtgtcatcctgaaggtagcattactcaaaagacagtaaataaatagaggctattttcccataatatcccaagttatatcacatgtaatttaacagataatatgtattttcatactatagctactaagtcattattatgtttattagaacatgccagaagtataaaaatagtattttatatttatataacacagaatagataacaagaatcatttttttaacatcctaaacaacctaggagcagttacttattaatttgcctttcaaaaccagattcgctgggctcccattgagctcccaacttgtaggtagcaggagaatttagaccaagatcttttatatcaagattctaaattcagtatttcttttacctaagaggtctcctaattagtacttataaaattctctttaaaagattaaaattgaaaaatggaactgcccacttttaaaaattttactgaattcacccaggagtttaaattaagtaaattttagacacagatgatggtaaatttctctgtacaatagacaaagtattaaataaaagaatgataatctaatgtaacaattctgtttatttcagaagcagtggaaagactttatgcctcattaagggaagtcttttgcttcattttcagttagaaaaccctgctagcggaattatatctgggctatttctaaatatttcattctcatttgtaaacgggaatgttatttccttaatagttacacatgcccatgaagtacatagagagttcctgtacataaaaaagattactaaagagatgtagatattataagagaaaataaccagtggggaaataaaggaaatgtggatttgaaatagaaaaggaatatggatttggaaaatttttttttctataggctgttactttaaatgacaattgaattaccaagtagaagagtgggtttctctctaataaacctattgatattatttatggatctcaaaagtataaagatacactaaaaatgttgttatggtcactatatgtgagataattgtatgtacaagtgaaaagaataacagaacattttcaaaatatattcatacccataaacccagtaaaataagagaattcataaatttacctttttaaaatcaacattatatgaaaaactaaagaatattgtattttgaagcgccgttctgcaaaagaataaaatgtgttttctttcgtaagagtatagtagcacattcattaagtaagtgaatgctgcacattttgaaataaatttattttaaaggcactgggtgcattgttttaatcacaagaggaaaaaccttttctgatgttatactcaaaccccttgtgttcgcaagtctcccaaaaagcttacacatgtttcctatggtgaattttccacatgcttgctagagctgacaatttttaatttactggtcagatttacctattatttgtacgcattatactagacatattcctgattcaccaaaattctttgtagggatagaaggaaattatagtcaatagagctgaggtcaagtgggcccttagatcttaattataacttgtttaaaaaaataagaaaaatgaaaaaataactggctcccttggctattttcttaccaggaaacaaatgaaaaagggaaatttatttctgaccataaatcccaaatgtttcattttcattttccccaagttaactttctcacctagctaagcagcatttttgctattattagcttgtggtccaatattagctgaccagtatccgtcaaactcctcagttcaatgagctcagggactcccaaagaactctgtgtatgcagacttctacttacagcttctaattattttctaacagataatggaatatttaattcagagaggttagattaaatttgtaagtggatcaaaaccctagataaagttgcagcagcaaggatcactgtagaaaactcaaagctttttagttttgagatccaacaccctcactgattgcttattcgtctgtgacgaactggtctcataattgtaatcctcagaggtgctcattttttttctaatcacactatgccatgctatacataaactgtaagcaacaggcaccaaaaagatggcctcttaggagatgcaatagcattttttgggaaaaaaacaagctatatatgtagtatacatagaatactatgattgttttaatagactcaaataagtatagattgtatgataatcacttcatgaaaagcgttaatgattaaaacatttatgcaatatttataaaaactttttcgcatcagatttttttttttttttttttttttagacagggtctcactctgtctcccaggctggagtgtagtggtgcgatctctgctcactgctgtcttgacctccagggctcaaccaatctacccacctaacaagctgggactataggcataagccaccatgctcaggctccagaatctttttttttttaaataaattcagaggatttgtgtgtgtatgtgtgttttaagaaagttatacacagtttgattttctaatctgagagtaagagtgagtaacataaaatgtcatatggagcaataataaataagaagaaaaagatgaggccatcaactggctttgaacagtaagaatacctcttgaacaaagcttgatttccatcgatgcagcgggcagctgaaggaaatcagaagaaaaactcagaagaaacaaaacttttgactgaactgccacaggtattgttacatgtggcccacctgcctctcatttaatgtgatcttttggaggaggcagagtaatggtatgagaagccagttgactttagagctagggaactttcagttcaaatccaggctctgtcttcccttatcggctttgcaatgagaacaatgatttaaatactatctgtaagctttattcttctctcaaaataggcatattaatactggtttgtaggcattcttgtagcccaatatagatacaaagaatcatttaattctttataatttacaattttgatcttaatgctacatgtggttctagaaaatcttcggaaaatatttctgctattaatagtggattcatggtggataatggaaccaaggaatgctaggctgatcctttttcaccctggctttggtgtgcagttgagttaaattattttccactatactccatttccttattgtacagattagctcttgtaattagaaaaggggcaggaggatattagtgcaaataaaaccatacctaaattcacccttgtttacattaatatattcagttaatttggatggaaatcagcccacatgtgatccaggattactgacttctgcccctcaatgtggaatcactttctaaacattaagaagatttctagcaatctggggtcatctctaaccctctacttgagagaaccattttactaactatgaccattcctaagggtgatgatggtatgcagactatacaccagaatgaaggcctcagcagcagcccaagaagcaaaggtttttctctgactttctcctgtcctcctgtcgctcagtcccattttccaccaaggcaagccatagaacctagaatccctctttccccagacagagcatacaaatgagaaccccttttcctgaaagccagccataaaatctgaaaatattctatgtaaaaactggccataaaagaatgatctgacctacctgtttgactgtaggtcattagacccacattccagagagggccctgcccccacacccagtaggaaagaatgcatgctcagagaaatcaacaagaatttagacagacaggccttgctgggtttcctcactcaattaatattagatcacactctttcacactcaatcatatttccataagtctggctatacttttttgaacctaagcataagaatggacaattttccctgtatctttgggtcttcattaaatacattttaaagtcttttaattaggcatttttcttcagaaacaggatcttgctctgtcacccaggctagaatgctgcaccaggatcctagctcatttcagccttgaactgctgcactcaagtgatcttctcacctcagcctcccacagtagctaggactacaggggtaggacaccatgcctggtagagatggggtcttgctacctttcctcctattaatttgcatcatgtcagtgagtttttaagaaaaacctttaggaaaccaagggccttggcccctacactgacaaagttcctgtccatgacttaaggacataaccaggtaaataaaaacagacctattgtccatttctttagtttctgtcagtctatggtttggaaattgtagacataaacctctgactgataacaacagtggtgttaagtaaaatgaggaattctcttgattattttgaggaaacgatcataaaaaattttctaagctatccttgtaaagtagacgcttttgtaataccatttttagcaatgccagccatgtgatcattgtaataagtaattacccaacggtatcattaaacttaaaaaaaaaagatgaagagaatttttatcttttatccacataccatacatgtgtaaagatacatatgtctttttattagatttttagatgtgtctttttattagacttattagattttattagatacatatgtgcctattgcaattatcacagcatagtaagccttttttcccttaaccaaattactgccctatgaataactaattacttcatgccatataatgcaaaccaggactttatgcagatagtcccttcctcctgcaggaacagtattttgtatccttaactctggaaacagatcattaacaaaaccattgaggtttgacatattggaaattgctgatattttggaaattctattttctggtgtttgcttgtcctttgggcaaaagatttctacctgcattttatgaacagctgaatattagaaactgttcctcctagtgatacagtcaaactgagtggggatttttcctaagtcatcataagtatcggttgctgttcagattggaataagaaattgcacatgattagtttaattctctttcagccctatgtggcatcataacacatcctctagtcatgtacaaaattcacaaactgtaggttagagagctggaaaatacctacaatatggaaaacgatgtcttcaacagacaactgatttccatttactaaatgcaaatattggtgcagtagactatgtgctcttgagaaatgtcctttcattcacacaaattcaagaaatgcttcggagaaacagaggcagacaaaaagttaattaagttacaggttgaggcttacggagagcaacctgtattggatctggatagtctcttttaggtacttcaatggagaaattaagcctgttggaatgcaaaacttgtcaagcactttgtcttagtatcccctaaggcagtatttaaagctcaaattttaggatcactactaaattctgttaactctcaactggaaatgcctgcagtcaactgagggactaagtggctatgttggctggacttcctgggtcaatagggacttccctaaggggactttcccctaagccaaaatgagccacagctgcaagctaagggattgaaacttcaaccaatcatatagggagtttaagctacagctgcagcctgatgtttttaaccaatcgggcccgccaacccacaagcagatagaaaataagctaattctgtaggacagaaaaaggaaaaggggaggggtcataaggggatataagcataagacacccaagccagaaaggcaacccttctgggtccaaagtaaggtgtggaagctttacttttgctttcgctttacttttgctttcgctttaatgagtcttgctgccacacactctttaggtccgcacgttgctctaatccagctgtaacacttgctgctgtggttcacggcttcattccttgaaacccgtgagaccacgaacccttcgatgaagaaaaaccttcaatcgaaagaagaatttcatctcacgactgctttcatttatttatttttgccaaaatctgtgataaaatcaactttatttttcttttcatccttgtattctcactcttactgaaacagaaaataaaatagagaggtcaaaaggagaagagatcctgatgcacgttttagctggagaagcaaacagtatcccaaattactacacaagtcaccaagaactcagaagtaagaagctaaaaatgaaacctaatactaccctcccatgtataatggaaacactaacaggcaagcactcacaagattcccttaaaacaggttcccctaatagaaactaaggaaagttattggcctattgcatgcataggaaaaaatcttccaagggtcttcctcctcaaagggttttcagagggtacatgaataccatgtcaaaacggaaggtctagttctctgtgtttcatctggcactctaaattcaagacagatcttaaattgagtttgtagaaatgaatcatatatgagcactataaatacctaagaaaaattattccaactacaatatgctaaataaagatagaacaattgggaaaaatatcacagaaattaattgggctggtatagagaggatgtaaaggagaataataagtctttaaaacatggaaaaaaaaatcaattcagacaattaaccaagtagttattctgtctcctatgtgctgatattgtgcttgctcatagatatgcagtgatggagtcagcagacatatttgctgtcatcaaggatcttgtagtctagtggtggagagtggaattctacaattaaaaactaagataaataatattaatatataataacttattaaaatttctgagtactattagtaagttataactttagaaatcaggaaagggctctttgagaaagcacacttaagctgagaaaataaggataactaggagttcattaggtatgattggaagatgaaaactccaggtgaaggcactgactggcttggcttataaggggagtggaaagaaagtcagtgaagagaaagactattggaaaagaaatcaggagctctgtaagctaagaatctgatattttactttagtaaagccactaaaggtctcatgcagaggacctgcacaattcaagctttgtattaaaaagtagggagatcaaatctagtctcataacttaagctgaagaagttgagggctgagattaagatgacgacaaaagagtataaaaagaagaggaaattgtccagatgtgtttttggcatagaatcaaagcatttactctcgaattggaggttggttgtttgtggggttgtgacattcaaggataaatttcaaatttctggtagggacaatagggtggatacagatacaaaatatataaatgggtgaaatcgaaggcagaagagattgagaagagtggatgaaggcatctattcaaggtgtgctagacttgggacgtccctgagatttccatgtggcaatattaaggatggagacaaggtcagattcacaaaacagactagagatggaacttggtagtctagtgagatgatctaggaaaaatttatagattgaaaagaagtctagaactttgcattgagatatttcaatatttctgatattgcttactgcctgtatgattttaagaagcaggaaagttgaagattttttgtaagaacatggttacaatgatggtccatgaatctaagcgggctgcagagagatgtgagataggaagcactgagggatcgtgagacaaaggagagtcagtgaaaggaaaatgaactagaaaggcaggagaatgtagctgaagatggagatatttgaaatagtaatttcaaatgtgaggctcctgctgattgcttactagttctagagacaacctacaaaatgggagaaaatatttgcaaactagccatctgacaagggtttaataaccagaatatataaggagctcaaacaattctatacgaaaaaaatctaataatctgaccaaaatgtgggcagaagacttgaatagacatttctcataggaagacatataaatgtcaaataggcatatgaaaaggtgctcaatatcactgatcatcagagagctgcaaatcaaaactaccatgggatatctcaccccagttaaaatggcttaatacttacatccaagacaggcaataacaaatgctggcaagaatgtgaggaaaagggaaccctcatacactgttggtgcaaatgtatattagtataaccactatggagaacactttggaggttcctcaaaaaactaaaaattgagctaccatacgatacagcaattccactgctgggtatatacgcaaaataaaggaaatcaatatatcaaagagatatctgcactcctatgattgttgcagcactacttacaataggttagatttggaagcaacctaagtgtccatcaacagatgtaggaataaagaaaacatggtacaaatacacagtggagcactattcagccgtaaaaaaagaatgcaatcaagtcatttgcaaagcttggatagaaccggagatcattatgttaagtgaaatcagcaaggcagagaaagacaaacatcatctgttctcatttatttgtgagatctaaaaaccaaaacaattgaactcatgaagatagagagtagaaggatggttaccagaggctgggaaaggtagtagggggctggggatggttaaataaaataaaatgtaaaaatataaagaatgaataaggcctactatttgatagcacaacgaggttactatagtcaatggtaacctaattgtgaattttaagatgacttaatgagtgtgattggattgtttgtaactcaaaggataaatgcttgaagggatagataccccattctccacgatgtgcttatttcacattgcatgcctgtatcaaaacttctcatgtaccccataaatatatacacctgctctgtacccacaaaaattaagaataaaaaatccactattagtatggaacaggatatagctaagagttactatgtgaagccatacacatgaaattttataatgtgaaaatgttatagaacaaaataccttttcaaataattttataagcctgttatactctaagagaaaatgtaaactgataaattatattcatttcacttgattaatgtaatatcaattagatttaaaataattcccatcaagatactgcatatcaaatggaaatatggagaagagaaacatacaaagactattcacatgaacatttcttcagaaaataggataacagcagttgtgtaagataaataaaatttcctatggtatatatagagaaaaacaagctattctttttaataagaatattaccatttacataataaagtcagatgacttaaaacacttttccttgcagtatctcactgtggtaaatctggtgtggaaaagttgaaacaaaagccaaaaaaattcatgcgaatgcaaagccatgactgttgagtagtcactagaattgagaataattacataatttctttcattttttttaagaaagcaagtaatttagataaaacatttaaaaacagtcaactgttactaggtttaaatactggggaaaaatacagagtgaagggaactcagaaaaagtgaatagtctgtctgatttcatgagatagtggtgcccaattttaagaatcttgttcaatagcatcatttcttatgtatgtgttctgcaccattttgtggatttaaaaaaaaaagaaaacaaaaaacaacaaaaaagcctgcattttccctgtgaaatggttctgtctgaaacaagaactaggagcaggtgtaaatgcaggtattcttatgaaggtgcgcctttagagtcattttcttaatgttgttcaatatgatctttctttatgggaatgaagaatgtactggtcattcactagcagtgtgttattattgtcattatgaatccattagacatattcgggtgagcagagtaacagccctgggtgaccaaactctccttctcttgcttttagtgtagcatttaatagaacacaaactgccccttatttattttttgcctatggtaaaaattctaagaaaatataaaagtcctctcctttacccttgaatatcaatagaagtttcattgtggtgataaattttgagtattaagttgccacatttgtgttatttattataataaccagtaaagcacagctatgtgtgatgaatagagtagtggttattgaatctagaatattctatttcaagcataaagttagagtggagaaaagggagtctaatgattaataagattgtgcaatttccattgtctttgaaagcttttttcccctgaagaactgtacaaacaagcatacaaatacaaatatgcacatacgctagtttgcagaaacatggttgcagcagatcttatttagcttgaaagttatccttggaacactctaccatagtgttataccagatgacccccacccacctttctttgcttgacagctttctctttccactgagcctattttgccatccttggctggaaggatatgtagggggtgaagtgtggctctttcccagcagctctacaccctcagctcccttaacccttgagtggggtaattttgaggtgtatgtcctacactggctgccagagtctctccagtgaaaagaagctccagtcacttacaacggcagctagctttattagttctcctgtcttatttctaaactcccccattgatgagtccttcacctccaaaataaatgactttcacattcttatttcaagggtagcttctgcatctgtaagaacccaaactaacacaagttaaacttattacttttaaccaagtaactctggaatatttataatttcaactcaacccttagattcaaattacaaataatttttcttgaacctacctcttttttgtggtttgttattcaaatacttttataatgatctacacacataaccaatgagctaaaaatgtaggtatgaaatataggcttatgtttatgttaaaattagagcagcctgcattagatactaaattcaccgttgatgttgccagttaaactgcattttaatcattgtgatgctatccttctaatgttttgaaagaagtctcgaaaatagtaggacatgtttctgcctggtacttattaaactctgctgatagctgtccatcaatctgttaatcttccagcatctatccacaagagaaaaggcacagtcaaaatattttctttaactttttttaacttttaaagagaacagagtcttctgaatctgttggttaccaaatccatcaaccatctaggaaaatgactcctttcatggctcaaccagagcctcatctaaaattcagcagaaatctaagacttcaagctgccatctccactcttgtttccatgggaatatacatcagatcaagaaaaaaaatggatggggttaggagctttcaaataatcattcaaaatcatgatgaggattttagagattttttcttaggtgtgattattttgtaggctcttaacccccttttgccagtctgtttccatggaaatatgacaaaaatgtctgttcaagcctccagcagagattattagcattctcatgaatttcagctttggctgtagtctaggctggcaagattttttctaccagttttataaattaacctatactgtttctactctttgtaattttcctttataacttctactttttaaaaaatttcccttcacaaatttatagttatgatcaagatcaaattgaataattggcatatcactgaaaaaggcttcagttttaaattttaatatatgagccaggacatgtagcagtggcgtgtcagaaactttagagaactggagaaagaaacaatatttagtttttggccttactgttatatagatgccggtagatatgcaacaaggtgatatttaaaatatttagcaactggtaaggcatgaaaccaaccaatccgaaaagctggtttgtacaggctgattatcaacctactatatgagaaccaataataagataggctgaaagtagttttatataaagtagttagcattatacataaataaattattcaaggtcaaagacagctcctgtaaaacttgtaaaggagcttacaagagaaactggatagagatatatagcaattcatcttttaaaaaaatcagagtgcatatgcttgcatcatttttcatatgaaggtcatttgaaaatagaaatcattcttattactcaagacattatgctaaaagatagagaaagaacatatatggtctttgatagaacccctggcaagatgtcttgtattgaatgtgaaaaaataacggcatgataaatacataattttattccatcctactctgaaatttgctgaccggttcaaatctacaatttttgctaggggaaatcttcaagttctgattgaccttaaaaagtacttttttactcatagttggagttttttaacccatagagtcttttcttctgaatttgaattaaaaaaataaatgtcaaggggtaattacttgactcaggtaggttcttaatttaaatttaacagagactaacttgctatagaaactaatcttgattgatgttttcaactaaatagatcataaccataataaaataaaacagtatggttaatttttcaaattatcaattttagcccctgctttccccttaggcaacatctggcctgcagcttatttatgtaaataaaaagttttattggaacagtcacacccatttgcattagtttttgttttgtttggttttgctttaattatctatggctgctttcctaccaaaaagagcagagttgagttgctgccacagagaacacgtagcatataaaagcctgactataatccagccttataaaaaaaaagtttactgatacctactcaagcttggcttcctgaactcaaagtctagacctgccattttctaactttctaaccttggggtaaccttgggttaaccccaggttcttggtctgtcatattttgaggaataagtaaattattatttgtgaattatttgtaacagtgtttagcacttagcaaatactttgtaaatattagtgacttattaccaccaccacatagtctttctaacactcttcagtgcaactaattttaagaaatatacacatgagctttggttattaaatgcaattggttttccgttgaaattatgtattgctctcactggagggctatttggttatatttaacaagaaaatttaagaacattacatgtctgaatcaatgtagataattcaccttggggactgtaaatatcttgaaactctaaaggcaagttctagtgacctatctaggcagacagttgtgaagcaaaagtgatctaaaaagtataatacaatgtgaattggtcttagaaatgtctttaattataagattataatatttccataagagaaatttgtaagttgtggagtttggttttgttttgctttaattatctaagcaggctatttgataatggagaaaaatgtgattgcctgggtgtctgtacttacatccatgaactccacatttgccttgggaccagttgtctcattaagaatcttaatagccacaggaatcttcacagtttctccttcaggtacccaaataccctttggggaaaaaaatttacattaaatatgacatctcaacctattaagttcttacaaagtaacttagaagtttgatattataacattcaatcaacaaatgtttatttagcacctgttacatgttacaagttactctgcaactttgttgtctgctttcattatctgaggatgttgctcatatacatgattacatatatagaatatagaatatatatcctttcaagatgtttacactactgtcaaattctacttgtgtgcatgaaaaaggctttgaatagtgaagacagcatggaaataggatagcaaaagaatatctgatttggatggtatcatcgactttttgagatggttgctctactttttgaagctcagttgtatcatctgtaatttagaagactgggctaaggaatgttagaggttcttctcaggctgaatattatctaaatattcagcagcaagaaaaacaattaaaaaagcatattctcatgttcttcaagttcagattgatttatgaattaattttcaagaatgaatatttaagatttatttttcaaaggcaagtgctaggggatattgagcacatattaatttgtctacattattaaagcatgtgtatatgtgtgtgcgtgaaggaattttattatctctgaagaaatataaaatatttatattggccgttgttagttctcttttcctatcaaaatataattataatatctgaacaggatttatcccttgggaaagtataaagttggtagagtttgagtgaaatacaacattaagctaaataatagcatttctgggtaaagtgaattatagcatttgaatgaggacaatgattttgataagacatacaaggatgcacaggttgtacaagaatacattttaaaaggtgtattttcccaaatgaacgcaaaagcaaatatgagagcatgaggacaaaaaccgaaaaatctcaaattttagcttcttagccctgacatcagaaaatatttcttataagatttttaacattaaaatgaaagaatgaaaaataatagtttgttattcctgaacaaaacatctttacttcctgtctttcttactatcagctagttatagtcataaagaaaaaaaattcaaaaagtttttcactttgaacttttatgctacaacatatgtatttgtgttactcaaagttgcagtatcatcaggagacctgaacacaagaattattttaaaacatagtaacaataataaagaaaataaaagattttaacttttagaaagtgaatttatggttgcattcttcctaggcagaatgaatagggaaatctatgtgccaaatgcaaaataataagccaagttccttgcaaaaaattaaaaagaaaataaagcagaaacagaaaaaagaaaacagcccaatactcaaaggcttcattttctcactgatgttatctagggtggaaaacaggcttattattcattattcaataaagtaaccacagagaagattactttatgaagacatggcatcaatattaaagtatccctaaagtgtagttttaaaataatataggccaggcatggtggctcatcccaccactttgggagactgaggcaggagggtctcttgagctcaggagttcaagaccagcataggcaacatagagacattccaactctactaaaaaataaaaaaatttaaaaatgagctgagtgtgctggcacatgcctgtggtcccagctactcaggaggctgaggtgggaggatggtttgagcccaggaggttgaggctacggtgaactgtgattaaaccactgccctccaccctggcctacagagcaagaccctgtctcaagaataaatacataaataaaattaaataagaatataaattcaatgtaaagtattttatacttctttttaaaataaatatttattaaattattctttttttttcattatttcattcattatttcactattttctgggactgactagttaaaaattttactatctgatacacatgatattggtcctaatctttatacttaaacagagaatatttctaattaggagaaaaaaataatcaaataattggttaagccaatttgcacttctatggtcaagaataatcctttatagtttaagacagtatgtcttcataacaactgatctattgattaaaacttagagtcaaccatagacactttcattacaagtaatttcaattagggtaaaacactcatgcacaatagacaaataaatgctcttaatacaagttaataaagctttattattaaatgcttaaatgggtaacatttttctctgctgaggacattagatagtgtttagtcttgagttatagggtatccaaggtttaaaataaaatttaatttacagaccacattatctttaaaaatataggagtgattatactctaggaacaatgtaagattgagttatcttaaaaatggaagtacgttataatacatttaaatttttccatttatctctttttttctccctatttctgttcttcataaacacataaatttgcctacttgctttaaattttgtcaatgtcacatgcagaattggtaacaggcaggaagccctaatatttttctactgacttgtcctatggttcagcacagaagccttcagttacatctgtgaatacggagatttgtagcatttactagataattcaggtggggaaaaatcctgcaatcaatcattagaatgggaatttatggcatagctaagtgatccagaatgattgtcagtatggatcaaattcacagcagtactttcaatttgtcaatttaaataatcaagactgcaatttaggactctacatttattatccacataattcgttgatattttattgtagaaatgagtacagattaaaattattaaagatgtaaatacaattgcagtaaatagatacaaactttaaggatataaaatgatacagtctgagtctgtttttttctagcacaatctaaattgagaaacagaaacatttgtttctttgaacatatacaaatctgaagatgagaaaaggcatcaagtcagcctagaacagtgcctatgcaaagtaggtactcaaatttttgtcaaattaagatcaaatttaattgaataaaatatgcatactaaaagattagaaaacttctgcattttgaccttagaatacaagttttattttaaggatattagattattttggagcacttggagagaaaaattaaggtttatattctaattattaatattttttgttaaataaatctctgttttaaatagaaaaaaatgaatatttcaaaatgcaacatttctaagatccaattaactttaacagatatgtttgtaaaatgtaggcttacacatagctttaagaaatatattaaatgccagccgggcatggtggctcatgcctctaatcctagcactttgggaagccaaggcgggtagatcacttgtcaggagttcgagaccagcctggccaacatggtgaaacctcatctgtactaaaaatacaaaaattagccaggcatggtggtgagtgcctgtaatcccagctactggggaggttaaggcaggagaatagctggaacctgggaggaggaggttgcagtgagtggagatcacaccattgcactacagcctggccaacagagcgagactccatctcaaaaaaaaaaaaaaaaaaaaaaaaaaaaatatatatatatatatatatatatatatatatatatatatatatatatatatataaaatgccaaagtaacttttgggaattgtagtaatggatattacaagaataattcagcatttgcccagaagagtttcttaatcttgttatttaccattaaaataaatttcaccacaattaatcttgggcctagcctctgaattggtcctgtaattaaggcaaataagtaaacatacacatgccatcatttgagcttttcctttccagaaatatctcttattgaaaacacatgatgtcatcttttcctcctatctgacctcaattttgcatataatgtcacatttttagtttgcttatgatgacaaagacatcaaaaccatggaaattatttacaaaatcataaatgtaaccaagtaggcaaaaaatgatttagaagctagttccaacctattaagacatcagcatatttgaatggattctaaaaagatcagctactaggatcctgatggagaggcgttggataaaaaagcagaagagaaaaagaataaaggattatggtatattgcccaggcatgtctggggttcatggagcactgtgtaggggtaatggcaaatgggttggggcttgatagttggataaaaatagaaatttgccaaaaggaatatgacatacggggctcagaaaggtattaagaaaaaaactatacttggctttgtatcagagtttcttgcttttctctcaagactgtatccgtcccagctcattcaataaaaattaatgaattcatttgtgcagcaacttctcaatattataaaagtcttcctttctgaatattataagaaaattaggttgtctaaagtaataactccattggctattattttctaaacatctaaaacaaaacttaactaacgatatgcgttgttttttacttactttataaaccgttccaaaagcacctgagccaaggacttttaccctcttcagctcagtttctttcaaaatacgaagttgagcttgattgggtgctgtgccactgggagttaatggttccaccaactgcaaagcggaaagaagaaggttatactttcagtccgatagtcagtcctctctctctgtctctctctctctctctctctttggttctctttcttacaaagaaaaacacaccaacttggtttgccttgacaaccaataccttcgtaatatgcaccactcaccattcactgacacatttatgcattctttcagaccctgtcctttctcttctcctgctctttgtcagggcaaacacaagtaacaaatgtgcacctaccttgaggcatactaggctacgagatttgatgcattaaagaaggaaatgctgccttcttagagcttaaaatatacctgggaagccaggacaaatgtgtcagaggagaggggaaaaaaacgcacaatgccaaaaccctaggacagggctgttaaaactttagtgtatatctgaattacctcaacttcttgttaaatataggtcccggttcagcaagtctggagtaggcctgaaatgtttgcatttgcatagaactctaagggatgcctaggtaccatggtgatcctcgaacacatttgaagtaccaaggcccaagtttacctgttaaatcaatagttctaaaattctatgatttgattctgcatcataagtgaatgctatgaaatgcaaggcatcaaacaactactggggagtgaggctcactagttttgccttcctaaagaatgtacactttaaaatcaagtcttgagatgtctaagtcttgacataatgaaaatgggttggtattgggagggccactgtgaaaagctgcttgggcacagcaagagggaggaggaggaagaaatatagcagaatacaacagggagtgggactggtcagaagggtgagagtacggtgggaaacctacataatcacagggggggctgggtgtggccaaagtagtaaaattaggctgatagttttagacgtcatcattgcgttgtgattcagttagggggaatgaatgagaagggggcaagtatgtgcatgcgtgccaatcactggcatatgtgagaaaaaaaaaaagtatgtctaagagaggctctgggtaccaaaaagcctgtatcctatgttaaaattttaggtttttatctatgtatgagtaaaagggcaagtgcaagaaataggagtttctttgtcttttaaaagttaaattaaggaactaaactttacaaatagtctcttttatttttccagcataataatcaaagggtactactactcaaactgtcttgaacccaccacagtaattcaaaatctctatctccaaagctaagtgcactgtggccctgcagcttgggtatgaattaccatgcttctgtgaaaataacggcctacttaattagtggaagattcttgattgaaggtaaatgtagctatagcaagaattttaggaagaacgtaataaaaaattgccaataaacttaggttatcttcaaactcttctttaattgtgagtttgacaactcatcttcaatttcattttcaaatttaagttatataaatgtaaatttgataacatagaactgcattcaagtcacattttaaaaatctcagaaagaatcactaaattatttgttaaatttcaaaatgattgctcaactgagttcccttcatttgaaggcaactcaaccatacaggaattgttgggtagattttgatacatatgctatatgtataatgaataacttatgaatcatttttaaaaatcatatacaaaagttacataaaatcacacaaaatactgggagggggcttcagcattttgggtgagatatacataaaatatacattgtgtatatgccttggcatataccatgcaataattgcatattttgaaaacttcacagttctacctgagcttttcagtcttctttaattttcttgggtatcatttaatatatttcacaaaaacatgtttctgtatcatttaatatattttacagacacatgggtttaaatttggaggtttatatgacagtgttgccactcacaggaagcaatttgcccttcctaaacctttatttcttatctgtgaagtaggtgtagcaataattaccttagaaacttgagaaaggatgaaatgagataacatatgtggaaaattctagaacattgcctggcatattgtaagcactaaatctgttactcttcaagggatgagatcatgtctcattaatatatttttgaatcacaccatctaccaaagcatcaagcttacagtgcatctcagtaagcatgtgtggaaaaaatatgttttatagttttatgcatgtaacataaaaaagacaatctggaacaaaatgatttgaggaacgtgtaccatctttaagtgtatgcaaacaatatatcaagattcaacaaatgttcacttctgaggcagatttctagcttcagtatttaaagatttaaattgactatcttaaaaattccccctttatttagatggtggtagaaaatcatattttcttttactaagaaaaagatagggattctacgattatctaaccaccaaatgtaaaataatttagtcttaaagaataattttctataaaaacagaacctgcttataaaaccagtaagtgggccgggcacagtgactcacgcctgtaattccagcactttgggaggccgaggcaggcggatcacgaggtcaggagatcgagaccatcctggctaacactgtgaaaccctgtctctactaaaaatacaaaaaaatgagccggacgtgttggcgggcgcctgtagtcccaactactcgggaggctgagacaggagaacggcgtgaacccaggaggcggagcttgcagtgagccgagatcgcgccactgcactccagcctgagcgacagagcaagactccatctcaaaaaataaaaataaaaataaataaaaaaaataaaaaaaaaaaagtgtgtgtttatttagtaaggaaatgacggtttgaaggacattcttataaagcactgcattataaaaacaaaccaagataaagcaacacaactcttttcacggcaatgagccttccctgtgtgtggttaaggtaatttctcttccattctgcagtcacctaaatgtacactgctattccaagctttcctttccaactgtagtttacaatacttcatttccagaattctctcaccaactgcctcaagctggccatgaggaagaattctctctgcctccagcatcctagctaaactgcaaacatacatagcacaaagcacatgtgttgtgtccaaactttcattcacatgtgcaagattgaaagtaatcaaattgctcttcaataagcttccagctaaagtaggaatcactattaggttttcccatgtatgtaattgactacctttattttgcttgaacatgtctattcatgagacagctcattccaattgcagataactttattccctagaaagtgttttcctagaagcagctgtaaggtagtttccagaaactttcacaggatacttctatctagatttgatttctgggtaaaaagagctaaaatttaattcattatcggtatgcaaaatgtgtgaatgaattaaaattcccattcctcccattcctgtcagtgttcaaaggagaagtgaaattgtcagactgacaatgagaaaaacaacaaacgttggataagcttatctcagaacagaattactgtgaattgtttagataggcacagatgtgtatatcaggagaaaggtaagatggaagttgagaagggtctggtaattcatagtcttctgtaattgtttcttccctgtatcctgtaccatgaacactatctgcttttatgctagagaactcagtgtagcaatataaaagacattataatcattcatgagtaatttacatactcacaataactaccatgcataatattaaatgcatcccataaattgtgtagtaaggtctgtgtgattacaacactaagttttatcctgtaagcttagtctttcactgctggtataatgagatcattgactactaatttaatgatcctaattaaaacatgcattccttgtctgttagttttgttttgaaacagaaagactctctctctttctaacatttttctaaatctgccactgagatattcttttttttttttaattattatactttaagttttagggcacatgtgcacaacgtgcaggttagttacatatgtatacatgtgccatgttggtgtgctgcacccattaactcatcatttaacattaggtatatctcctaatgctatccctccccacttgcctcaccccacaacaggccccggtgtgtgatgttccccttcctgtgtccatgtgttctcattgttcaattcccacctatgagtgagaacatgcggtgtttggttttattgtccttgcgatagtttgctgagaatgatggtttccagcttcatccatgtccctacaaagaacatgaactcatcattttttatggctgcatagtattccatggtgtatatgtgccacattttcctaatccagtctatcattgctggacatttggcttggttccaagtctttgctattgtgaatagtgccgcaataaacatacatgtgcatgtgtctttatagcagcatgatttataatcctttgggtatatacccagtaatgggatggctggatcaaatggtatttctagttccagatcgctgaggaatcaccacactgacttccacaatggttgaactagtttacagtcccaccaacagtgtaaaagtgttcctatttctccacatcctctccagcacctgttgtttcctgactttttaatgatcgccattctaactggtgtgaaatggtatctcattgtggttttgatttgcatttctctgatggccagtgatgatgagcattttttcatgtgtcttttggctgcatgaatgtcttcttttgagaaatgtctgttcatatactttgcacactttttgatggggttgtttgttttttttcttctaaatttgtttgagttcattttagattctggatattagccctttgtcagatgagtagattgtaaaaattttgtccctgtttttagatgacatgactgtatatctagaaaacccaatcatatcagcccccaaatctccttcagctgataggcaacttcagcaaagtctcaggatacaaaatcaatgtgcaaaaatcacaagcattcttatacaccaataacagacaaacagagagccaaatcatgagggaactcccattcacaattgcttcaaagagaataaaatacctaggaatccaacttacaagggacgtgaaggacctcttcaaggagatctacaaaccactgctcaatgaaataaaagaggacacaaacaaatggaagaacattccatgctcatgggtaggaagaatcaatatcgtgaaaatggccatcctgcccaaggtaatttatagattcaatgccatccccatcaagctaccaatgactttcttcacagaattggaaaaaactactttaaaattcatatggaaccaaaaaagagcccgcattgccaagtcaatcctaagctaaaagaacaaagctggaggcatcacgctacctgacttcaaactacactacaaggctgcggtaacccaaacagcatggtactggtaccaaaacagagatatagaccaatggaacagaacagagccctcagaaataatgccgcctatctacaactatttgatctttgacaaacctgacaaaaacaagaaatggggaaaggattccctatttaataaatggtgctgggaaaactggctagccatatgtagaaatctgaaactggatgccttccttacaccttatacaaaaattaattcaagatggattaaagatttaaatgttagacctaaaaccataaaaaacctagaagaaaacttaggcaataccattcaggacataggcatgggcaaggacttcatgtctaaaacaccaaaagcaatggcaaccaaagccaaaattgacaaatgggatctaattaaactaaagagcttctgcacagcaaaagaaactaccaacagagtgaacaggcaacctacagaatgagatattttcaatgcagatattttctagatctgctgctattgagatatcctctatccagagcttgctaatgggatcctcccaaccatacaaacaaaatacagatactttccccaatacaataattttcttgaccactcccatctacccccttgaagccttgactatttttacaacataatctgatttttcacaagctttgtttaacggactataaaataaaaaacttaattaggacactgaacagaattttacttggattaaataattgaacatcatctaaaccttctaaacctgatgaaaatccccaaacacatgaagaggagaaagaaatacctcacctctgtttccaagaatcttctcaaggctcttttctttttgatgctcttccttctaacataaacagcaaatgtcagacccacaatgaccagaatgaagagcccaccaattactccagctgcaatcaggggagttctgacaaccagaatgagaaaaaaaaaaataaaaagtatgaagagagagaagacagaggaagagaaaagagcagttgtacaagacattatccacatttcacaaatctagtcatttagatgaaatgcaaatataaaagtgcattaggttttgctctaccaaaacctttctcatggtaaaaactatggttgtttttgtgtgtttaacaaataataaaccatgcatgtacaactaatctttgagatgaacagtcacaacatgccatttgatgaaaaaaatgtaaaacttgctagcagtatgaaaaacatatgccaagacattggtgttggcgcatttaatatttttctattatatatgaataaacaggaaatgcattgtaagaatattgttgtggtttgtaattttatttccagtaatttctctgaagcaggctttcacaacagtggcactattgacatttgaggctgaataccagtttgttgtcgcgaagtgtcctgtgcattttaggatgtttagtagcattcctggcttccatccctgagatgccagtagcacccccatcctctagtcatgacaatgtctccagacattcccaaagatctgtcaacatcacccccagttaggaagcactgctctaatgcaaaaatgagtggtctgaagacatagaaaccccacacctctggagtataagggtaccaataagagagttattattgcccaaagtgctatttgaaactctgattagggcaactctggtagaaaaaaggtcaggagaaagataaagaattggttcagacatgttttcagaataatgacaagagtattagaatcaatagtgtgtctcagcatcatacactcataaaagaggtttgcacatgaagcattacataaaaagtggtaaacagtaccaaaaagggattaagaagagattgattggaaatcttcattcttaaaatgtttttgtaatgtattgttagcaaagatataattttgaaactgatcacttcttagctaattttttccttgcttaaacagtagtagttgtgatttttaacttgttctagagtagagcagtatctctgaagtttccgtggtcagagttcttaatcatatgaattttgtataccataggaaataatcttgagtgaaacacacaggtgttacctaaaaaatatttgaccaggaagccacaatggatatcaaaactaaaaaagaacttcctgcctgctcatgctttccataataaagcattttatatcttatatttatatttttaaaagaacttatactacattttcttaaaaaatactttctcttgctaaataaacttctgctcagagatagatcagaaatagtatggtggatgattctcaataaaatcttgaaattttaaaaagctcataaaaaaaatctgcgtaacttcttctataaatgaaatcatgtcttttagagattatgactgctatattgtcatataaaactgcagaaaaatctaaaaaggtagttcatcctaaaggttgtttcctgacagctcaaagtactatagtatactgaaatgttgctataattcagctagatttttctaaatgggattttctaaagatataaaaatctctgctgagaaaattaaactatagtatggaaaaaaattcttcattgtgatatgtttttgtttgtgtaagatcatatttttgatcatgcaagttaaatatgtatttcaggaaatattttatgtttcaaccaaaggtataatttttagctcaaatgcttaacatatccctgaaaagtcactgttattgaaagggtcatatttttgttttctcagtccaattttttatcgcaaaatatttatgtataattgagactaatgtccaacatttcgttaattgtagattcagaccaaactctaaactttctctgcttatttattttgcaaaataataggtggtatacatatttatgtaaatatatgtaaacgtcaatgtcactgtatatgaaaagaaaacgctctattttgttttttgtttgtttctttgtttgttgttgttgttattttttaagaacaaacttccaggagaagaaactaatacctctcttttttcttattttggtggagattgattgccatataattactatacaggcaagtaatggtaatcaaaataagacattcaaaaactcaagacagtaatttctggttttatagttagaatttactttcagtattttctcacagcaatatttttggtctacttgaatttctttactgttttcttaccactctgcaggaacggtagaggtacaaacaacctgaaggaataaagaactaaaatttctgtacttaaaaatcatatataagtgttttattgaacattataagaggccaaattctgcctattcccacagaatttacgtttgaaacataaatcattaaccacaaacaagcaaccagtaaaatcaagaggagggaatattccataagacaacttgcagtttctttttattaattgagtatcatgaaaaaggtgctgatgtagcttaagaagacttaatagacatagcaactggatataaaatgtactcctgcattagatcctagtttggacaaaccagttatagagtctttttggaaaacttgaaagatctaaatataaattatatagtagatgagaagataatttgctgcaacacaaagacgtgcaccacaaactgaaaagattcggtttccaaacagtagaacttcaatatgaaaaaatacatattcatatatgtctacaaatatatcctcagatgcatagatctggaataatataaaataatatactaaatagtagttgtctctgggtagtgtgaatacagtgctcttatttttactaatttgtattttctaattttttttttttttttttttaaattcactagggtttttctctctttgacatttaaacaagaacacaaagtaaacaggaaatacaatttccaatgtcttttaaagataatgtttttatataagttgtgtgttctcactagttttttcttcttgaggtaatgtattaattaatcacaatctgctcttataattttgacattcactttaaaactccaaagggaagatgtgattaggtattaaaattatcttaaacaatattaaaagatagacatataggaacctctatattccaggccaaactacctaagcaaaagaaagattttgatgttagtagaaaatatttgcaaactatacatctaacaaaggtcaaatatccagaatatgcaagaaacttgaggccgggccagtggctcacgcctgtaatccccacaccttgggaggccaaggcaggtggattgcctgaagtcaggagttctagaccagcctggccaacatggcgaaaccccatctctactaaaaatacaaaaatcagctgggcgtggtggcatgcacctgtaaatccagccactccagaggccgaggcaggagaatcgcctgaacccaggaagtgaaggttgcaatgagtattttctaattttttatgatccatttatattccttttgaaataaaagtttattaaattcaagaaaaatgcagaagaaaaaatcattgtctaaaagtttagctttgtaataatggccttgttctctttttcttgaatgtttactttgcttttttttcaattaagatttcattttgttattccctgtccacttttacaatctaagtacttttgtgtatattttctattcattatagtttgatatgtctgagacatttgattactattatgtttcttacagttaacattatgtaccataaaccaagataatctgaaaagttaatactattttcacatttcttactcctctgaatttttatgattcctagatgtttgtaagtataggatagatatctttttcttgtttgtttttttcctgagaatttatgcttagctccttttatgaggaccctttgggtagagaggaaatagcaacctaagttacttctttaaatggctgtgcatctctccttggtctaatgatgataatggctattaccaaccaacctgtttctgagcgtgaatgtgatttattttatttttattttttagatggagtcttgctctgttgttgcccaggctggagtgcagtggtgtgatcttggctcacagcaacctccacctcccaggttcaagtgattctcctgcctcagcttctggaggagctgggattacaggtgactgccaccatgcccaattaatttttgtaattttagtagagatggggtttcaccatgttggccagtctggtctcctcacctcatgtgatctgcccgccttggcctccaaaagtgctgggattacaggcatgagccaccactccaggccttgaatgtgaatcttgtatgtgaatcagcggaagcgataagaggctcagttgacactatgagatcacaaggttcaaatactaagggatctagaatactctgattccttatctttaacaggagtattgcaatttttttgtcttgtcttttggctgtccattaaaaatggttgagaccccctaaagtataaatttctaagatcaagtccaagcttagactaaaaggatacgatcaattgatagtttaccttattctgtgacttggaaatagtattatgaaactgatatcctcccactactgaagaaactaatctcacagggattctgaatcacaaacgaattttgctaatttatttaaaagcaaatgatttggttttcataatttcatttagaaattcagagacaatgaaatggattaaattctactgacttgaatgcaattgttttataaaagagcagcatctttccaagctatattactcatctaaaatatgtatattcttaattactatatttggaccatgctatttctctcatgcagaatataaaatgtgagaggacacatgaaaccttagttttaaaaacatccggatattttctcccattgatcagtttcttttcagatgtcagaccacaaaaaaaatgtaataaagtcaatataattcatgattaaaactcaaatgttttaaaaaactattttgttatactctttctatttaatgttataaggactggctatcttttaaaaaggaacaatagtattttcttaattggcgaaactggtattttgatgcatattgcaataaatgttaattctatgattctacctttttttaaaggtaagttcgtcaccaaataaaaggtttattaaattttgaatatatgtgtattttctttacttttttgaatacagaataattttcaactaaagataaaacaacctgtagtcctataaaacactgatggtatacttgcaattcatagtattgactatgaatcaaagactttcacttttagaagcttttagattaaactaaataatttgaagaaaggtcttcaggatttgttgcatcagatgtagacctgcttcacttgcttatctatgggcactaaatgttaaactgaaaatgcgtgtgtgtgtttttttaaaaaaaaagtatataagaaggaaaaacaaacaaagacaggctagtcagataaatttaacagggatttttttttgtaaaataaactttgcaaattgcaaaacatggtaaaacagtatctccaacattactactttgtgttaatctttcaaattctgtatgacttttccttattgtggcagaaagatgctttggagccaggcaaatctaagttttaatcatatgtctacttctaaccaattgtgagtttactgcctctatcaaatagcttaaatatacacaaatacattctttacctaagctagtacaaaaaataaatgcagaaggaaattatatagtcatgtttacattcatagtatctaatgaatttgcttcaagatcatttctagcattatcattaaatcaaacaccttgaagtttaggaattattcatcccattttggccaggacggtcttagtttatgccagtctaataatcaataatgccacttttactctccaaagtgcctctatgtgagcaataaatcaaatgtttatcctacatttagcccaatctaaaggaatttaggatacccagagttaataagtatttatctatatctctatattaaaatgtgtatgttggggtatgtgtgtatgtgtatataggatcgaaaaaacttcagtttacctctatgaaagggaataattctatgaaatctgacatcttcatttttagtagattatttcccatcaaaaataaatgcattgctaatgacactctgttgtgctataaaacccatgagtatgtgtaggtgtgtgcatatatacacattcacacgaaagtgtcttagttttattttcagcaagttttactttctgggaaagtaaattaattactgcattttatgaatgtatatgtaacttaaatgtatatttcacaaactagggtcaaatgttacaattctctataaagttatatttcattttaaaaatataattaggtaacattggccatcatcctatatcctatctttcttctgaaaatcttacagtggctacagatgaaagcataagtctatcatgacccagaggacaaatgtatgctcaggggtatattctgttttgtaaagtgttcttgctgtaagaaaaatgtagttgatcaaaaacctattgactctctattaaaatcaaattcttataattcattcacaattaccaactgaggcaaggaatatagctttgaaaacaataacgttttcaatattttcttaattatgtatataatttaaacatagcaaaaggtctgtttccataagagaaagacaagatttgacagccatcagattctcacaggttttatagcacacagggtgtcactagcaatgcacttattttcaatgggaaataatctaataaaaatgaaaatgtcatattttcttagaaatcattccctttcatagaggtaaaccaaaggcttttttgatcctatatactacttttaaatttaaatcatttagctccactgaatgtgaactttccattctaataatttccaatacttgtatattttataattagaatttaacttttacatacattgtatagtttcacaataacgatgtaacacatatcttgtaaactccatattaaatacaagaaaatagaaaagatgcctggataacatcaaatataaatagtaatgctaacattttatgtattggagtctcaagtccattaaactttcacctattgtattttttctctttctaaagatgatatatttacacaaatatcattattcaggttttgcttcaatatctatgcttgatagtagagaatacaaaatgcacataaatttatttaggggttttcatagaacttttatatttagttatatcttaatattttacttctctttcgactatcattttatctgtattgctatattcattgtgatttacttttattaaatcctttatatccttgggtgtaaagtttataagtgacattcttcttcttttagcttcattttgttttcaaagtgagaaaacagttaaaatggttttcttttttttttaacttatatgggatttcctttaagaaaggtaaagacgagcagtatctattattacagtgacagtacctattgtactgctactctgttcagccttccccaaaacagttcagatttgaaacaagagaccttgaaacaccaggaaacattgaaattccccagaagacattttaagggttactgcctggggcaaggagagctacattaagggagttctttttctcctacaagtagtgcttattctgacccagaattcaacctgctttataaacatgacacatcttttctttttgagcaaatgaaagtgatcttacagtttttggttgacgagacctggggtattacaataggtctctgtcctttgattaaggctcaagattcctctattacatttcaaatatgaccaaaactgtaagtgctgaagctaatgaatcagaacgtactgtcccccttcctaagcaaatttgaatgttttttgactcggctttatgtgttaaaatcaatctttttttcaatatgtgaatgcaacatttcattcgataacacagtgttgcaaaagtacttcagtagagatattgccattaaatgaatatgtaaatataatctgatccttttatatctagatcagcttctgagaaaaaatttcaagtagtttcagagcaaaccttccttctctttacaggcaacatttacacatatctatgggcttttgtttgttttatcaaattttggggaagtacataaacttatacacttgactttctggcaaacattctcatgttaaggacaccatcctcagaatatatataatctatctaggaatttctacacccaggattttctacaactaaagtgttgaaaacgaattacgccaggaagaactttccttttaacagggtttttaagaggtcagatgaagttttggtgcttttattaattcttccacagtttatacctattatacaatatcatatatctatataccatactaatacagtaactttattattgtttatatactgttatctagatagaatatatataaggacatgttttgtgacacaaacagaatattgtaaatatttaattacagaacaaattaaccgttaagtatcactatgtcctattacttattcattatatggacaaggtaatatgaagcaatagagcaaaagatttaaatgtccaggattcagttcttacaacttcagttacattaggtaccaaaattgttcagcatgctaagtaatttaagtttcataatagagcagaaagtattacataaacactgctctgtgaagaaaagtgggagagggataaatcatggctggcaccattcttgttcccatatttaaaaagttttcttcgccttaaaatctccattcattctatgcactataatttcagataattagttgttaacagagaatatattctatgtataaattgcacctacctttatctatcgaagcattaagcatacacatttctgtcatgcttattgtacacaactacataagacagatacagagcaatctcattttcagagggtttgcaaactttttttttgagaaggagtcttactctgttccccaggcaggagtacagtggcgccatcttggctcactgcaacctccacctccggagttcaagcgactctcctgacttagcctcccaaatagctgagattacaggcacccccccaccatgcccagctaatgtttgtatttttagtagagacagggtttcaccatgttggccaggctggtctcgaactcctgacctcaggtgatctgcccgcctcggccttccaaagtgctgggattatagctgtgagccaccaagtctagccttgaaaacatttttaaagtaatagcctggtttgtttgtttgtttccttgatagtcaattctgtatataaagcatttttgatttttttttaactatactttagattccccaatccttgttttatactgaaagaagatttttttaaaaataaaatgctaacaaagagggattaaggaagtatctttcttgggaagtatcactactctttattcagatgatgtattttctacttacattggcctgctggtagccctttttcctgctgcggagacctacaagtgttcatcggggagttggtggccttgcagcctactgaagatttgaatgaagtgagatgggaaaagactttaagaagtgaatacagttgtgggaaaaataccaggatttttggacatctatctagagtcactggacatttcttgcaggattaatgaacaaagctccttttcctagatattttatatgtgttatgtcaaataactcttccaatataattgattattgatgtatggtgaatctgaagtaggttatacaacttgtccaaggtccgaagcattctaactggatagtcaagcctagactcttagtatatttttctctaaatcctttttccattaaaatataattatgcggttatattaggaaaattattctggtagaaagttgtaagatagataagcaggaaaaagaaaagatatgcaagaaaattagtttagctgactgttttaaaagtcctcatgagtaatagtgaaagacagattaggaaagtttaaaaggagatatggtgagaaaatgtattaacagcagcaaaactgataaaaagtataacctcaacagtggagaaaaagcaggcatcaaaagtgactagactcccatgcctatgggaatataataaggccgatgatgccttaaagggacgtgcagaaatcagcagacagacaattagaagggagaagtttttagttctttttgatctatggatttgaagtgctaaagggtatccaaaatctatatcatttcattcaacttttacaatttctttacatatttgttattcttgtaatttcaagacccatacctgttgattttattaatagcttcacatttttaattaaagtgagtcacagacaacattccattccattccctttaagtttttctagtactttatttattctctaggaacattcaaaatgcaaaggaagaaaaatgtggctaaaggggctttatttcttttctacttcctctccctgtcccttttgttttgctgatagactatatcattttatgcggtttcacttatctcatcaagataaattctactgttccaatctgtttttgttcttatctttttactgaccttttgagatcatcatttgcaagaggaacaaaccttaaaaatatttaatacatttaaaaaacctgttcatagtgctatttgccttgggtaacacatgctagagccagatgccttagtaaggctacatagatctcattgctaattcttgtgccttaatgccatcccccatttggagaatttaaaatttgacattaaatattaaagcttaaagaaaattatttaattgaaaaagacaattaaacatagatactccaaaagagtccccttcatattcttttataatttggtagtttttatagaagaaaccttatgttccagatgcaaagctgtaagtactaataagtggcttcaattttattgtcatctctgtgactgacctcaattcattccattttgctatcgtggtttcaagaatatttgtttttagtacttatgtgtcttagacactactagaccaaacttgatttaggtatttataattatgctttcttggattcttttctatttcaaagtaaattataagccccatgaggttaggaccatcatttctaatttttttttttgttttatcactctaataacattgtctaagaagtttatcaataattattataaagtgaatgaaatagttaagtgggatattttaagtaataatgagttcttaaaaatgcaattcttccacttgatgtgactctttagtatttggaacaattttggaaaaagcagaatattttctttgcatttatctcttaaacagtttgtctaaaactgatcattttatttccattctcttaattcttgaattaactctcatcacatttttagtctctgtctcttcactaaatcggttcttatcaaggtcatccaatggttttcttgctgccaaatcaaaaagtaatttcttagagctaatcttaatcaacctggtggtagattttcatataaatgatcagttcccttttcttgaaacactgtcctcccttgaaagccatcctttccctagtttcttccctgtctggtcagtccttttcactcattttctgctatttgctccgtgttaccctgacctctaaatataggaaagcctcaggactcaatcattggatttctttactttcctacttatgccctagacaggatgtaccatccatctctttatctatgtaatgataagcaagcatattcagagattaaaggtaaaataaaagaatttctatttttataagctcaaacataagtcctttaagtgctagaattttgccacaaacactttcatatgttttagagtctagtttattgtctcatgaaaagaagtactaaatagctgttacatgaagaaataactggatgaaagtttacttccataaatacttacaaactttttatcttaaatcaacccttgaaagcacatatatccaacaacaatctcagagctccctatatgtttttaaacttaacaaaagcataattctaaaatatctttaatggaaagaaaatgagaagagttatttatgtaaggcttctctgaaatgaagctgatacgtgtttaacatttgcttattccagctttcgtagtaattggtaaaataatattttctcctaaaagcagtgaaactaatcctgagacaagttatttttctttgctggttttagtttagtttatccctcaccctcaccacactgcgtccaagtcccaggctgactgaagcaacagttgttcctactccattacccctaacacactagtgatttttaaaacgttaagtaacaacttcctcagtctctctgcatcttggtgtaaacatacaacaaaattcttgccaatgaaatgaaagcaaaggttgaccatagggaattctggaaaagaacaggtagagctgatgaagcctatccctctacttctgtccttggatctaatgcttagagctgtggcactcagtgtactatcaaaacagaaagataataaaatgatatacgttctggtcctgttgttactgatccatgaaacccatggcaacagctatgccatttctagactactgttatgaaatagaataacacctaaaactattgggtgaagccattactttttttacttgtaggcaaggaagatactaactgaaaagttcgtatgaaaagtgactatgtccaaatttttcacttttccttttttcttgcattttaactgtcaaatgcatcatctcaagatatttgcatttttaaaaacataaatgaagtcaatggccctttcctttcttgttaacacttactatctctggtgcttctattacatctgcttcatcatcctactcttctggtcattgactaggctttacgtgtatcagacttttctgaatgcttacattggagggggacaggggtgggaggaagtgcctcacacatttgtaagtaacactaagtagaagcttgtagagcttcctcaaggatgctgtctctgaattgtggaattatatgtgctgtaatagacaggatattatgtgtcatccatttccaagcagtaataaaattcaaaagtagtaaatgtttcctgaacttacacacctcaagcaaatatgtactgaaagatcaataaagagaacatgaagaaacacaggtcttcattagcatttaatttggcaaaacaagaacatccaagttttctaatttctggatccatagtagattggaagtaacccaaggaaaaaatgagagggtgagactgtttctgcctccacaggggacttggcgaaaagacaaacaaaccctcctttcacagaggcttttggtcattgcaccccattttaaattatgtttttaacttagaattgattagtttttatattctaagaggaggtttattgtgactgaattcacaaaaacacatttgaaagcatttaataacaatgtttagtaatataactcctttctaaacttatataaacacccaacccctaattagaacacatttctaattatggggaaacccatttttttcaaaagctattgcctaggcgatgttatgattcggcagatgctctgaatacagattcacagcctccagataatgtaagagaaaaaaaaaatcgaacctaagcatttcaaacaacattgaaataatataatgccaagacaactttatactttgcctgaaaccatttcatttacatgcaaaataaatcattactactaaggaaaaaacccacatctacatgaaacattctcctccaagctagaatattaattttccaatctgttctttactttttattattaaaattgtgtatactattaacaatcagccatatgtaatgctatgtattgtttatggacatccagcagaagatcttttaaaatctctttgttttgtaaatggtcataagaaaataatctaaaagtaatttggaataaacataacgcttcccttttaaatttgctaaatgaagtatatctatagactttcttcttttcagtctttaaagctttcagattgcatatctttatttttgcatttagaaaattatctaagcaaatgacttatctttacttacaatcatgccaattgagtttatgcaaaatctaagtttttcttagagccacgggggaggagagtaagagatagcagttattgggtcctaaattcaccctctggcactgagttagttgctggaaaacactaacatctcttcttgagtatttattgggatcactaagtaagtatgttagtatttagctatttgcaaacagtcaaaaacaaacgactctagagaacaaaagtgtaaatttaagatgctatgcaatgggtactttctcataaaattcatgccagttatcctttattatcaagtaaggacatctgcagtaacttaaagagaaaaagagagacagagacagagagagagaaagacagagagggagaagccctcacaatctattcttagtgttttataaaaggattaggcattgctatgactaagttattctataaatattatttataatttcaaaactatataggatcaaagccatcctgtgaattgtttatatatatatattcttattcctccataaaaataaatgatgttgaaatattacagatacatatatctatagctgaccatctaggattacttgaaaccaattaataaatcaacagactttggaaaagttaattaaacttctttatccatcaagatctctgtataacatgattaatggcatcataaatgaaactataaactcattagaagaaatttctaagttattcagtctttggcaacttttggtgaaaaacttgcagccgtactttgatggaacctgtctaattttagaaaggtatgaaagataatgatctgttacaaatttatgtattttataatgacactataattcaaatgtttttaaactcacattgtaacttctgtaatatttaatgtgttttctatttgactttttgaatagcaattcacatatatgaataagaaacttgaatattttcatgtattttaattaatccctagctaaacatacttttttaatgccagatacacacacatatatatgttatttattttataatttgtaaaaggcaaaaacgtaggaatagcctatctttcaatagggagttggtggtaaactgatactagggaatactaggcaatcataaaaaaggggtaatgtctgttgatctggaaggctgtccataaagtactattaagtgagtaaagtaagttattgaataatgtgtagagtatgctccctaatctgtaaagaaaaacccttattatcgtatatatgtattagtatgtagagaaatgtgtggaaggactaatacatagacataacatatacatttctatttaatactctaagcatgtattacttttgtaattttaaattttattaaaaatatattttaaaaaagaattaatcttaaaaaacagaaagagggaaaaaagaaaaatacctaaaatatgatgagctggtgagctttaactatcaggatgatgaattctacatttacttgctttggatttaaaagaaaggcatatgggacaaatcactaagaccagaaccattgcttgaagataaatttagttacataagtacattcagaagccaaagaaattttatttgtaagggaattccatcataatttcttatttgaaagcatataaaaactgaaataggaaaaatatttcatgatgtactgatttactagtaatctgtacttgcacagctgcataactgctgatgtttgtagtaatgatgtgatttggagtaattgttatatatcagcattttgcaattaacgcaacaggtattgaaatttgttaatgtctcagaacacatacaggatgctgttagattctgattatgtatttaacagtcttctaatttaatgagtctagagtcactgagagcaaaccacaacctgctattttccatgcaaaagcaaaatagggtgaccttcaagttagaaacatgtaaagcaacacattgcaaattattgatgatttgtggattaatgtcagaatattttaaatgcaaaaattagcccagtttatatttggatttaatattccagaccatctgtctcctcatacctgtacgtctcctccctttgggcaaaatgatttcatctacaatctcaaagagaatttagaattttacataaactcaaccttttcttaccaaagttatacatttatctgtatctttatcctgtaattattttctctcaataaaataatgaaggagggagacttctctaagactaatcctttcatatgttcttttcctcttaactcttcttttttttcaggaaactgttataattaataatctcttctctctcctgtatctccaacctctcacactctataaaatcttccaaaacagactcaaaatttcacccattctcaaaatatctttctcttgatattattcccagtccaactatttcccagtctctctctcttctctctcatctacatttctcaaaagatatcaacacttggagaaacttccatatctgtatattaaatttcccatttagcatcactgaatatgtcaaagtcactgcaaattcaacacatccgaaactaaacacaggatgactaatttagcacccttctactgtgagaaatctcagttaatgttacccccatccatccaactttgcaagccagaagcctagaaaaaaatgattaacagtttcttatcccaattccttcatatccagttaatcactaagtatggtattacattttaagttctaaatattttttgaatcttaacacttctctccattcactcgaatttctggctccccaattccctgattacttattccaatagttttagccagccattcacattgataatactaaatatttacattaccaacaaacgattaagttagaaggtcaatacttgcttcccaatcagcatatggactcactcccttctagaacattttctttacttggcgtccagggcttcaccttacctgatttcctcctacctccattcagtctgtctcaatttcctttgccgtactatacctttctcttctgttctgctcatacaaattatggagtattctaaggcttgtgcagttttccatctacactttctacatatggaatctcatttaatgtaatgaatttaaatatgcttgatgacccagactcctcccttgagctccacagtattatatttatttgcctatgcaaaatcttcactcaaatatcaaataaacgtctccaatttgttataccttaacagaattttttattttcctcataaaatttgttccattttcttttgagtcttctccatctcagtttatgacatcattcttagccagttactcaggacaaaaacccaggtgtcattggttgtatttttcttttcttaccatctgcatatcacatactcatttataatttccctcataataaataatcatgcatgtaaataatattaatgtaaatgcatgtaaataatattaaataatattttctctttccctacacaatggattttatgatattaggaattacgttaacttttctctctattctttcctcagtatcttagccaacatttgacatgtagtaaatacaatgaatatttactggctgcatattgtgaaataacatatatggaggagggtttgtgttttgttctgttttctcctgttaaaaacaaataaaatatggtatgtttgactgtatcaacagtgggaagaatttttcttgggagaaatcactttttaccgaaacaaccagagccagatgatacacaatctaagattcataacctatcacctaaaatcgttactacttccaatcaatttttcccaatcccataaatcctacagtatgatctagtgacaacaaggaagtggctgccaaagtccagcactatattgtcttttattttattttagtgtccatgaaatttgaattcttacttgtacttttgatgagggaggctggggatggtagcattaatgcaattaggaacaggtgaaagttgttctcatacgaaaccacaactttgtttttcaaatctctgcagaattttaaaataactctcacttaagaaaatattttttaaaactgtgcctatgtttgttcatatatgtcttagattagtttatctgatgtatttaaaaagttacattatctacaattataggagtacacgcttagatcatggaatttattggtccaggataaaatactctgtgtgagaactgcattataaaatcctacacagaagtaggcttaatagctaaaaattaaaactaagagaaagacattgagcgatttttttgtaaattgctgaatgactctaagtctgtttcatcatttatgaatggcaatagtgactactgtttttatatgcttgtcataaatattcaatgtcacagtgtagcatacctgatatagatacatattaggattttctaaaggtggcaaaaacaagctcctagctaaatataagattttggaaaagacatcagtactctgagaaagaaataaaaaactgatgttttggttttccctttggtcctttctttcctggtgtgtagaacaatatagctattctctctgggatttgaactctcggatttcggggtcagagattgaacaaaggagttgctttgtaaatttatcttgctctgttcaggaaaaaacatggtgtttttccctcaacaagtaaattttttatggtaaaaggtttttgttgttattttatttttactctactaaaagtaactataattattccataaatgactcaagcatatggaacactttactctgagcagaagaacagaatgctataaaacttacatggctacaagcattcagagtttattagaggtgaggttccctttccttatcattcattctttagtactgagttactgcaaaattacaatgaaattacacctctttgggtttaagggtagatgatggcagagaaggaaatcactgtaatggaattttgttgataaatcaaagcactctctgctaattagctcctgcctatatacatagtacagaagaataattgtatgtttatgaaaaaatgattaattagggaatgtgctgaggtaataagaaaaaggcatgaagagagcaatttgaattaatatctacacatcattttatgtaaccacatcacagaagggggtctcagttaattatattcccctagttagatagaaaatatgaaaaaaggtacttacttaggatctaatacaatatatgcctaaattacatggtgaaataaattcaactcttttctaaatatatggcaggcataaaaacagaaactttgatctctacttaagaaatctttttggttaagtattgttcatttataaaaactgaaacaatgttttaattaaaatatgggctataaaacaaatttaagatctatgaaatataattccaaccctttgagtaattttcaattttaaaagtaggtcatactgggaattctaaatgcagactcaaattatcataatttagtcttctcctatagaagtttataagatctgtgtgcacatataaatatacaggtatatgcaatgggttcaggcaaacagatgtttttcctcgaatctgtctaactcatcccatctgtaacccattgaagctgatgaaataaacacccttctgtgaatatgcaatatcattccctctactattcttattttgtgtaaaactattaccaaaattgaatattaaatcaaagtttcatgatgactgggctggagcagtgcagtccaatagatctataatacaagctaaataagtgattgaaagtattctagcagacatatttaagaagatgaaattaattgtatttatttacccaatatacccatattattaacatttcaacgtgtcactgatataacacattattaataagatattttatattccctttttcatactagtcttcacaatccagtgtactttttacaattacatagaatctcaatttgctttaactgcactgaaagtgcttaatggccatacgtgactagtggttaccatattggacagtgcaggtctagagcaatcttgagagagacttacaggtctgatgacttaatgaaaaggccacaaattttatattaaccagggagtactttaatcaggattctgtttgtgaggtactgcacaataatgcagcatgagcacctggaaccaacatggacactgagaccttaccttacagtatataaatgtacaaagagaaccctggttttagttccaagataataccttattgcttgctctagggcctttgaggacaagaatatgataatacattatttgaagatagtttaaccaattgatctctcatacatagatgtgcctttatatggcaaagttgcatgacacacagaataataatcaagtttccttcaggacaagaaaaaataagaatggcaccgtcggaaatattatatgctcaagtacccagggtaggcagatgtgctagacagaaatcaaaaattgctcccaggattacagccactgaaatatacacatacctttcccacttatttaaattctaacccaggtgctgatgtgaaaggattttgcagatgtaattaaggtcccaaatttcttgacctgaagatagaaagacaatcagcaagggcctgacttaattccatgagccttcatatctgggtctattggtcagagagacaaaatctaggagattcaaagaataagacggatctgaaacactgttgctgggttttgaagatggtgggggtggggtgggaagggctggttcatgacaaggaatacacatggctggctaagagtcagcaataacttgggagcctcagttctacaacttcaaggaacttggttctgccaacaacctgaatgaacttggtagtggactccaagctctagatgagaacacaggtcagacagcaccttgatttcagcctggtgagaagataaggaaaaaacccagctatgccatgcctgtaattttacctgtggaactgtgttttgttttgtttgtttattatacttcaagttctattttattatactgtaagtcactcagtgagtttgagtataatattaacattttagggtctctagaagctttggtaacaatgtctgagcattttgctatcaaggtaaaagccacttttgcaactttgtgacgctaaatacttctgttaaagtaaccactttaactgtatgaacagtaattaacaactgagctgagacgttttgctcttcccctataattctgtgataaccttggtattttatggctactgggaagttgggacaaaagtcatgtggaaaagaagagattcacacactctccttcacctcttcaaactctctttaattccaaagtaaatttaatataaagaacttagtggactgaggatagacttataataaagggctgtgtgcttttatttattggacttaaggatcataatacaactgccactcatctaaggtaacgatctatggatgattttgactgtttgatttggacatgagttatgaacttaagttccttgggggcaaaacaaacaaggaaaaaaaaatgtgccaattgtgaaagtggtgccaagaatatcatatcatctctctcatatatcacacatgggtcacactgctaaaggattaaactgttatgtgacctgttacttaataaccactataccataaagtaaaagtatgacacaggcattaaaatgtgacaagaatataaaatgtttcaaatagctgcccaaaggagatttagatagttaaactgagtcaaattactttactttatattgtgaagcacctagaataattgaattggagcaagtaactagataaaaatgcttgatatctagctgttttaatgatttcacaaatttgaagagttattagtcagttaacacatggactgctaactaacacaaagaaatgttttgccaatggaaacttgacttattgagattaacaaatttcagccctaatagaataggagactgagattaaaagaaataaacaaacaaacaaaaaaaaatctttggatatatatttgacaaagaatctaaaatggattagaatcaaatattctattctatcagaatctatatgaaaatagcatgtatgcaagctaaaataaataatatacagaaaagaatgaaaaagtcttgctaaacatattttttataggattcttgatggaaaagaaaaaccaccaaaggcaaatactatttttaaggcacttaattcaaataaggtaagtagggagaggttctaaaatatcaagtattattttcattataagcagcatattctaggagactaaaggtaaaaaaagaaattctattctatcttatccaatcttcctgaaagaaattccagcagcagcctataatgtaaatgaagtgtggaaaccaactaatacattgtaggcttgggaaagaataacattgcttagaaaatgaaagttgatcaagactggaaacatttcacctgctttcatttaaatcttcccccccgccccccgcacccgcccccccccacgcccgccccgctggtttgggaaacagaatacaatataatggggtggaaggactatgaacactaaatattttgaaatggccacattgacatgctcaatgtaattttctgtgactaaaaataaactaggcatttggataatccgccagttaaaatatggtttaagaaactcaaaacaattattttcttttttgggggggtttgagggggacagtgtcttgctctatcccccaggctggagtgtagtgacacgacctcggctcactgtaacctctgcctcccaggttcaagagattctcctgcctcagcctcttgagtagctgggactacaggcatgttccaccacgcccggctaattttttgtatttttagtagagatggggtttcaccgtgttagccaggcttgtctcgttcgcctgaccttgtgatctgcccgcctcggcctcccaaagtgctgggattacaggtatgagccaccgcgccctgcccaaaacaactattttcatttgtagtttttgtcctcctattatgtaagattcacttcaatcaattgacagatgctttgaaaaactatgatgacatttaaaaatattattaaattagcgctctgctttcagtgaaatacacacccacctcatctcagagaggtaagcatttgttgcaatactgaagacctgaaaaagcagacacttgttactttcacatcttacccaatctgcatcaaaatgttccatgatcatacacacttttgcaaagcatccaggctaaatccttcatgtaaatgtcaaactttctcataaacatcccctcacaagtcaattgattctgacaagtcaatgcaagtgaagaatggagtcacactgcattatatttaagttctaaataggcgttaatgaaagatatctagagtttcctaaaaggaacaattaactattgctatgaattattttaaattattgtacttagaagtttggtataacattgaaatgcttaaaacctgagtaattttgatatatcaatcctgtagtcactaacctactggattaacgccctgttgatatgtaaattactaacttcgtgaggttttcaaagtgattattatgccaacatttcaactggagcagtaagtaccaccaataaacataagctgtatgctggctattgtgcattatttaatcttcacaccaatcttaagggttataagaattctcagtttcaaaatgaccattataattcccattttacagataaaaaacatcatggagccaatatttgaacctagacattcaagaacccctgctttttacctatattgtgggctacaggtgattcttcttaagaatgatgggctgtactttctgtattatctacaaacagtgactggccatggtcacctatttatgataaggctaatctgaattaggtgttttagtctgagattactggaatctcagagtgaatatgtcctggaaaccgaagcaggcaaaaggattgagaattccaatcatgcttttgtttaaattttgaaaatattaaatctataacaagatacactatgattttgagttaaataacctcaattacaagcattaaggactataagtgatctatcagtgtggttttaacctttctctgcctctacatatcagccaatgacctaccataattagtatcagtggccaacattgtaattgagattctcaaggtgaagagagagaaatgctctctcttccttcaaggggcccatcaaaagggctttaggtacagatcaaagctcctggtgtggctttaaagacctctctccttcccccgggaagcacgttctctcaccctcaaggtttgagaatttttgatgtacagaaagataataaataataacacttattgagtgatttctaagccaggcactgttctaaggacacactcaatcttacaatttatgaactatattagtattcccattttatgcatgaagaaagtgaggctcagataatttaaggaacttacccacagtcacacatctaaaaatggtagagcctggctctgaactcagaaaatctgattctaaagacggaacacttaaccactgtactatattacccctaactagtccactggaataactacataattataagaaaatcatcaaagcaaatgtgaaaactgttctagctgataatgcagttgctctgccagggtctcaagaaggaaaatttctttcataaatataggaacaatctaagatgaaccctggcttataaaactatagtttaggccttcggcactctctccctctctctaattttttcataattttaccttgctcgaaataactagactaactagtcttgattgtgcccaagtgtcacagtgccactgttgtagaaatcaatttactctagcacatgcttcgctttctttttagaatttaatttttctattcattaaaaatgatatattaagatgacatatttattttaaaaacatgtaaaggcaataacatatgaatgaagaaattatgactaaattcagtgacacagatttgaatctcataaatataatatttcacaaaagaagccagatgcatagaatacaaactgtatgactaaatttatataaagtgaaaaaccaggcaatctgacctatggtattaccatttaggacagtggctacccttggaatgaggtacaaggtagcttccagggctctgttgccatcttgtttcttgatctggtaaatggcaacacaaatgtttcatttttggaaattcactgagctttacaattatgttttgtgtactttcacactatatacgcttcaatacaagagtttacattaaaagcaagtattcttcatccaaaattcccattttgttaactttagtactaccttctctctcctaaaaggatgagatttattatttcataaataaagctaacaatatctctacataagatggtaatgttatataggaaatattttatgagatattttaaaagtcaggttgattgaagtataatttatatacagtaaaacatacagttctataatttttgataagcacatgcttttgtacaaccatcgccatgatcaagatagaagaatagttccattatctcctcaaattatctccttcccttttccagtcaaccttatcctccgatctccagctcttggcaacatttctgtcctgatggtttcaccttttccagaatgccatgtgaatggaatcatgcagtatgtattttttttaagtctggtttctttcacttggtgtaatatatttgagatccatccatggtgttgggtgtatcagcagtttgttcctttttattctattgctcagtagtgttacaatatatagatatgccacaactgaagaacatttgagtagtttccaattttgggtgattatgaaaaagccactacaaacattagtacataggtttttgtgtgggaatgagtcttacgttttgtttttaaattccaagttatacttttacctgcacaaaatattttctatattgcctttatgttaattcttatacctagagaatatgccaaccacttaaaaataatataaaatcagaaattgaattaaattaaataataaacttctgcaaattccttacttataaatatttttgtaatcatctattgaattaagagcaaaaaatattctattaaaggtatatattaataactcaaaatcctgtttagactacacaaattaaaaatcgaggccgggcacagtggctcacacttgtaatcccagtactttgggaggccgaggcaggcagattgcctgaggtcaggagtttgagaccagcctggccaacatggtgaaaacccatctctactaaaaatacaaaaattagccaggcatggtggtgggcacttgtaatcccagctactcgggaggctgaggcaggagaatcacttgaacccaggaggtggaggttgcagtgagccaagatcatgccattgcactccagcctgggcaacagagtgagactcggtctccaaaaaaaaaaaaaagaaatcgatggtgttactaactgggactcttgtatcacaatgaatgaaggaaaaagaagtaagaaagttggcttgagaaggaaagtgttttatgcctctttcaaaactttccaatttgatatattatgagttacaatatattataaatttaacccaactggttagtactttttgttcatgataactaggaaaggatttgagcgacaaaatggaaacatggtagatgttacctagcatgttgtggtaaagtggaatggcccgtccatgggtagtaaatgcagtcatgactagtgggaccgttacacctgcaggcaattacagaacagaaaacatcattctccatccacagtgacatgcacacacatgcaccagtgctcacacatggagccttggaggaagaacatgggaagcaagcacaccaagtacctatccatcaggccgatgcagtcttcaatacttgagcctatgcacctgcagaaaatgcaaatttaaaaaaatacaaggggaaaaaattagtcatttaaaaaatcagtaaaataaatattgattgtctcgaattcttataactattagactattttggaacacaatgaatttcaagccaggaagatttttgcttgatgaatacacagaaatgaattgccattatcaactaagtgggatgcaaagaaatgtccaaagtaaaaggaaattttacactggttctgtgaataacttccaaacgcacagctcacttctaatactttgaactgatatgcatcatacatgattacatgtctcaacaaatatgttgatatttcaatgactataattgttttcttgtgtatggtttcttcttaaaggccttaagtttaaataaaaaaaaaacaataagaaaaccatgagcaatccaatatcatataataacctgatgctcaatgctcattaaaggttgattttggcagaaaatgagtcaacatgctttaatgctattctcatggatactttacataatcacattattctgattcttggttgtgcctgtctttaaaagatacttatcttaaacatgaatttattttaaaagaaaattaactggtttcaccatactgcagtttctcttgacactgtcttttaaaatagcaatgccataacaggtaaacaaaaacaagtttttaaactaccataataatgaacgcaaacaataacagataaatatatactatgtaaggaaatgaattacctttgagacccagttaagtaaagaatacagtgagactaacatttaaatggaattacataagtacacagaattctaatgtgcagtccctagaatttcattttgaaccaatatagaattattatttctttcatcttccaatatactcgaactctttatcttttccttttctcccatcaaagacatacagctccagaacattatcaagatcctttttatagttaggatttatagaagtgccttatttcgctggtaataaagattacatatatttccaaacttttaattttcaaatttgaaaaagcagcttaagataggatcatcatacaatgatgtaaaaaggtgccaatgtataaggccagtctatccattatatatttaaataactctaaacattggtgaactaatataatatacctataataccaattaagtcacttatctctctgtctcataaacatttgttataacattcctgctagcttaaaaattgatttttgtttttgtttggagtagcgcagacaaattttaatctatagaaatagagagaatacacctgtatgaaaagtcttttaaaaagcaactaaaaaggaaaaaaactagagtacatagcattaaattagtattatatataatctatagtcaaaatcatttctaaaaatggaaaattaactactaaaaaagcttccaatttgtcttatatagttttcttttcattatattccaaataacttgttttttcctaagttcctgctctatcttcttgaaaattatttttatgccatattatcattttgtaaaattaaaagtctgcttatcagttccaagtgagaatctaaaaagctatggctagtttgcaatccatctttataacaacccttgaaagattaaaaaaaattcaaaactaaaatttaacttgagggaaaagtgtgaatatgaaagatactcattcattaaaaaaagcactgtgttacatgtctactaagtgttcctagtattctaggagctagagggagaaaaaaagatgaattagacatttttctgttctcaatgagctatgaatttaatgaaggagacagatgcataaacagatgtgtattgaataatgtgataaatgtaataagaaacatgaaaaagtggttcatggtagtgtggagggcagacacctagagccaacctagaagggcatgataaccctcttaggggaggtaagaagctgaaatttagagttctgcaaactggggttggggtggcggtggcttctgcaggagcaaaagcacagacctgaagaaatgtattgtatatacaaaacaactacaaataattcttagtagttggagagcaaaacatgaggcaataggaagaggggaaaaaagaagttagaacattaggtgggagccagattttgagaaatatttgcttagtaacaatcaataaaaaatcactgtagggctttaaagaagtagtgaagttgctagattagtattttcagtaaatctcctagctctgtggatactagtcagctggcagccaggccgactcatttggcacaaagactattttagtccacgtaagagatgatggaccaaactagggaaatggtaactgtgttggaggcagaagaacagattcaagaaatacctcaaaagatagagggaataaaaaagagcagttgattcatgaaagtgaaatgatcaaaggagttaaagaagacttacatttctagctttgctaatagtggtactatccttgagagaatccaagaagatgaatatgtttcttcctgtatgtgttaggggatgaggagttgataatttcagttttgtgtatctagaatttagtatggctgtcctacatctaggtagaaatgtttatcagcagttggaaagatgagtggttaacggggaaagaaggcatgagtataatgatcaatcttgaaatagcatgtaggagaaagttgaaaccatgtaagtgaatagatggctaaagaagatataaaaagtaagaaaagcagaggctgaagatggaaacccaaggaaccccaacagtatatgacataagatgagttctttgtgccagaagcatgggaaaatataattgagtaaaaccaattaactgtagtctcatggaagtcaaatcagaaaagaacttcaagaaagaggcggtgatcatcagtgtgaaaggcagagaagtctggtaaaataactcttaagataattttacttgtcattgtcatggtcactagaatttaggtttttgtgagttgagaagcaaattggagatagaaaaatagaggctggggaaagagcggggagggactgagggagcaggatgtagggtcaagaaaagttgttgaggggattgtgtaggatatttgagattcaaacctatttttaaactgagaatgaaagaaaaaaatgaaagacaaagaaaaataagagtatgactgaagtggcaccattctttctaaatacaagccgctgaaaactaaaatatgtatattgtttttcaactctttgtattttctgtaagcaactaattagtatatgcaatttgcatccattcagccagatcacagaacaacagaaacacaaaacttttgaagagccaaaatcacaaataaataactgaatcaaaatctagaatagtagaattataaaaaaaagtgtttcaaagtggaatacttatagaaaattagaaaaataaaacacatgtctaattaacaaattccaaaacaatatctaaagttctgaatattaaactgtgtttaacctttgttagtactaatgacttataagttccttgatgtactcatttaaccaacatagtttagatattttgataaaatctttaaattttgaaataaaaatgaaggaaatttttaaaaattctccattaaaagattatagacaaaacttccacaagcagcccttctttccctctcttgatgtataaaaattatttcattatatcagtttaagaatattttaaaaatggataaaaagattaaggtacggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctactcgggaggctgaggcaggagaatggcgtgaacccgggaggcggagcttgcagtgagccgagatcccgccactgcactccagcctgggcgacagagcgggactccgtctcaaaaaaaaaaaaaaaaaaaaaaaaaaaaaaaaaaaaaaaaaaaagattaaggtacatgtgacatttaataatataaaatcattattctaatatcaacaaaaacatgcaatgagatttttaaaaagatgttccataaaataaccatttcattccaagtctaaaatgcaggtttggtttgatacaaaaccaaagttaaacggacattaaatgagcacatactcaagtgatattagtgaggaaaaaaatcatccttgccctccccacaatttaattacattggttaagtttacaaatctttaaaaaaattctatcttgctaatttcaaatctgaacatcattcctaagttttaaattcttgcttatcatttcaaaatactgtggagaagggtctggtctctaacagaggatataaattaaataatataaatttactggactgtgagttcattgaggtcagaagctgtgtcttgttcatttctgaattttcctatcactgtatgtgatgcagagcagatatccaatatacaaagctgaagagtgaataaactaagaaaaggctgttaaaataaaaattatctagtcaaggtaagaagagacaaacttgttgttttcatggatattagtgagaatcttctgataaggagtaaatagatgacctattttaaaagtgtctagagagcttgttagagccattatatttaatgtacttttagagtagtaaaagtgcttttaaagtatgacacaggtaactttattttcagaaaaatcattaaacagtattcaaagtaagaactttaattctaaaaaatgtggtttgaaagactattttcattaatgtggttcttgaattatctgacatcatataggcatataaaagaaaaggtgttttccaaagtagaactggcctggtgagctcacacttactgataggtcgattattacatgtgtttaggaataaaaatagttacttgctccatcatcctcactgcccctgtggttttcccaggaaaatatcatatctctatatgctcaatttggaaagaagggactgactgcacagaacaccttattgcttcagtaaaatatctcaaagcataatgttgaactgcaatagaatttatatgaggatttaggaatttaggaatcacatccttcaggaattcctgggactagaatactctgggactagaaccacagcatttttatgaagtgagtgaatctggacaatatgaaggtgttttaaaaacaggatggcagaaagctaaatgaaaacagagacaaaaatccttcaggattaagtcagtcattagagaatgcatttaccttggaagatgccagggagtacaatattcaaattctgtctcaacttaattctgcggctgcaaattgctaaaggtgtcttttttctgttcacttggagttcccaaatgctctggtgagatttcttccccattacaccttcatccttccttttgactgagatccagattttgttgctaccataaactaatctcttttcattgcctcatatttctacttcccccactatatatgtttattattattatataataatgatttaaaagggcagagaggaagacacaccagccatgcatccagactatggctctgtgatctcactttcatttctctaatggcctcattgtaattagatttgcaaaaacagcaaaaggtctcattttgaatggcaacagctgttgacatcaacattatattgaataatttactggtttaattttagctgcaaaacaataaaattctcttgtggatgattttagcaggcaaagttttctctttctgttgctgactctttcttctgctccagcagaaccagttgtttttttttgtgaaatactcttaactcaagtatgccaaaaactcacaaggggagcagtttattacctctagtttccttgaagcaaagtgtctatgtgactatttcagtaccctaaatgtatacgtgcttatatgtgaaccaatgaattggcaattaccacttccaaggtgaatttgaatttgaatggcagaatattactttaccttttgaggatctgtcacttcacagagtgagttaagcttatttcttgacctgcaggaaattgtagcaacatctgcaaattgatgttttcttggcaggaaatgatgtcgcttgcttaatttcttcagtatcccccaacagctatcccttaatctgacagaaaatctgtttatggaatctcacactttcctgccagatataaagtacccaagctgattctcaactacaaatgtgtgtgtgtgtgtgtgtgtgtgtgtgtctgtatgcgtctgtgtgtgtgtgtttatatgtgtatgtgcacatgcctataggcattcacaatggagaaaaggctttatgggcagtaggaggatggcaaatgtaacactgctttcaattacaaattattcaccttccggaggaatgaaaaggaaaaatccttactaaaatagacttgttgtctcttaagaaatacttgttggaatttgttagatgaatgacattatttcttttacagttcagtgcttttcttctttctgtaatgtgtctttgttattcaactgttatcaatatcaaaggtaatctaattattattcattgcacaatgtattcttttgaaaaagagaaaaaaaatttaccaagcttcagattgccctatatcagtcaaagaaattcaaggctaaaggattacctgtaacaaggttactttcacaaaatgtactcattttttaaatatacatatcactaggttccctttttccctgccattgttacctttgttcatattttttgaaggagtaatttaaggtagtatttatcaaagagaaatatcctcaccttaagcttattgtgacaacaaagaaacagaaatagaaaacttcctttaaagatttgataaacacaaacctcaaaagcatgattactgtcctatcttttctgagatcttgaatctccaatataatttcgaagaatttctaaactgcatccaaagtatacctgacactagctagcttcatgaaggtgttaatagaatggttataggtaaaatctaagcagaaatatttaagggtgtacaaagttgattccataaatcattctctcagtatttctcttaaaatcagcattttaaatataaggattagtagagttctatgagaatggtatacatttcagagatggtaccagggataaagatacatgtggataacacataccaggtgagcccttggccagcaagaatgcttacccttgggtgcagtttggatggcatgggtggcactcccgatctggatcagcatacttgaaaatgaaactgtttgccccctgtaagccatctggacatttttccacacagtttgggccatctttaaaatgagagcactttgtacagttgtcaggaccctgaaatgtgaaaacgaaaaaaaaagaaaaaagaaaagtggtgtcatttcctctggaatgtattcatgtggtttagttactgagacttcagtaggtggcaaatcttcctctaagagaattggagaacattttcagcagtgcaaatgtggatgtaatttttgtagtacaaacagtgcaaagaagatccatcaagttcagttttgatatcctgtatgtgtgaaaacactataataatgtatttgtgcttgaaatattttccttttcgacataagcagttcctgggccaactgatttccatgtcatgactctaatgtgacttaatttgatcagcaaaactgtccaatgactttctcaaaaggatgtcagtattttcttcttgtgatttatttctggcaatattatagtgcagcaatttttagtaaaacacattttccctagaggtatttcatcaccaccactgggaatatgtgaatacttttactaaatagttaatgagaaaagggatataatagaaattaactaaaactgaatttcatataagagtaggatgtaaactttcctttggttgtacaatgactttatttataaaatgaattttaaaatttgttatgataacattatcaggaattaggccgtttaggtgaataaaaataattcctagatttttctttatttcatatccactgtgaaaacactaaaagtcatattatgtctatttatagggattttagtaaatcacagaacaatactgaaagccatataaatgcacattttgatgagcaaaatagtccataataataaagcaaatacatacaaacaaaggcttcatgaagaaacttatccaaggatgaagataatataaatatgagtataataaatgcaaatagaacaaactcattctatatatttatgtttataatacacattaactttctaatatgtggaatgttaataagtgataatgatatgaaaatatatctaaaagtcatgacaatattaagatgttcaaactaaaacatatatgaattttacagaatacaaactgatttggatctggtataatggatggaaagcatactagaaatgggtatatcgtcagagcaaagaaaatttagaacactttggtaaatgctatctttcttaaaagacttccccgatgctttcatacattcagctgttctggacaacagctacctgaaatgtacttttacatctcctttttggacaccatattgtcttaaaattcctctcctctttgaccactcccctttggaacttcttcccctgacccatttctccctaaaatctggctatgtccatagggttcaacaatcattatagttcacatggaaaacaacttaaataaataagatatagtaagcatacagagagacaattctatcacatttgtagttataaacaatgagaatttggcagtcaggagttaacactaagttataaagaactagatattaggtagggattgtaaagataatgggagtaccttatatcctaaaccaggagtgtccagtgttttggcttccctgggtcacattggaagaagaattgtcttgggccacacataaaatacactaacactaatgacacctgatgagccaaaaaaaaaaaaattgcaaaaaaactcatagtgttttaagaaagtttacgaatttgtggtgggccacactcaaagctgtcctgggtgcatgtggccaatgggctgcaggttgggaaagcttgtcctacacaaatgttaatccaagagcagctagatattacaaattggttacttaaggcatcagaaaatcgagaaatacaatattttaaaatttaaaaatggaggcgtgtgaatagaagtataaagaagaaaaagtaatcaggaagagctttcaggaaatcctgagactggtggggctcaatcaagcccttgtctatttcactattttgctgtgaggctcagagctcgaaaaaaaaaaaaaaagcctataaaacctaatcctgattctacctgaggagtttgctaatggtaacttcttatttcttcccaaaaaagaatacttcacatccttccaattttaacacctgcttatgggtacttaggcacgtaatattgtctattacacagaatcatttactgtgcaagtatgctcagtaccatgacttattgtacaagacaagagacatgctgatgtcttcttgcagcacacagaataaaacctacaatgagtaaattaggcagagtctgaattaagaattaggaattattcttctaagtaatgtaaatgtatttttcttataatgtaaaatcatgtctgggtgaagtcaaaagatataaagttgtaaaagtaaaatcaagttcatatttaatatttaagtatactgtaataagataaataactttttgttctttgttttttaagcatctcttaactatagtcatgtgacacttaatgaccgggatatattctgagcaatgcatcattaggtgatttcatcattgcgcagatatcacatagtgtacctacacaaacctgtatggtgtagcctactttatacctaggccatatggtatagccttttgctcctggactacaaactgcacagcatattactgtactgaatattttaggcagtagtaatacaataataagcatgtgtgtatctaaacatatctaaatgtagaaagggtacagtaaaggcagatattataattttatggtaacaccattgcatatgtccatcactaactgaaatgttgttatgaagtgcatgactgtatttgattgtattatcatgatagaaaacctaatgtcccaggctgacataactaaaaatgtcctggcaaatctcagaaaaagaaacatactgattccccatctcatttccataataaagagacttaaagaaatatacctgtgtctaatgtttactcttctttcattatattcccaaaggctttaagaaccgaggcacaataaatgaattgatcagtgcaataatagaaaatgaaggtcaaggcaatattcttccttatccctatttctaaactacctctggagtcaataatctagacagacaactaaaggataggctgaatccttatagaagcatgacttttttttttgagtcgtcattgatgtttttctctggtagctactgtaaaagacatatttattattcaccagtgaccaattatcttctattccagtcacatgagaacattataattctcctcccaccagagataagatatggcttaatttgcacaatggaatataactagaggtgactatgagataactagtgcttaagtctccagccttctctctctggtgccatgactcacagaccccatgtagaagtggaagtgccataaattaaaagcatccctgaatggtagaccataacagggaggctcgctgccttagaacatttcccagatttccagtgtactttacaagatggatgggtgtggtggctcacatctttaatcccagcactttgggaggcctaggtgggcagatcacttgaggccagcagttcaagaccaacctgggcaacatggtgaaaccccatctctacaaaaaatataaaaattagccaggcatggtgacacatgtctgtaaacccagctactcaggaggctgaggcatgagactcgtttgtgcccaggaagcagaggttgccgtgagctgagatcacgccactgcactacagtctgggcgacagagtgagtctcaaaaaaaaaaaaaaaaaaaaaagaaaaaagaaaaaagcaaaaaacaactatgtactttacatgaaaaaaaaagaacttaaacttatttatgtaagctactgcaatatggaggttatttgttacagcagcacaacctttattaacctaaatttaacagtgttttcacttttataggaatgtatttcaaaatcagttcccttactattttttctcttcttttgctgcctctctagcctaagttttggtctcctgaaactgtctgatttcccaggcttgtctttcttctcatatttcctcctatacctttctggataggactgcctaaaagtaatgaaagtaaagcagagtgaataaaattataaaaaattaaataaaatatagaagaccaagtgtggacagacaaggacataagcgcaaaggccttcttttatttccaatctatcccttgcaagattaccgtaaatttctgtcatttttaagtaggattatattatctcattttacttatagctatcatagtccctgaaagcattttatccctattgcactgaagacattgtttcctgggggacaaaaaactgagatgtacgagaaatttacagtcagaacttctatagttgagtcacagtttcatatcctactgacgtgctgacttttggagtaactttctaatcattattggttaactttctttatattttaaagggagaaagtgatagcatgcttcagatgtaacagtgtttggtaaacataagtatatatcagtttttgtcattggggaaatattcatagatcaaaaaatgtgatttcaacagaatatatcataagatcaggaatgggatttccaaatggctttgatgacttcttcctcaatttcatcaaaacgccagtctaatggagaagcttccagaacctcttggatatcttaaatgatagatgactgttatctggcacacaaaaccatctctgactctagttgtggtcattaacatgtgggcccagaaacaggcaaaaacctaatatgaatcattaagggttgaaagaaaccaaaccatagtgggagcaatgtttgggccactggttgagctcagccatgccagtttttcaggcaccgttactgaaagatgtcgtgttcttacctgcttagcattcaaagattactgattctttaactataaataattttaaaaatcaacttttggagttctaaaaatgtatatttttataaccatctcaagttttttgaggaacaatgagtaaacaaactgcaaaaacccacaaattaggagaaattaatgaatgagttattcactagcacaattttatgcaacaggaggcatcatgaagaagagaaaaagcatggaactgataagcacattgagactggatggtaaaattgtgattccaaaggtctcaatactacagaacaattcatttaagtacattgagcaattcatttaacatctctgagattatttcctcattggaaaaatgggagtaatacctacaagacaataaaataaaatgtaggtgcaaatacctagcacagaactagctcacaaaaggccctcagtaatgtatgttaaatcattaatataaatatgatccaagataatcagattaattctgacttgattcataggtaaagtggtcactgaacttttttctcacctgaaaactaataaaggcatactgaagggacagttgttgaagtctctccttagtgaaggttagactttgctacagatggtaagcgaacatcaagttttcagacatgggattttttttatgaaattagaaaaaaatatggtgtcttactatgcaacatttaagcagattagttttttgtctataggattaggtgaactaaaagtattagttcataaatatatttgatttttctgaaaagtcacaattgcaagaaaggccaaaatattattacttgaatgtattttcattatacagtatacaatagatgaagaaaagataatgtgaaaaaattaaaatatgcaaataatgcaacttcttaatttttgagaaataattttgaatattaatgtttgaattttctaatatttaaaaacctaacaatatgtatactcatgaagcctggcacaaactaggtactaaataatatttgctgaataaatgaataagatgtttcttaaagccttgctcaaactaaaaaggttaagagaaagaaataggaaattacatgtgtgaagaaaaaaaactaatctagaaaattgtaataagatatttataggaaatatcagtgcagtggcacctgtagtgattcacaaatgaaacattaggcaagttttggcagttgctcataattttttgaaaagtgtttctgtaaatctatgtctaatatatattatgattggatctagagggcctatgatgattcccagcctattcagatgagagggccaaatccttgattattttaattatacattttgaaaagtttcagtctctcagaaagagattttttcattccatgattaatagtcaagaagttacctaaatatgttcttttttaaagactcatacagatatcccaacctgccttaacaagccattacagaaatgcacttccctgtgtttcatgacattctttacagaattcatatttctcacactgttagttaattgtatttttcatgactgtccataatggagaaagaaaatagctgcaaatgccctttgcatagttacttggagatcattacatattaaattgccttttacactttggttcttcacaccaagcaacaccacttctttttctcagaggtctaattttccaagctaatcatccttgtggtcgtcctctgaactggccaatttttccacatctttctttagataaagttccagagcagctcactggggcctaatggaagtctggagggctcaatgatatatatattttttctaagctaattaagtgctgaataagcattctggtataaaaattaatactatttaaattttcaatgaaattgtacagagcaatgtgaagctcttgtctacattcaaatgttggtctcaaattatccattgagagaggattcaataacacagataaactggaaatttgtctaaagaaggatgaaaatgatacttaggaatgaaaaatttatactgatctcattattaagaaaaactcaaatgatggaaaccaaagagaggtctaaaaaataattataattttctctctgaggctaacttcaaactatgtaaatgagacctcatccatgagaactttcctaatcctataacccctccttggattctcatagctcaattcttccctctgccatagtatttattgcactgctttagattttagtttatgagtacttgtctccttctttccactgtctttcacagtgccacaacagttaaaggattaaatgcatataaaaatgtgtgatagctttcctcaaatacaacatgaacttttacatttgcatatgtttatatgtttcttctttccagattattcttcaaagcatagctccagcatcacttctctatagcctatcttgatgtctcaatttccatcccaaagacagaattagtttttccttcatttgtgtttctataacaatttataaatatttttattatgttagtgattatgcttcaatctaattattcttttctatactgtgcaatagtccaggactactctatatcttataattccatttaactattttatattttatctggagaataaatatgtatgacatcgactttttaactattttatctctactactaaactttaagcctcttgtaggcagataaacatgtttccccatggcatcctgtaagtagctattgaatggatgaataaatgataaaataataacaaacattcatacatgatactaaataagccaacacaccacagatgtcttcaggcttaccggtccatggcatgtgaggaggccatcttccatcttctcacactgggggtcacactccacacagatggagccattctcaaactcccgaaattcactgtgaaaacatcagccacatgaggaggtgtaagcaaacaagcgtcaacttaacaaatgaagtaacatctgctaaaagtcctattggcagagtaaattctaaagtttgtttctctatgtgccaggagcatcagaaacattaagttttccattaggagaaaagataaactgcagccagatggctctccctgtcctccattgagttcaatgttagactcattctggaaacctctctcctgcaagacatattccagcaatctcaaaaaaaaaaaaagctacaaagtataactcttctgatgacacagtaaaaccatttttacctttttaaatagggctgtgcctgttttgtctttatatacaattttactcttggagaagcttttatttctaaactctgaaagaactattgtatttttcttgttgctaagttacatgaatgttcccaatccttgtccttcaaatcccaagactcttcaatttatttttggtgaaatttcaaaaactactttgattcctcttctccttttaaaatatctgccttggagaattagagaaaacatctttttatggtagatttcattttcttatattattgatctaatatcacaacatctttttgtagtctaaattctttttgaagtaattctataggtatacaataaaagacacagtttaatggtaacatcctaaaactttctaattgaaatctcctgggatggtggtcatcccttcctatatccttacatttttgtggctatttgtatattacatgttatcaacttatgaattttacaatcaatgtctatggcaaaattattatatcaataattagatatcagtcatctataatatgttaaaccaccccatcccactaaaatacaggaggataaagtactgagtacagacaatttaaaatgccatttacaaatcattaataaaatttgacgatgtttagctattttattattttgtgcttttgtgtcctgtgttactactccacaccaatagcattacagagatggcaatttttgattcattaagtgatacattaaaatatatttttacctaaagtgaagcattcacttttttctcatttgaatactgtaaagccttaataaatgaaagaagtacaatgatgagctatcttttctgccggttagtttaagactacatctattccaaggcaaaataattaagtttggttttccaaatgaatagcataaatagatggcttaattatgtatgaaatgcacatatattgagttacatggattatgcattttataaagtgagatagcagtttgttatggatcaaaccttttataaattttcttaattttaaaatcacaattacataaagacaggtgatcttttgcatgcttcactgacataaagcatacaaagtactcaacaaaggaaaccttcagaatataaaagtccaaatgaattggtatgggagggtagtaaaattataaaaataatcaaaagcattgtttgcataacaaaattatgacaattatagcacacttgagattatccactggttttggataatagtttcttgggtgattaaaagtttatggtactaaatgagggttgtagttttcatattactagaacaaaggtcacgtttttcttattcttcttctccaaaacccacttccccacacgcagagttgaggaataaaatgtatgtcataaaacaatcatggagatggcctattgcccttttcttccatagatttccatttgacaggcttctgatttttcctgctctcagaaaagatcctcctggcaatctctattacttcttctgccctttattgtgactttctccataatttctctttttctttcctgtcctctagtgattctattgtgactttgccagagtcaccctttcacttgaatcagatttaacaatttatagtctattaagtatgagctttggatagggagctttgttcccttggttttgctatgaaacatttctcacagttttgttgtatgtgttaacttagcaagtcctgtgatcaagagtgaatactctgggatctagtttttccaaatctaaaccccaggactgacactactatttctaggccttaaatacttcaacttccttaagcctcattttttaaaatatcctctgtaaaaggaaaaaataagatttcattgagaagctgcaattataaaatgtaaaaagacttagaaggagcttagtctggttccctctttgatgtttctgtgttgttcttaaactttcacaagagtttaagcatgttgacagatatgggaagttctaaagttccattgcagttacctatctttttcatttttattgcttgagcattgtagttaagagttgttgaaatacagtgatttatatgacatggatttgaatgctaatcagccagtaattgactgattttcatttttcccttcaaaaagtcctctttttaggatttcttctcttctggagccacattttttaacatatatatatttaatataatatatatataaaatataatattatatatatatatatataacaaataggctccctggattttggtaaatgtcatatttatatttgattactttcagtagtttcaaaaatggccattctatttaaccatttaatcaactcagataaatagacgaaaaagaaaataatgataacatttatggtagaaactccaacaagatcttacgcattttctcatttgataatcacaactgtcctataaagttaacaccactattattcccaattttcacataagaaaaccaatttagaatgatgagatcgtttgcccaagtttggatgtttcaactaggaagcaatgaagttgggatataaactggttcttcctcaaaggctatcataaccatcagccaatgttgaaagaaactagcccataccacaagatggaaggtgggcaatccatcactgggcaggcaagaattgcaccagtcttttacaagatacgtaagttgatcatctttcaaactagccccatgcttatggtttcctggggtgccataattactgcaaaatacattaaaaactaagttaatttaacagatttgattttataatgtaaatatgaaatatgctaaatataaaaaacagtgtggtaatcagtgtttcctcaggaaacctgtatttttcttttggttagctttcattgtttttgtagaaatgagatagaaactggtgtatacatacacatgtttataaatttcatatttctgaaaagctaaaaactgtaatattaaataaaaacaatggtgttctgggaaaaaaacaaacaaacaaaaaatcaagatgaaaaatcagataccttacgttctagcattggcttgagtcctatatagtgttgcgagttcagcccatacttaattaaaccagttccctatatttataagatgctgctattacacaaaatgatttctataatttcctctttagtattgcacatatatattcaataaacttttaatgtaatattcacttaatgaaattagtctattgtgtttcattttaatttattagtctattgtgttttgtttcatttatcaattgctgaatgcaaaagcaagcatattttgatctgaggtattttatgttcataatattgggaacaagcataaatatgattcaatgagacaagcagcaaataatttccaattcatttccaaattacaagccaaagttacctcacaaaattaaatgctaaaattttcctgaaaaatgattaaattcttatttaaaattttttatacttatgcttctaatattaatattttcccttatattttatggatggaattggttttggacatcttgcaaagaagagacatgtcaatatcattatgatctatatatttttatttttctcgtgtaaaatgcaaaattccaatgttatttattggatccagtgggataattcatgaggcacatgaggaaatgaaagaacttcaaaactatactttccaaaactattgaaaatactttcaggccgggtgcagtggctcatacctgtaatcccagcactttgggaggccgaggcaggcagatcacctgaggtcaggagttcgagactagcctgaccaacatggagaaaccctgtctctactaaaaatacaaaattagcccggcatggtggcgggcacctgtaatcccagctacttggaggctgaggcacgagaattgcttgaacctgggaggtggaggttgtggtgagctgagatcaggccattgcactccagcctgggcaacaggagcaaaacttagactcaaaaaaaataaattaaaaaaaaaaaaagaggccaggcgcagtggcttacgcctgtaatcccagcactttgggaggctgaggcaggtggatcacgaggtcaggagatcgagaccatcctggctaacacagtgaaaccccgtctctaccaaaaatacaaaaaattagccgggcgtggtggcgggcgcctgtagtcccagctactcgggaggctgaggcaggagaatggcatgaacctgggtggtggagcttgcagtgagtcgagatcgcaccactgcgctctagccaggcaacagagccagactccgtttcaaaataaaaataaaagtaaaaataaaaataaaaataaagaaagaaaatactttcagtgagcaacataagaaaatttgacttaggagcagtactaaaaatacattataacattgatgaaggacaagaatgatgcatcaaatagtatgttatgataaagtgattttatgaatatatgaaatattatgcaaccaggtacttactagcttctactactggtaatgttattattgaaataccagataaaattaaaaatacttaatttaaaatactgcttagattatctaaaacctggcagaacactttcaaaaccacttcaaatagaaactacagtggtagtttttctattgggctaagcacttgtcaaagacagaaacaagccattcctatatacaaatagacataaaagtgagtagaaaaaacaaacaaacaaaaaaaaacaaacaaacaaaaaaaaaaaaacaagaaaacttgcactccagatgaaatttatagagaagtatgagaggaaaataaaaaatattattgggatacatggagaggaagattacttataacaatccccttcataaagaaaactggaatatatttctcaattttgcttaactgtaaattgctataataagaattgtctgagtatgtttttaaaaatgcatacaatagtaaactatgtatttgaactcataatttcaaataaaattatttttccttaaaagaattcgtctatgtgttgtctcctttatgcaacaagagctctccttaaaaatcctggcctgcattttaccattttcttataattttaaaaatcagagctaggccaggtgcagtggctcacgcctgtaatcccagcactttgggaggccaaggcaggcggatcactaggttaggagttcgagaccatcctggctaacacggtgaaaccccgtctctactaaaaaatacaaaaaattagccgggcatggtggcgggcgcctgtaatcccagctacttgggaggccaaggcaggagaatggcgtgaacccaggaggcggagcttgcagtgagccgagatcgtgccgctgcactccagccagggcgacagagcgagactccgtctcaaaaaaaaaaaaaaaaaaaaaaaaatcagaactaatcagtccttcaaagctcatgaggtgaaggcaaccctagaagaagccttacccatcatagaggttacaagactctatgcagatccttcctctactgaagcggcgacacgacagacattggtctggcccaggtccccaacagccatcactggaacacagatggttgcacaccattccttcagcagctgtgaaacaccaaaatcaaggggaaataaaacagaggattgtgtcaaaacttaaaatcttcctaggtaatgctatttctaaaggagttcacttaaaagagatatatggcaaatgactttggtggcctatcccatcgtcatgtcccatcctacccacaacttcttctatattgcagagtcctagtagctgtgtttgtacagcaatcttgcatttttcataaggttaaacaaaagtgaattgcctatataaaaactattgggaggacaggtgatataaattatctgtccaagctaaagaataaaccacacttctctcaagccaatgctttgctccactaataaataaaatattttggcttctcagtttgagagcttcatgaagaaatagaaaacaatattgtcctgaaacaaaaaaagtattaaaagaggaagagaaagaaaaagaataatttatagagggtaagaaggggagaaaggaatagaaataaaacacaagttttctcgtttgtttttttgagacagtcttgctttgtcacccagatccaagtgcagtggcatgatcttggctcactgcaacctccacctcccgggtttaagcaattctcctgcctcagcctcctgagtagctgggattacaggctcacactaccacgcccagataatttttgtatttttagtagaaacagggtttcaccatgttggccaggctggtcttaaactcctgacctcaagtgatccactcacctcagcctcccaaagtgctgggattacagtcgtgaggcactgcgccaaccaaaatataagttttctacaggaccctgctgtattctggctaggtctaccttgctattagtcaagtcatcacatgtaaggaagaagttttgaaagaatattcagcaaattacagtgattatttatgcagaagtgtagagattaaagcagtaacaatagtctttagtgttatctctatgttatctctattttttgttgttgttgatggcagaagggccaaataatttttaaatttccacttaaggctaaccatctttgtttccctttatactgaatatcttttattcaggatattattatttatactgcatgacattattttagtgacgggagatttgatattgataagaagagccataaatacttcaaatgttatcctgagtgtctgaaagtgatttgaggtatttgaaacacaacttcatgtggttttcatgaaataataattctaaagaagattaaaacatcaaaatcaactttatctttccattagttaccaactttacttattatgagatgtaaaattttatggcaagaacatttgcgaggtgggttgggatggcactgaatatggtagtgtaatataagcagggaagtctatctgtgaaatctgtgaaagttaacttctctaacatatgcttgacagagcaaatcgcccacacctgtgatcctgactagttctgaaacagcgaaacaaatattccaattcatattttctttgttctatatcctggggttattaaaaaggcccctatggtaaactgtgtaaaaattttttaaagcagacttagatctatcaacaaatcttgctacttcttgaataatctctttcagcatagtttaagagagaaatgtgtgtgtatctgtgtctgtgtgcagcagttttattgaagtatacatagcatacaatatactgctcatacataaagtataccatttgataagtgctgacatcatgaaccacatctacaatcaagataattaatgtattcattatctccaaatgattcctcatgaccttatgtaatccttgcctcctgcaccatcctccttagacaattattggtctgctttctgttactcactgtacattagtttgcattttctataatttttaataaatgaaattatacagtatattttctgtttttatatagtttctttcatttatataattatgttgagtttcatctatgttactgcatgtatcaatagtttattcacttttattactgagtatattctattgtatggatatatgaaatttataatccattcacctattgacagacatttagactgttccattttggatgttaaaaatagtagtagtagattactatgaatatatgtgtaaaagtctttgtatgggcatacactttcttgtcctttagataaatacccaggagaggagtggctggacaatatggtaggtatatgattaactttttaagaaactgtcaaattgtttttcaaagtagttgtaccattttacattcctaccatcaatgaacacaactcaaaatttagtttccctacatcttcaccaacactgatgtggtcagtttgttcaatttcaaactatctaatttgaatgtagtagttcctgattgtggttttgattcacattttcctaatgattaaaaatgttgaatatcttttaatgtgtttatttttacatatctcgtttggtcaagtgccaccaaatcttttgcccattttaaattgtattgattgtttcttattaatgagtattgagagtcttttatatattctgcaactattttctcccaattttagccatgtctttccattcttttaatactgtcttttgaaagtagaagtttttcattttgataacttatcaaccttttttttgaatcatacttttgacatcatatctaaaaagtttttggtgtgtccaacccaggttcacaaaggtttcctctggtattttctaagttttataggtttcacaattatccatatgattcatttagagttaatttgcacatatggtactgtattagtcatggttctccagaaaaccagaaccattaagacattttatacacatcacacacacacacacacacacacacacacacacacacacacaattggctcacacaagcaggaaaactgagaagtttcaccatcttccacctgaaagctggagacctatggaagccagtggtgcagtccccatctgagtctaaaggcctgagatctgagaggactgatgataaaaattctggtccaagtccaaaggcctaagaaccagaagcatcaatgatgtaagttccattccaagagtaggagaaagatcaatgttctagctcaagtagccaagcagagagagtgaattctcccttctttcaactttttattttatttggaccctcagtgtaccagatgatgcccacccacactggtgagggcaatctgtttcacttagtataccaattcaaatgctaacctcatttagaaacatcctcacagacatgtccagaaatgatatttaaaaaaatatctggtcaacccactccccagttaggttgatatataaaatgaacaatcacaggtactatgtaaggatctattcagtttttgtatatggatattcaatatttccagtatcatttgttgaaaagatatcctttctgtatgaaatttgcatatttataagaaataagttgttcatacatttctggttctctactctcttccatctatttctctctcatagtatttttccataattttacttttaatgtacttgtgcttttatatttgaagtccatgtcttgtaagcagcaatcattgaggcttgtttttctttattccaatctgataatctctgccctttaattagggtgtttaaaccatttacatttaatgtaataattgaaataattaagttgaaataatttatcttagttttttttttcctgttggtccattctgttctcttcctccttttcttcttttctcttatgttttggataaattgattattaaaatgattttattttatttctatttatgtttttctgcatatgtggcttatgagctctacaacttttgattcactattttatcttttgggtttataatataaatattttaaatttaatattttattctgaaataattgtatattaatgtgtagttgtaagtaatgatacagagagataccgtgttatagatacccagttttatctcataagatcttaaaaagtttatagtacagtaacacaaccggacattggcattgatataggcaaaatacagatttcctcatagcaagaatccttaattttgtacttgtatcttcacactgacttgtctcccaccttccctttaaacttacccattagagctccattgctgcaacctctaatctcttctccattactataatttggtaattttaaaatttatataaatggaattgtacagtatgtaatttttcataattggcatttttgtcaattagaatacatatgcagagattcatccaggttgttgtgtttattgtttgtttctttttattgaccatagtatttcatagtatgggttactacaatttgtttatctatttacccatgaaaggatatttgggttgtttccagtttggagctactacaattagggctactataaacatttgtgtatatgattttgcataaatataattttcatttttctgtaataaattctcgggagttaattgctgggttatatggtagtaacactttagtcagggtttttttttttttaagaaagtagcaaactattttctagagtgattgtaccattttacactctcaccaaccatgtattcattattacatttctctgcatcttctcccacatttgatttcattactctttttattttagccattctgataggtgtagtaatatctcattgtgttttaaatttagatttccataaaatggctaataatgtcaaacatttttaatatgcttatttttcatttatatactctccagagaaatgtttcttcgtatttttgaccactgtaattagatttcgtttatttatttatttgctatttagtgctactttttgttctttatatattccatctatctatgaaaccattcctataaactttataatactaataagggaagatgggagggggagaaatgaaaataaaccaagtggccggacacggtggctcatgcctataatcccagcattttgagaggccaaagctggtggatcatctgaagtcaggagtttgagaccagcatggccaacatgatgaaacccgatctctactaaaaatacaaaattagctgggcatggtgttgcatgcctctaatcccagttactcagaaggctgaagagggagaatcgcttgaaaccgggaggtggaggtttcagtgagccaagattgcaccattgcactccagcctgggcaacaagagtgaaactcaatctcaaaataaaataaaaaaagaaaagaaaagaaaagaagaaaagaaaagaaaccaagcttgcaggacacacatcattagtaattaatgtagctttctattggacctgcttcctcatagttgtttgcttttgtctcagagtcatgcagaccctgttacaagattatagttctccttaactgctctatagctaactatttgaacattatgaaacattaggttttgccttaagatgttctttcatgtcctgcatgccagagaaatcactgatgccagctggtctgaaggaccccactgatgccaactggtctgaaggaccctatgaggagatgactcaccaaagaatggagtttccacatcctgatgacttcatccttcttactctgaccaaccagtggtcatagttttccagccccttgctcttaaaaaccccagcccagaattctcagggagacaaatttgagggtttcctcccatctcctcactaggttgccctgcaatcattaaactgtttctctgctgcaaaccctgctgtctcagaatatttgtatattactgtacagcaggcataagaagatatcggttctgtaacaactatctgatttgaatatctcctctcctaatctgtagcttatactttcattcttatcttaggatattttacagagcaaatgtttttaattttgatgaagttgaatttatcattttgttttttatggattgttctttgcatgcaaactctaaattcttttcacctaactctaaatccctaatgatttctccattttttacctcaaaattttatagctttatattttacatttaatctcatgacctgttttgaaagttaatgtttttataagatgtgagatgtagcttagggttcgtttatttgctctatagatgttcatttgctctggcactatttgctttaaaggctacccttcctctaattaattgcttttgcacctttgtaaaaaatatattgggtatatttgtgtcagttatttctgagtttgttttattgatctgtgtattatcctctaccaataacacacagccttaattatggcagctatgtaataattcttgaaaatatgtggactgaatattcccatttcatttgtttcttttccaaaattgttttagttggactaacttgtttgcctttccatacaaattgtataataatcttgtctctatctcaacaaacctttttgatattttgataagaattgtactaaagctgtatatcagtttagggagaattgacatctttatgattttgagctattcaatacaggaacacagtaggcttttgcatttatttacacctgctttgatttctttcatcagtattttgtagttttcagcatacaagtcctgtatatgttttgttaaatttacaccaaagtatttcatcttttaagtaattataaatagtattatagttttaatttctatgtccccatgttaattacatgtattcagatacaattaaactttgtaagttttatcttctatcctataatcatgctgaatttgcttatttattttaggaggtttttgtagattttttgaaattttttatgtacataatcatgccatctgtgaatagagagattttttttccttttcaatctatatgctttttcatttcttgccttatttgctaggtagaactttcaatactatgttaaatgagtgataagagaggtctttcttttcttgttcccaatctagtgcaaaagccttcagcttttcaccattaagcataatgttagctgtaggatttttgtagatggtcttcatgaaggggagaaacttactctgaatttctatttttttctgagatttttaaacagaaacaagtgttaaaattttcaaatgctttttctgtatcaattgacatgataatgaattttttcttccttgggctgttaatatattacatttttgattatcaaatattgtgccaatcgtatatccctggaataaactcatttggttatgttgtataattctttgtatatattgctgactgctatttgctactactttgctaaggagttttgcctctagattcttttttttttttttttttttttttttttttttgagatggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatctcctgacctcatgatccacccgcctcggcctcccaaagcctctagattctttagagatacattggcctttagttttatttctttttggagggggtattctttcttcatttatgaatactaatattcaaagccatcatgaaaaacaggaatgatcatggattttataggtgggcagagtcacagagagtgtaagctgcccaagaccacaagagttgggttaaaacccaatactgggctgggcgtggtggctcatgcctgtaatcccagcactttgggaggccaaggtgggtggatcacgaggtcaggagatcgagaccatcctgggctaacatggtgaaaccccatctctacttaaaaaaaaaaaagtacaaaaagttagccaggcgtggtggtgggcgcctgtagtcccagttacttgggaggctgaggcagaagaatggcgtgaacccaggaggcggagcttgcagtgagccgagatcgcaccactgcactccagcctgggtgacagagcaagactccgtctcaaaaaaaaaaaaaaaaagacaagaaaaaacgaaaaaagaaccctcccacaatattgcctagtatctatcactcagtggagatgaaaatgtgaactccataccctgccttctctgacatcacatggaagggagattggcctggtgagagtagaagtctacactctcctctcttttgcgagcttgactgaagtttgtttgtttgttatttttagcattgtatgtttgtttgttgtttttagcattgtatgtttgtttgttgtttttctgtggtgtttggctggagtggagcaattattgtctaaaaggtttctgtcttgtctacctgcccctttccagattctttgagtagaaagaacaggcttttgttggggcttttttttatctgcatctgttggggattctgagttgccagtttcttcatcttgaaatctgggatatatgcagcaaaaagaaaactcagagaactcacctctgcattgttctttgggttccaagatctcacacctgtctgtctcttctgtccacctttcagagttgtcttataatgtccagggtttttatttgtacttagcgggaggaaaaggtaaaagtatgtttcctccatcttcacagaagcaaaatcccagtatatatctttaatttattacaggctgttttcaagttatactctaccacttcacatctattctaaggatcttaaaatcggatgcttttatttcttcattccttacctttgagctattatcatacatcttactttcccatgttattcactccacattacattgttactattttcgatttagcatgacatcgtatttgaagacaactaaataataagatgaaaattttatatattcatccatgtagttaccatttctggtgctcctcagcctatgtacagatccacatttccatctggtattatttcctcctgtctgaaggacttcctttaatatttcttacagcgcagttgtctctctgtgctgctttcctctctggtattgtctgtcaactctagctgcattattctgcctggactcctagctctgtcttctcaacctggagttcttgggactctgcctgggatctccctcattatactgtggcttaaaatctctctcaaggcacttagccagagcagtcataaggctcacctcatttattttctcactctcaggaatcactttcccttgtgttctgctctccagtctattgcaaactattgtttcatctattttgtcctttttttgattgtttcatgaggcagggtaaattcgatccctcccttttgttatttcatctttgtcagaagtgaacatcttatatttacttttaacaatgcaaagtgggattacttgctgtttcttgtttacagacaaaatttttcacataaaatttctcccaaatgatccaaaaaagctgctaagcacccactaagcttcatttaaaactatatattcttctattctaattaactttgtagttattttaaataacataaagagaatttttaaagataatctgaaagaacagagactaaatggaatgctttcctgtgtagataggattgaccctatgcttaaatatattataaattattttaggtaactcatagtttgcaggttttacttaattgtggttttctccatgtcttaaatatttattaaaatgaaatatcatatattatgacattttatcttcttatcatatctagactctcttcccctgaaaagctgaatgatttgatgttttgcttgggaatggcttatcaacagtttctctgttatattaattttgaaccaatagcaatagtgcttatttctttctgatttagtcataatacagaggaagaggtttctctcattccacaaaagaaatgtcagcataaatggaatctgtttgtttgaaacagtgtttcactctgttgccctggctggagtggagtggtgtgatatgggctcactgtagccttgacctcctgcgctcaagtgatccttccaccttagcctcccaagtagcttggactaaaggtatgcaccatgacacctggctacttttttgttgttgtttttgtagagatggagtttcactacgttgcccaggctggtctcgaactctgggctcaagaaattctcccatctctgtctcccaaagtgctgggattacaggcatgaatgattgcacccagccagaaatataaccttaacataggtcttatatcaccagttcccaaaaagtagaatatgaatgacttcgcactaatttataaagatgtaaagagtaaaaagatagtttaaccaaactgattaaatataaatgggtggtcgaattctatataatagacaaagttataaaagtagcaaagatcaattatatttatgaatattaagttacaatactcattttataaccatttagacatttaaaggttacttatcaagtatctcattttctgacatatatcgttatatacagtgtttacatactcttgctaatgggataaacatgatcttcagaggaaatcctgaagagggaaagttgtattatgagaacaacttgtaaagagaagtagagaatggttaaaattatactgtacggtgtcacgagtctctccgtattgatcacttttgttttctttttttaatatgttttatcaagttctatctcaggccttcaattacagataattttatctatctatctaaaatatatatatacactttatagatatgatatataaatatatatcaatgtaatatatattatgtataatatataatatacatctaatatatattcagtgctaagttaatatagaatatagcagttgtcttaagttagtgttctaacttaactcagtttctttcttgaggacattgacaaggtcacaaacattcccttggcactgtctattttatgatattccataaacttttgggtccatttattttaccatatcacgttatttactttcaggtttgctatcttctccctcttgtcccttccccttacctctgctaaaggtgacagcactttacagtaagtggaagggtaaaggctgactgctttgatctttcgttacatgctttgacataaattggagaggaagcttcagcttcacccaaaatcttacctctcttcggctgtctaatgcctccctaagtctttatcatatgcccaatttcagagcagtttcgggtcagggaaacaatatctattggaagaaatcaataataaacaggaaaccgtcataactattttcttctcattctttccagaccaatagatgatggaagtgaagattggttgatcattttctctagagtgaaaccaaaggaagtatctccacatagcatagaacaaaaggccaaggaagccacttctttgaaattcttaagagaaaagaaattttcgatcagcaccaagaattcaacagccctctgacttcctgcagtgatagtcatgagtgaaggagtggaagggctctgcaatggcttacagttcaaaaggccattataaatctctctaaagaaactttagcaatgtagttattaggcaacctttaacttcttctgtgttttctctggaagctgcaaaatagatttttctttatctcatctgaattccagctgtctgttaaaaatttggagagataataatgtgcttagtattttgacctttaccgagaacactgaacctgctttaactaaactagagggaagctttaagtaatggattttgctacagttttacatgtgaaagtaaacagattatttcaaaaatattgaaatgtatttggacaggtattgttcatcttttttttaaaagctgagaagtactgtttagtggtcatcatagttaaggttttgtgattagacatagatttaaacccttactctgtaattacccaggtagccttgggcaattacttacatgctacttatctttaaagtgaacagtaatatcttctttcaggattgtgatgaagattagacataaaattagtagaatttttaatacagggtctgagacattaagtaaatgctcaatacatgtactcaagagaaatgtgaaggcataaaagcatatccctgtgtttattttgaaaaatatttattgagaaactactttttgctagctctgctaagagctgaggatataactgaaacatgaaatagaatacatattttgttacctcatggagtttacagctaattagaaaaacaggctgcacataaatttatgtatgcatagaaacatatgtgtgtgtgtgtgtgtgtgtgtgtgtgtgtgtgtatatatataacagattgctgagagaacatagaatacagcagttgtcttaacttagtgggcaaatggcattaggtcagcccacagaagaagggacattaaagctgaaataagaagggtaagtaagagttcttaaggcaaaggggtgggggaaaggggcaattgtaactctagccaagagagtctgaggaaggaataaggttagtgctctcagaaaactgacatgggcagcatatgggaaagtggtaccctgtaaactggtgagatggagaagggacagattgtgcaggacctagtggccatttttaggattttgtgttttggtcaaagagctgtcggaatccgttgaaaggttctaagcaggagagtaaaggacctcctatttcaaaaaatgtcacttcaatttctttgatgggattgacttgaaggtatatttgaatagttggtgacaaggagataatagcgataatagagataggcgtttgacccaaatagcgtcaatctgtactgaagagggaaggtagagctttttaatctgtgttcataaactctgtgaatgctcttagcatatgcctgccagggccagtcatctttcatgaagaatgagaatttgcctaagaggaaagcagagtgaagcaaatagaggattgagccctagtgatgttgttcgaacccctggatccaattgtgtccgaaaagctatttcttggacttctcatttctgtgagttaatacagtctctttatgcctaaagtaatctgggttggacttatatcactaaaagaatactgaaataatttcctattcatgctgtaacaaattactacaaacttcattgcttaaaaacacctacatttagtctctcatagttctggagttcagaagtccaaaatgactcttaaggggctagaatcaaggtgtcagcaaggctgattgcttctgaagtctccaggagagaatttgttccttgcctctttcagcttttaaagacccctttggcgttggcttgcagtgacattgctccaacctttgcttccatggtcccatcaccttttcctttacggtagtcaaacctccctctaccttcctcttataaagacacgtgtgattatatttgtaacccactcaaataactttaggataatcattctattttaagatctataacatctgctacgtcctttttaccatataacattcataggttctgaagatttgaatgcagtcatcctcagggggccatcattcagtctttcataagcactaaactgtcaataagctctgtgtgtaggcaaggttagacatgtgtaaagtgtaatgacattatatgacattgtaaaaaattataatgggttaacaaagaagttggggaagcagcagtggagaagtaagtgcagaaacataccccttccccatgttgaataggttaaatagatgctacacaaattgttgttaactcttatataccctagttactctatatctctgatgtgagtgggaccagagcagcaaattctgataggaggaggtgagaggcagtagtgacagcagaaataaaattttagaaagtcttaaggtttgattagaaaactgagcacaatataaaatacctctcagaagagatatgtgtcaaaaaaataaaatgaatccaaaagtattttgttgaaagtctaaagtaaataaaatttgatagtacaatacttattatagtataattacccaattactgtataaactataattaaatattccctttattttattgaatatgttattgttagtaaatgcaaaaaaaccccactatttatagaatgctttttagagttagctctttatctttttctcccaaacctatattattaaatatatggttttaagctattcaattatgaattttcctacaagggaacacagcttcagaagaaaaaaggaattgttaggatcacatgttctcaaatgtctttttgactatagaacgatgggggaataatatggggtgtgacagagtagagtttcccaaaggatttcccacaggcatctgtctcagaatgatctgctttgtattaaaaatgcagaatctaaggtttcccaccccactgtctgtgttagttccatagaaatagtgtaacaaactgccataaactaggcttcttaaaacaacagaaatttattctctcacaattctagagatcagaagtccaaaatccaggtgttcgcaggctagtttcttcttgggctctcagagggagaatgttctatggtcctcccctagcttctggtggttgccagcaatccctggcattctgggctcacctctatatcattccaatagtcgcttctgctgtcacacagctgtctttcctctgagtgggtgtatgtcttcacatggcgttctcatttgtgtgtgtccatctgtgtgtctcttctcttcttcttgtaagtacactagtcatttgatgaaggacctaccctgctccagtataagctcatcttaactttcattttaactacttgtgcaaataccctattcccaaatatggtcacattcatagataccaggggtcaggacttcagcatcttctggaggggacacaatacaactcacaacactgtctaaataagaatctctggagaactggagcctagcttttgcatttttaataattataagttttactttaaaattttgcaaccactgatgtagaggcaagtcaggttaaaatatcacccaccatttgtaataaaaactggagcctgcagtaatcctggcttttattgttgagatatcattctctcagaatttctagattacaaaatagaagggatatcatttctgtagctaattggcaagagtaactgcttattatccttttgataagaacatagtgaacattttctagcattgttagtaattagacagtgtgctgtttcaaatacaataacaaaatcttacttgaatgcttttttttttttacaaagaacagtgtattgatgtattactctagtaattttaaaaggaaaatcttagaagtataattaagattttctattttctgattactcagaagaatagcgacttcactatattcaaagttacacactttatggttcataccaagctatggtttaatgaaatctgtcgcagaattcattgatttcccaggctcccagacccaaaggatgattcttctaacttggtaggctgcattttgtttgtaaaagcacatttactcaagatagcatgggatgggttaggagtgcacaaattaaaggtgaaagtatgggagcaggagaaagtaagaaaatctgccaccttagtaatattttcttaaaataaggtaaatcttaatttataatcaaaattcattttctataatatacaacatattagaaatgacgacgatataaagtctgtttattttatagaaatccaacatttcttatgatgttatagtaagtaaaatgcttgcttctgtattttgttgttttatcacagttaccagagaaaaacaaataaaacaatatattaagcaaacactgttttattctccactgtgtgatataccttccattccctacttattaactctttggcctgcttcaattctggactcactataaagttggatgatgttgtcatccagagagttcagttattagcaattaactatagttctgaaattacctttttctagattcatgtacaatggggtggatttttctactgtcaaatttcagaaacataaaaaccagagataaatataaaaatgtgtatcctttttggcttctttgtgccaaaaaaatatattccccatcaccagatatttttcccctgagccattaatttaaacttgatattttttggaatttttaaaaatactaagtctgttacttatcataaagccaattttaaaatgttttaatttagaagagaaaaaagaaaaataaatatatttcaagggattctcaaacatatactttttatctgcttatgattttgagatcatttctaaattcttcaatgtctagcctcctgttaataacataataactaatattccttccatatctcccaatggttgatgtttttctcacaaatttttaattcaccactttaataaggtaaatttttcttctgcgtaaaaaagaaagctcttgatatttatctttcctttttatcccccaaaaggcattttttcataaagtaaaattaaatattgtatcttcacattacatgtgtatatatgaatgtctaatatataaactatttttaataggaaaataaaatgtttagtagtaacaatatctaatacatgtatagctcgctcttgctctttcttttctttctttttatttcttctttctttttatccttccttccttcctccctccttcccttcccttccttccttctttcctttctcttccttccttccctccttccccttccccccctccctccctccctccttccttccttcctttcttcctctctctctttctttctctttatctctttctttctctttctctctttcctcactttgttgcccaggctgaagtgcaatggtgtgaacttggctcaccacaacctccacctcctggattcaagtgattttcctgcctcagcctcccgagtagctgggactacaggcatgcaccaccacacctggtgaatttttgtatttttagtagagacagggtttcaccatattggccaagatgatcttgaactcctgactgcaggtgatctgcccacctcggcctcccaaagtgctaggattacaggttttagccactgtgcccagctatgtatagcactttctttgagccaggccttcaatgaggtgaatactattatctattccatttttaaaatgataaaactgaggtatagagacaataagtgatctccgtaaaggtcagatagcaaagagttctgctgagattaaaacccaggccatttggctctagagtgtgctcctgaataatatgttatatagggtatacttcagtaaatcatccaattttcttatgaaaattaatcacattttcattatttttatttttatttatatatattttttgagaaggaatcactctctgttgcccaggctggagtacagtggcgtgatcttggctcactgcaacctctgcctcctgggttcaagtaattctcctgcctcagcctccccagtagctgggactacaggcacctgccaccatgtctggctaatttttgtatttttactagagacggggtttcaccatgttggccaggctggtctcaaactcctgacctcaggtgatctgcccacctctgcctcccaaagtgctgggattacaggcgtgagccaccatgcccggccaatattttctttattttgagaggaatcacggtgaaatgaagagcctagactttgaagtcagacaggcattgggttcaaatccttaatcggattttagtagctccaaaactggaaatatcatttaactttcttaatgtatgtatactcatctgcaaatgcagatgattatactttacagggtggttgtaataactaaattaaacaatatagctaggttgagagatagagtctggcaccttttagctgatttgttagctgatcagctaaagtcaaaaaggagagatggcttgtttaataaattattttggatccatattccaatcaggaaattttaaaaatgctatgccaaaatgtcaagatgtgttaaaaatttcaatattgtttttaaagtactagatgaaaagaattgtctaaaaatacaagatcaaacaattaaaaaggaaaagaacaatctagtcacttaactatataaaaatatggtttgataaacattagtttatcaaaagacaaattattcaaattaccagtaagagaggaacttattcccaacacatttaaagaacaaaatttaatgaatttaatttgtaaatagttctttcaaatttaggagaaaaagaacaactcccaaattaaaaatgaaaaaagttcacatataaagcaatttacaagatttaaaaaaagataaattaatcatgtaaatataaaatacttcttttcttctttcagatcactgaaatttaaaaccatagatgatatccagtgatttaaaacagtggtggaaaacgttactatcccacagtgtttggaacaaggttaattgatttagtatttttggaagatgacgtggaaattagtgagaaaatttttatgtagcgtcatttacacagaaattccacatctaagtttttagcctcaggaaataattgtacactacaaaatgtttcataaactagatacacatcatggcagtagtgatgatataaaaatggaaaataatttaaaatacaattaatatggtactagtccagcatacttctataaatagctttaaaaaggaatgaggaaggtcaggcatggtggctcacacctgtaatctcagcactttgggaggccgaggcgggcggatcacctgagatcaggagttcaagaccagcctaactaacatggagaaaccccgtctctactaaaaatacaaaattaggcgtggtggcgcctgcctgtaatctcagctactagggaggctgaggcaggagaattgcttgaaccagggaggcagaggttgtcgtgggccaagatcgtgccattgcactccagcctgggaaacaagagtgagactccgtctcagaaaaaaaaaaaaaaaaaaaggggaataaggaagagctctatgctctatctattgaatgggagatgcttatactatattaagtataagatatagatggctgaatggtatttaaatagaaatggtatgatcctattcatatacgaaaatatatatttcactatccttatccatacatatgaaaaatatattcaccaataattatatataatgtagtttaaaaatatttttatatatttttgattggttttatattgaacaatgagaaaggtactattaaaattgtaaaaataaaaatatttttattttgaaaatcaataatgaatttatctcttattcatgttgggtttaacagtatctgtataaatatttttaagatgagatatataagttcaaatagaactcagattctaaaggattggtgtaatatttatctctacactgcttatatttcagtgttaaaaatttatgcttaaacattttaagaaacttcaaatgcttttataaacctactctaaaacttcttccacctaacactgtaatttggttactatcataaccacgtaaatgatagatgcccaaaatattctagcttttcatgtcccagagtttcccgcaatctcaatctcttcaaaccataaagtcagctttgaaatttttgacttaaaagagtaagattgctctagccactgttaccctttatagatgagttaactttttaaaaaatcgtcattactgttttaaatcatgctgaattccaaaaaacaccattacaaatgaaggattgccttttcattaagttcataagccaactcctagatttagataagtgtatttgatggtgactgcatgtaaatgtaggtgagcatgtaagggtgtgtatgcacggatatgttttctaggtgtgtatatatgcatgtgtgttgtatgtggaactacatacagacatgcacgctgatatgcatatatgtttaggtgttgtagtgaacatgtgcgtatgctcatgtacatcttgtgtgtgtgtgatatagcaagacagaatatctaaaaatgaaacatttacagtgcatttaaaatgaagcaagcatttagacattcccatttacaaagagtactggggattgtaaacatcagcagcatctctgaggtcaagtttacagggtaattatatttctgaaaatggaggcatatggaatttttatggatccggtgtgctgtgagactgaagtccaaattttgataaatgaatttcatgcaaaatacatttattctaagacgttaaaaatgaaaaatgatatgcttgatactatagcaccacaaaactatgtttctcctaactgcttcatttttttccccaaactgcaaagtcaattcttatgcacagaacaaaaaaaaaatatgcctatggtctgaaaagtagctaaactcaatccaagaagcataacactgaaagtttaaacacattttatattttagcttattatcattgtcattattcactctcttttggtcatttgaaatgtttagaagttttaaagaggggtgaaataacattatataatttattgaaatatccctttttcccatcttgcttccctacatttatttttttgcattttcttcttcccatttgctttttaattcaagtatagacagatatatgacatatgaatttttgtaggatttgcaaactgattaagtgcatcaaagaggaagaattttttttctgattcttttatatatttctttacattattttgaattcacagttaaatttttgaaaggtagtggtactaatttttttaaggatgtggaaggaaacgagagtatagccctgatttagggaaacattcatcaattggtattgaagaagattctatcttattgccatgaatcatctactttggggcatgtacacacacatattgtgatatggggtaagaagcttaagtattaaggaaaaagcacaacaaattttcttttaggaatcagtaatgtgtaaaaccaaggaaataacacaggccaaatgaaataatgaatatcattcaatataacatgcatattttgatacacaattagattttacatttcgtgattctatgtggaacatgagaatgagtaagaacttaagttcactcttagcaggaacctcatgttgtaatagatctcctttatttggaaatatttttaaggatcgaaaagagctaaaatataagagaattcctcacaaattataagttatattttatgaagattggtagactgagctgccttaaattatttctggaacaagatggggtcttaataaatcaattaattcactgacaactcaataaacaaattatgttggcctcttaagagtttataactttaaaaaagtcttctatttattcacacacacacacgcacacactcacacgtatacacgcacacacaaactcaatcattatttatgtgtaccctggagagatcaaagaagtaagcaaatactgtgagagcagaattttctagggttctgccttttagaatggattgattttgtgcccacaacaagaatattcatttgcaaacagttcatttgagttcggattctttttattcagtatttaccataatgagtcagatggttgtactcataatagtggcactcataggatgtaggaaagagtagtattcagtagaaaaacagggaagaattaagcataaatcaacggagtatcagtgtattcgataggaatggcatagtcatgtgcctacaaaagcattatttgcttcagagtaaataagaaattattcaatgaatcaataagtagcaaaatagatgaaaaaatgatatacatgtctacataaatgcattaataaaataaactttctttctgaaaaataaaacaccttgaacatatacttcttgaatagtagtttttacatgttagaaaaatacgtcatttttcttaccacctctaaatggcaaaactctgttattctgttatgaaactccctgaaaccaaacaacaaacagagaattcaatagggtcgatctccacaaattgattggatccttgaaatgacctgggatgccgattaaacatgtaaatgcccaggtcttacttagacctaactgaatccaaatctccacaggagggttcttaagatcaggcaagacggccgggcgcggtggctcatgcctgtaatcccagcactttgggaggccaaggtgggcggatcacgaggtcaggaaatcgggaccatcctggctaacacagcgaaaccccatctctactaaaaataccaaaaaaattagccgggcgcggcggcgggcgcctgtagtcccagctaccggaggctgaggcaggagaatggcgtgaacctgggaggcggagcttgcagtgagccgagatctcgccactgcactctagcctggggcaacagagcgagactccgtctcaaaaaaaaaaaaaaaaaaaaaaaaaaaagaaagtcacttattctgattattttataccatgttggtaattgtaacaactaccttcctttttaagggttgggataacagagcaacaattctgaccggatgttatttttaattgtttggtccaaagaagaatgggaaaaaatttaagtttctatgttttaaatgtctgagtaatgtacttactacaattttcagcttttctgttgtcccggattactattctctggttgattgtgctgaagagtgttgtccagttaatggtatgataataacacaggttgctgttgtcagtaatatagatgtttcctgcgctgatttccttcagggactggaactgtagagaggtgatgccctgttgcttgaggataagcaaggacaggccactaaggagggggaagtgagaaaacggaaccatgaaacgcattccggagtaaaataaggctgtcacattttattttaaaaagaatgttaatggtgtataaatggaaactgaatcaataaatctgtgtttagaatattgtttttacatgctatatacagtttttaaagtaataatttgacctcccaaagtaaaatttccattgcttacagttatgcatattggcagtgtatctctatttctgtgtatgtatttaccactgaaatatctgctcactatcttcccaccccaagacttaactttacattgttcaatgatgaaatcctgtattaacactaaagaagtgtttataaaacaattgttcatctactcaaaataagacattaattcctctttatgtaatagatttagacatactttcagagtatgtctaaataatttcagaaaatgattataggtatttagctttaatttatacctcagacaccaaagaactgtaataattgaggaatgtgtaagtaaggttaggagatagtaaaatgtaaagaatcaaactaaactaaaattagaaaaagaaagcaaactcagatgccttgggtatctggggaaaaggtctctaaaagttaaataacaactaccctgtttagaattgctcacatcatgcactccatacttgcaaaatactaatattactttgagtgacagaaaattgaaaaatcgaggaaactacttttattttactatagtccacatttttgtaattatttacttttttacttatttacttttttttacttatttacttttccattctctaaagaataaacatgcttccacatttcgatcagctaatgaatattattttacattttggagatcaaagctttccacttttatttatagttttaaatattctttgctgttaatatttataattattttccatggttgtcagggtgtgtgtgtgtgtttgtgtgtatgtatgctcaatgataaagactaagatgtaactctttctctcaaattttgtccccatcataactatcttgagttgttgattacaatgttagcacaatgtcttgactggcttataatatttattcaacggatagtaaaagttgtttatatacagcactttaatagattgtatctttcaactatcctttcttattaagctcctttctcctttacatttttaaaacctcctataacttttaaattttaatagtgaaattcgatgtactttttataaaacattattagaaaatcaatgatgatattaagtttggagatattttgaacttaaatagacaaatttaaaaaattcttatgcaaattgacttttaattgttcataaataagaacatcatacagatgacatcagagaaatcttttactcttataacgtgaatttaaattattgatgttataattttatcaatgtccttctaaacctgaattttttttgtccatttattaaccagcactacacgtacagtggtggacgagttcctaaaacatcagccctgtgacgtgtagttcaattatagcaccagagacaagaacagaacctcctggcacaacagcatttgtatcctatacacccaagctattaacaagtcacacaactcttatcttttaattgtgataacatctgataaaaatgaaagtttcattggattgttcacatcatgccctccatacttgcaaaatactaatattattttgagtgacagacaattgaaaaatcaaagtatgtattctgtaatacctcacaccatcatcggaggtatttttattgagcttatctttggaaataaggatggaagcatgatttccccagaatcagtaaatcaataagagtgatagttttgacttaatgcacacacaatgctcctcttgaaatctgtgagccctgcagctttaaacatatccacttacctatagagtactcttccaccaatggtcaccaggttagaaaaaacactgaagtcagtcatgtttggtggccatgactgtatgttcaggaaacctacaagtgaagagtagaaaaaataaatcagaatatcattgtcttagtattagtgctgatttttcttgaaatatggtgaaaatgtgttgaaagttgggaagtgagaaaggggtagtgaacatttctattttttaagcactctattacatatgtattcttccaagattgagtgtcctacccaataaaactgtatatgttgaaacgtttcaatgactcagtttgatttattcttataaatgcaaaaatgtagtctaactagataaagagaaaaatacagtttcaatttctctgaaatcttttacgtcttcatctgttcacttatgacatcagtgtcacccttgtattctaagacatttatatacatatctagcctttctcattagattttgcattattttacggtaagtccatgtctgattcatatctatgggtcccatattacctataagacaatgttgaacacattacatgcttaatatgtatgtgctaaataaatgctacatgttatctattttcaatagtacttcttttgaagaagtaaacagaaaaacatagtttcaaagatcagttgacacttgcaagagtcgtaatgtcaaactttcaaagatactcattttgtaattccatgggctttcaaaatgtgcataaaagctaaaaagacaccatctttaaaaataacatgagtttttacaaactaaaatctgctttgaaaattagttgctgattccaatcttatgtaactttttttgttttgttttgttttgttttttgttgttattttgaaatggagtctcactctattgccaggctggagtgcagcagcgtgatcttggctcactgcaatctccacctcctgggttcaagcaattctcctgcctcagcctcctgagcagctgggattacaggcacgcgccaccacacccagctaatttttgtatttttagtagagacagggtttctccatgttggccaggatttccatctcctgacctcatgatccacccgcctcaacctccctaagtgctgggattactggtgtgagccacgatgcccagtcaatcttgtgtaatttttaaaaaaattatattgttcatagcgcaacagttgcagtttaaaaaattacctgttatctctctgactgtccgaaagacgttcagtttctctgggtctatggcttcaattgcattgtaagggtccctagaaaatcaagaagagatgtagccaaatttaaattttactaaaggattgaaaatatgagaaatgtgacaatattttattcaaatttaattttaattagcagtaggggtgttatcaatgcatgtttaaattaatctgtgctagatgtggaggaggaataataggtgttttgtggaaatttttgatgtcacaaaatatgagattttcatcaaagcctattccagatctataagattattcagcttcaactattctgatgaaattcccaaagacagcaagctcatgtatgaaccattttacattattttgttttaaaagtttattcttgatttggaagaatatatatagtctagaaatacattatattatagtgagaacaactggcatttccgctcctcaaagaagtatacattgctattagtacctggaattcgtaagaaggacagaaacaaacacaaataaaattgacatcttttttttctgtagctctacatttatctacttgtgaattttcataatatttataacattgtccagaagtctctcttcatacagattacttagaaccatcttgttcctatctagcttattcatattcacgtttataacacaggaactattcgcttccaagtatatgaattcaagcaagacttccagttttttttttaaagaaatccacagtaagttttaaaattttattacattaaaagacatttcatactatcctaggtagagacctcatattaatatataccatttacagagagattaaattttatccattggctacttcttcaagacagatcaaaacttctaagaacagtgatcttaggcttttttagaagtatgtatctacctgtagcagccaaacaaattttattcttactgtggacatctcttcttttaccagtctctgagaacattcctttttggtatggcgaataaccattagtgatccactatatgcagccttaatagggctatcaatcaacgtgttccacaatcccctgacaaacagataggcatatggcctatgtcctggggatttgtgtctgaatccattggcatttattcatgccagcattcaagtcttgaaaagagtatcagttccagcaaccttgatctctggaaccaccttgtactggcttcctgaacttggttcatcagcatattcttctctactggaaaccattccacatcttaaaaaaacaaaaaaaaaaaaaacaaaaaaaactttgcttgattaaattagtgtttcaaactaagaagtgcaatcaatacaatgtactgctagtttaacatggagtgctttatactaggctcaaatactggatattgctgaggttggagaaacactataaatgtgtttccctataattcacacataaactattgattaaaattttctcaatgtcatattaatatctcacaaaagcttaaagtctcaatgaaatgttctagcaactttctctatttacaagcaaagatatatggaacaaataactatgcttttgatgaacatgaagccaaaaatgaagtgtatcatgtaggaaaactcttgccttcactttttaatgtgcaaagaattttgtatacagaggaaatatcagctctgcagtacaagaataagctttcaacatttgttctttgatgaaaagcagagtataggacagctcaggtcgtataatcaaatatcttggctttattgagaaaaactcaaaattcagggcaagcacacaataatggggtcagtccggacctttactgagaacacttccatgttgccaggaatgaaatgaattctggaatgttaacatgaagctcagtggaccacagatattttatacagttaattttagagactcaggacccttgtcaaataagttgacagaattccactcactgatttcaaagtatgtcttgggagttgcatcctatagccactcgaaatacatagtactttaaaacagttaacttccctaactaaattcggagccatgcaaaagaacactacgtctaccgtgtcattgtgtttggtgatccaaaataaagctcaggaaaaagagagagaaacatattttcatttccactgaaatcactttattttatcatcgagtttattatttcccttccattgtctagcaccattgcaggctactatgtaaaccctttcttgccagtgtctcattgtgacacaacatgaacatgcttatttggtgagcatttggttactctaagcacatgcacatcaataatgtaaaacataacaaaacatgaaagaaaagttttcctaacgataaccctaagcactaagctttcctgcagttcccattctaaataagaaaatgagtgcccactgctatttctggcaatggtactcttgtactataaactaaacatgccaattaactttcttgagcctaattatatattaaaattttaattgatgaattgccagtaaatatattttgtggagaaacttgtttttaaaaagcgtaacaacctcattaaattattatttttgcattttatcagttaaaaacatctcagctattttaatcaaaccatatgaccttatcaaaagctggttagtaaaatattatgggtaatggaaattgaggtaaaacatttctttaattcactgtaagttttctgcttataatactctgtattgttcacctttaaaatatctctatctttatacacacacacacatacacacacaaacacacattacattcatgaccacacttgtatctatacatatataacatgtctaattctactgaattaattctatagccatactttcctaagatgaaacagaaaggcttcagaatatatgtttcatgctggcatgacagtgagaataaagaatacatcataattcatttatatgtttgtcctggaaaataccttataaattatacttgagacccaattataattattattttaaatattccaggtttaagcgctatgattaaagacaaataatcccctgaactaagaagcatgactcattgtaaggaaaattttgcctttatttggtttccaaaagagtctatataagactataatcaagtctataaaattaatatttgttgcacaacatgctgtgctataaactagacataggcactgtgatttttcctttccactgccttcttctcctcctgttttgttttttattgattttcatttctctctgtttccatccttctctctctctctctctctctctctctctctcactatctttccctccttccctgcacttccaaccttctattttataccatttgttaaggttttacaatatgccaggcactgggctgagcaattcaaaacaacttttgtttttaatcaccacaataatcataggaaataggtatttattgttaatccatttctcaagtttttttattggaggaaacctagtgtttgacgtgagagaaagccatgcaactcaacacaaaccctccgtggtggagctgcaaatcacactccagtctactctggatcaaattatccaagaagaaatcctaactctcattttctaagtttatgtttaagacaaacttggtttacctttctacttctaatccatgtaagctgattttccataagtaatttttcacctggatgaatgagcaatatttttctccttagaagtctgggttagtctaaagtggtattcttcccataaacttgtaaatgcatggtccttactgcctgatgcatttttattcattggactacctgtttccattttttattgcatttatttattaaactttcctccactctgggccggaggtgactatatatatgcgtgtgtgtgtatatatatatatatacacatatatatatatatatatatacatacatatatatatacatatatatatatgagagagagagagagagagtaattttataactagtagaaatctagagttttaataattatgttctatgatgaaccaagactaaaataactattctgaacctcactagatagaacatttttgaaacctttctacccatgttttatctgtaagaattttagccttggcaggtcacttttggtggtttgcaatctttctactatcacaaaattcttgcagtgtttctcaatgggggcagcaccaccccacgaacaggaagttggcacatctggagagctgtttcagttgtaacagagactgggtgatcctatagtttacagcagttatcacaaggttgttaactgtctcttaaatcaaaggattgagtcatgttttatacaaccttaaaatgtcctactagacatttaggacctcatatgtgcaaacttcatgcttggtcatactttggccaggtataattccctagttgtgttgctccaatttcacttgatcttagccaaaaagtcgagaagcaatttactccaatttcaatgaaagtcatttccctctttcttttgtcatataacaatgtgtctggctagtggttttctattccagtggtcagctgttcctctgctttttatttcctggtacttcttacacaaaaatgccttctaatctcatttttcataaatccaaactttcgtataattggaaacttggcattcccctaacaatattttattgtaccttactttttcgtatttcttttaaaattacaactagagaattataataattaaaacaatatatatttaggttacattatctataaattttatttcagaattgaaaagtggcaattttttaatatataaaagtggaatgttgtgcctgataaggataaaaaccacttgtctaatgcaattcatgtgaatatgatttcaaatcattccccacagtgaaaggcttgaggctaattcatttattatttctaggtgaaagcacgcaatgtgagtcaagtggctctatcttcttatttctcagaagacattattagcataatataatcttacattcatgtggtatttggttttaaatatagtcaaattgtgggtatattgccttactaaatgtcatatatgcattaaattatgaagaagcacctaaatattgtcccaggtctcctatgcaatggggcaaggagggtaagacagcaatgtaaatggactcagaaggccagtggggactatggtaaagttgattaagggtgtcccatctcaaaatgactagtgttactgatttgctttggctatgtcctcatcaaaatatcatattgaattgtagctcctacaattcccacgtgttgtgggagggacccagtgggaggaaactgaatcatgggagtgggtctttcccacgctgttctcatgatagtgaataattctcgtgagatctgatggttttatacaggggagtttccctacacaaactgtctcttgcctgccaccatgtaagacatgcttttctcctccttggccttccatcatgattgtgaggcctccccagccatgtgggactgtgagtccaccgaacctcttttttctttgtaaattacccagtctcgggtgtgtctttattaacagcatgataactgactaatatggctacccagttccaacaaattgttgccatgtaggaatatgggccgacaatgaccaagtctatacattttaaaaggcaagtaaaaaaaaaaaaacatttcttaagacagatacaacaattatggggtggcagctacatacatactattatactatctaacatggggctgtattaaaagctacctattaaaataaacagatatttagcaataatacatataataattgatttgaatgaaaagaaacactttgttctattgttcttgccattcctatttggacatatttattcataatatgtcaaattagtttgcttttagaaatgatctgatacatgttcagagtaagattttgaattaaaatatatgagagatattctttatctgtagcctgcagcactaacatttagggattaagtagtaatatagacaaatagataacatacaatgttaaaatactgacattcaaagaatacaaacttgtttgttttccagttaaaacgagtagggggtcctgtaatgaaggagcccagataaatcacgttgcaatttgtattaccaaaatgaaattcatttagcagcatctcttacagtggtgctaacttcccaacttaagggaaacaagacgaaaataacacatcaggacaaagaatttctggaagaagctcaggggaatttcaacatactgattagttttatgtgagactttttaaaggatattaattcatgttttctcaagctaatccattagaagtttgaatgaattttcccacctcaaccaatgatacttttttccctaaacatatctaaaaataagtcaagcttgctgaaaactgtggatttgaggaggatgtcctaaaatataatttagtttaaatacaaatttatatttttgaccttagtcaccaaactaaagtttgagcacattccaaaactagtatactgtcattgctggtgaaatcaggcccctgcttttgttggtgaggagcattaatgaaaggtgaaactcttcagcttccagaggaatcaaataaacaaaactaaagaatctcttcagttttgtctacactttgtaaaataacttgcacaaaaatttaatactgacccatgaataccagtgactagaaagatcaaattcccattgatcttggtacagtttatgaatttgtcaatgttactggaatccacagtctgagctgacatcaatgatcctgtgccaatgccatcacaagctgtagaaacaagactcagagttaggggattgagaaacttatttttggccaataaatcattgcatcttcattataaaatagcagagtatttttaattgtaacatataaaatatattacaaattttgttttctaaaaagtaaaataattattcattcgttcaacattcactactggttctgctttaaaaacttgtccctgcattaaaatcgaatgacgatgactcatcagagaaattacattttatatcaagacccagtatacacacataacacatacataagtcttacagaaattttataaatcaatactcctcctaacaacataaaattatctattttctactttctttgaaaatatcatttttaatgattttgaaatgctggtaactttagcaaaatgatttcatggcctacatactaatggtctacaacctgcaattttaaaaacagtggtctaatggagaatatatgcaaataaagagttctaatgatgtgaattataaccaaaatcaagggccattcaaatatttatgcttaaattgaacatgctttctgaagcttctaatttaaacaaacaaacaaaacaatttttgtgtgtgggtggggggggatgtatagagaaagagagaggggataaggaagaaacagagagggagagagagaaaacatcatctaaaagtaagtgtggagtttgtccttttctagggcactccctgatactttgaaaagtttaataacattcaggagatttagactttattttcatcttgcttaatttaggtttcattctggtgaggaattagactacccacagctggaagagattccttcctccgctaaaattctatggcatgaattatctgatatatttattttaaacttatggtaaagtttcttgtcatttcatagatctcatctttcaaaatacattttcaagatctggaaagtaaatttcatgcccctctggatctctttttatgcttagcagataattttgtatatagtggcaagcaactaatatgtgttgtgatgccaacataaccgtgtgaactcttgttttttacaaagcttttaagatttgctattgacagagtaacaggcaactttatttctgagttcctatcaatgttacatgtgcgtttttttctgggccattttagtagataaaattcaaactcaataatatacagtgctataaaagttcatattttgagtaactgttcaaaattatggaaagcgtgtgggtaggtttggttgtgagagtgggtttatattaaaaagttggtctacttaaaagtgaattaaaaaccttgttatataggcccagttctaactaaataatctgagctaccactcaccttttgggcaaatgtcagtgcaaggtttacacattttaatcccattttcttctacttccatcttggaactagggcaggcacgcacacaagaactggaatctaccacaaagttatctgattaaaaaaaaaaaaaaggtaaaataagcattaatgttaacattcagcaaacaagctcaaaacaagatattttagggtttaaaaatgattagcatcattgatagtgtttatgtatcttacccttaaacaactctttgtttaaatatctcaacctgaaattgtatttccagtcaaatgcaatgtgtgttaacaacaactagtacttgcttggttactgctccacatattgaattgcccccaagatagagtagatttcttttatatacttaggaaactacgtgacatttagcttgtgtgtgtcaatagttccacttcatttcatgacatgacgcaagtttgaagtccaaaaatacttcaagtccatgaagcacaaatgaagcttaagttgaactgccttggatcagagtacatttcacatccaggagaaaatgctcaaaatgtgttctatttttcagtggagtgccacaaaacctttctcatatttttatacgaagaaacgaaataaaattggaaagggtagtactttggaaaaggtatatcaaatagacaaggagcagtttgttacccaatacttggattaaatgtctagcagtccagtgacatgggatatgccagaacatcccctccaaaataaaggacaaattattgcacctaaaggctctcacaataaataggaaacacaatacctgctaggccactctggttttaaaagtagcatccttccatgcctgggaatattgttctggcacaatatgcaatgttgtggaatgcttacagccttgaggggtgcccaaagcagaaacggcatatgatgtatatctaggctgtgatgcaagcaatattgctacttgggccataaaacccaagaggctctatgatattggaagcatctatagtgggaaaatatgccatgtagatttatggcaagtttcatcagaaaatcacaacagagacttctaggtttttagagctaagctatgccacctgtagcacaggattgcacaccatttaataaacagcttttgacatgcttctgggtcctggtagagatggatcttgggtcagaccttatagccagaattgcctatcatgaacagggttttgctataatgtcacaatgtcatcatgttgggcaggtccaagagcattccattgtaaaattaaagtaggacatgtgtaggggcagaagcacaagtaaactgcataagcaaatggttaagaggcccccatgccatccaccactgggctggcccctctcagtcatctcatacctatggctgtgtgggggctaagagaaggcacttaggaaaagctaacagagtaagacacaaaatagactaggtatgtggtactagctgaaaatggatggcagcttctctgtctgccatctcacctatgactagacttgaagcacagagacaagagaaaatcttaccaacgggtataattctaggtagcgaaattgattactcattttgtatgaaaagagaagttgcttgaccttagaatatatatgaagtaatgagcttgtcctgagagaagaaatactggaaaatttgagaagaaagggaatctggtgcaaagaatccatgggagtgggtacaaagtatggaaaaatttgcattccaagtcaatatccacatgaaagcatccaccacaacaaagagtcactttgttgagatgatatcaaagtccaatcttgctttcttcccttccccaaaaagtgctgattttgagactactccttaataacctaatctctatctcaggggaacccaacctgcaacaggtgcatacatgatattaagtagccattctttcttcaaggtcttgtgatatggtttggatctgtgtccccacccaaatctcatgtcgaattataatcctcagtattgggggtgtgacctggagggaggtgaatgaatcatgggggtggcttctcatggtttaacaccatccctcttggtgttgtcgttgcaagagtgagttagcatgagatctggttgtttacaagtgtgtcacacctcctgcctctctcttcctcctgctctggccatggaagacataattgcttctcttcaccttcactgtgattgaaagtttcctgagccctctccagaacccctcatgcttcctgtacagcctacagaaccatgagccaactgtacctcttttgtttatcaattacccagtctcaggtatttctttatagcagtgtaagaaccaactaatacatcttgggaaatgcgttacaatgaaaccctttcacatttctgccgaatggaataaacaaatattataattagtcttatatcagttagattcaagttttgcacccaaacgagtttcagaaaatgcatgtttggagtttttaaatttcagaattctggattaggaactgtagacctgcatttagaagctgaatgtccgaccgggcacagtggctcacgcctgtaatcccagcactttgggaggccgaggcgggtggatcacctgaggtagggagttcaagaccagcctgaccaacatggagaaaccctgtctctactaaaaatacaaaattagccaggcatggtggcgcatgcctgtaatcccagctactagggagactgaggcaggagaattgcttgaacccgggaggtggaggttgtagtgagccgagattgtgccattgcactccagcctgggcaacaacagtgaaactctgtctcaaaaaaaaaaaaaaaaaaaaaaaaaaaaaaaaggccgggcgcagtggctcacgcctgtaatcccagcactttgggaggccaaggtgggcggatcacgaggtcaggagatcgagaccatcccggctaacacggtgaaaccccgtctctactaaaaatacaaaaaattagccgggcctggtggcgggcgcctgtagtcccagctactcgggaggctgaggcaggagaatggcgtgaacccgggaggcggagcttgcagtgagccgagattgcgccactgcattccggcctgggcgacagagcgagactccgtctcaaaaaacaacaacaacaacaacaacaaaacaaaacaaaaaaaaacaaaaaaaaaagaagaagcttaatgtccttgttttcccaagaaagcttcaatttggcaaaccaagccatgtaagccaggcccatcagagatttaaattttttcatagacaaatactgaagtgctttaaattagcctgtagtttgagatacacaaactaatctaagaaaggaagactgtaagttaccacatttaaagtaaacaagtcaggtaatttcacacaataggtcttcatgtttagccacttactacagtttggagttgacagctttcaggtgaatcactataagggctatagtaaagaaaaggggaattctctaattcaaattttcctggtacttctgctctcacccaaccctcgggcttcaacctaaggacttgaataaaagggaaagcaccaaaaaaactccaagaaagcatagttttgactgtctttgggaaaggcatcctaatttgaaggtagtagattaggtagtagtataatgcgcttctaagaaaagggaaaatatcatttagccccatcctgcaatactgccaagccctcagttttgtaaggatggtacatggtgacatatagggtgactttagataagaggttattagatgaaaaggactggtgtgaatattgaaatatttaagatgcaaaatctttgctgtcttggagttagtgtgtctgtgactttaaaatgctaattaagagacatattaaacacacatatatatacataaagaagtcaaagtacaatttttactttaatggatatgaacgtgtttcataacaatgactagaattgtgttttcaaagcctttttaaataatctacccctctcggcctggtgcggtggctcacgcctgtaatcccagcactttgggaggccgagggaggtggattaactgaggtcaggagttcaagacagcctggccaacatggtgaaacccaggctccactaaaaatacaaaaattagctgggcgtggtggatgtgcctgtaatcccagcgactcaggagctgaggcaggggaatcgcttgaacccgggaggcggaggttgcagtgagccaagattgcgccattgctctccagcctgggtgacagaaccagactctgtctccaaaaaaataaaaaatctacccccctcatccttatatcctatctcttcgattgttataatggctctggaaagaaaggagggaagatatatatattttttgagacagagttttgctctttttgcccaggctggagtgcaattgcatgatcccgactcactgcaacctctgcctcctgggtataagcattctcctatctatctcagcttcccaaatagctgggattacaggtgtgtgccaccacgaccggataatttttgtatttttagtacagatggggtttcactatgttggccaggctggtctcaaactcctgacctcacgtgatctgtccacctcagccttccaaagtgttgggattacaggcacgagccaccgtgcctggccagaagatataatttttataacccacatcttaaagaagaaaaaatagagaacaaaaggtgttatttaaaaatcacatgactaataagggaacgaagccacgatccatagccactctaatcccatgtcccttacacacattgagtatcccttatccaaaatgcttgggaccagatgtgtttcagatttcagaattttttggattttgtaatatttgcataaacataatgaaataccttggggatgaaaccctagtctaaaaacaatattcagtttttatgattccatatatcttatacacatgacctgaggtaattttatataatattttaagtaatgtttggtgtgaaacacagtttgtgtacactgaaccatcagaaacaaaggcatcactatctcagccatcaacatagacaatctgtggttgtttggcatcaccatcattcataacactaaatttatatactactgatgagcaatcatattcttacacttattcacacataaatatataaaactaaaaaaaaaaaacatggtataccactaacacagtgaaaagataatgtgtttggaataactaggtatcagagtagaatgaccagaatacctccatcagctgtgaaacaacaacaacaacaaataatgcaggcttttagtgtccatctatgatgctgtgttttgattaaaaggttacgatacactgttttattttcttaggtaaaaagaaacatcagaaacagctgagaaaccagggaataggtcctacagggataagggggctttctgctggatggctttttaaaatgtttcctccagggtcatttgcccattaacagtgaattttgtcttagaagtctctttttgattttataaactcccatgacttcttgttctgttatgaatgcaccatgctctagtccttcagtgagcccataacacattttcatcatgtcttctgtagataactttttgtgcaatgttaaaaacattttcattgtcactattaccacgattgctttgattcagagcgacttctgcaatttcaccatcagtcaatgaaggaacaactcgttatcaatgttaaaaacttctgtgatatccatttcttccagtttactgatggactctgaaggattatttttttctcacctgacatagggaatctttccaagtaaccacctttttcccgaacacagtcataggtcagaggttgtacctggcatgcaaaactgtgtctttagtactgtgttccaagcattgacaacagcatatacagcatccttcatgctaagcttcttttgaaaaccttcccacacccaggtctttgttcactgctgctagcatgctgttcaagaaagtgtttttggccaggtgcggtgggtcacgtctgtaatcccagcactttgggaggccgaggcgggctaatcacaaggtcaggagatcgagaccatcctggctaacacagtgaaaccccgtctctactaaaaatccaaaaaattagccaagcatggtggcacgtgcctgtagtcccagctactcgggaggctaaggcaggagaatcgcttgaacccgggatgcagaggttgcagtgagccgagatcatactactgcattccagcctgggtgacagagcgagattctgtctcaaaacaaagaaaagaaaaaaaaaaaaaaaaaggaaagtgtttttgtatttacttttcattgctctaaggatagtctgtttacatggctgaattaatgaagtcacatttaagggaaagtacacggcataaacattgtttttgatgagaatttcagctgcaggatgagtagaacggttgtcaaggaaaaacaaaatcttgcattcaacatccagtccagcttcccagcgatgagcaggaggtgctagtataaaatgtttgggtgaagccaataagaaaagttgttcccggtaaccgatgcatttttagtagcataataattggtaagaaattcactccttggaaactgaggatgcaagcttttgcctatcacagcaagtttacatttatgtgtgcctgctgtattagcacattccagcccagtcattctgtctttggtatccttcattcctgcaggggctgtctaatgaactgtggtcaatgcctttgtggaggagcaatgttaaaacagtgatgtttcatcagcatcacagaaatgtcctggtgtcagatttttatcagtgatgaccttggcaaactcaatgatgaatttctccactgctttgtgatcagcagatattttgtcaccgggaatctctaaagatttaacgccatgtcttttcttaaatttttgtgtccagcctgttgaatatttacagttctcttcaactttcagttcaccgtgctggatctttgcctgtttgatgatcagcataccattatgtggcttatgttcatctacatgctgaaaaatccactctttcggtacacaagcaagatctttatcattagctttattcagtgctgttctatttttcattaacttctgttattcattttcagcatagaacagtttatccttctgtttcttcaggtcacacaaagtgttcataccaacactgtactcttctcttctctatgatgttgcatacttacaccgttctcccatttctccaaaagcttgactttctaagctacacataaacataaatgtttcctcttatttttaccacccttacctggagggatagctgcaggcctttttgacattttcaacaatatctcaacaccacaaaatggcactttggaaaacctgccattggtgtgtctggcctgcacacgtgccattttattacctgtgggtgtgcttccctttggaaatctgggtatgcaaggaaaagatgtaccacagtcgaaaggggctgagagtgtgtgtatgtgtgtggtttctttccctcttgggaacactaaacaaactgtgttgtgtgcattttgactgtgacctatcacacgaagtcaggtgtgaaatttttcatttgtgacaacatgtcagcactctaaaagtttcaaatattggagcatttcagattttggatttttggattgtggatgctcagcctgtacttcctactgtatcacatacacaaagtgaagtaagtcacattatatgtatagcacagactataaataattcttttaaatgagtatatgggcatatatagtgatttttttcagcctttccaataggaaatgtcccattggttactcaaagcaaaaaaaaaaaaaaaaaaaaaatagagtcaagtaaatatcaatatattatcctgaatacctgatgaaagttaagtcggtccttttgaatcctcaggatgttatcaatttgtttaagatcctttaacataccctttatatatatacatgttttatttaaggttaatttgctattaaacatatatatatatatatatatatatacatgttttgtttaaggttaacttgatattaaaaatataatgctaagtattctagttataaataaggaatcagaaataattttaggtaaaaatccattgttattagaagcagatcctattcattacacagcttgctgccacttaactaattacttttttggagaaacagtatgataggcaaaaatactgtggtatagtaaaaacagaaagaggtttttgtttgtttgtctgtttttgagatggagtctctctctgtcacccaggctggagtacagtggcaccgtctcggctcactgcaacctccacctcccaggttcaaaccatcctcctgtctcagcctccagaatagctggggctacaggcgcccgccaccacgcctggctaatttttgtattttctgtagagacggggtttcaccatattggtcaggctggtctcgaactcctgacctcaggtgccacccacctcggcctcccaaagtgctggcattacaggtgtgagccagtgcgcccagccacagtaggagttttataacctcaaacatgtcatccttttgctatgaaactttacacaaatcactttaaagttttggtttagtttctttatttataaaatgggggcaatagtatctatacccaaagtacttataatattcttacaagtttcacattaaaataaacttacataaaattcttttgatttcaaataatgacctaattaatttggttattcttattctgttacttacgtggacatttcttgacacagaatgctccatatgtgtactttgcattgaaattgtgctccagttgaaaggtggttggattgtagacaaaggtttggggacactgagtaacacatgctccactgtcattgaaattcatgcaggcctgcaacacagcaaatattactttcatttacaaataaactcataatacttgttaatgaaacgctgccaaaacaggagaagtttttttctataataattccacaaatattacaaaatttgataatttaagagtcatgtgtgtttccaaaatttcataaaactcttttttccagtatcagtaaataggaaaatttatggctactgatgctcaaagtgcttagcctgtatccagtaatttctaaactgagaattggtttaaagttagctaatagtgaaaaattatttgagttcacacttattcaaagcatttatatttagtcttaaagtatagcactgacaaccaaatccctaattctacaggctagatgtccacttgagctggtattttaaagagttccatatcccaaatgacatgtaaagtacaattatcaccactgtcctgtaagaaaacattgtgatggtgatttatatcggacttaaagaaaaggctctggctggtgactagccaaatacaaatacagtgcatgtaatgccaaaatgtaaagaggtaattagctacagttggcctgtaattaaataatatgatgtcatttctagtatggcttttttcctaatgccactccatttagtaaaagctaccatgtagaagacagttcatttctgctgactcgtatatttatattcataactcaatttattaatattttcaaattcatttgggaagaattaaaaaccattttattacctgagaggtaggtacttgatataaaaacagaatatatgtgtaagtacatataaacatgtgattaacaaaaatgtggatgagctaattctttcaattaagaaattaagccattttaggaatgatttgggccttggaaagcaagctaatacgaactcaagctatgatttacatttaatcataaatagtacatatggttattaataagcattaatttattctgtttcctcaaaacattgcttcatcaattgttgttttagcaagcactttatcataaacatgacaattccctgatgatggtctactagatgcataatcagaacaagacttactgatgacacattattcactaagatgacacattctaggaagaatctattaagaaccaatctagaaaactcagtaagttttaatttatggttataaaatttcatgtgtccttataattgctttactaacatattttatgcaatgctgtacacagattgctcaggaacaaaggaacataagtcagaggaataaaacaaatttagctttgcgacagcatacaaaacaatgtaacttacaccaaggccttagtctggcattcttgaacattctgtaccaaaagccaaagtggaatcattagaccgttccataaaagtaatgaaatgataatttgaagctcactcagcactgtgcttatcatgataatggaaccatgacaaaaactgcatgcaaaacttctaagagtttttgctattgctgtttattgttgttattgttttggaattgttaatgaaacacctgcagtgttcaatgtcttcagaatcaagcttccatcctacgtctgatgaaagacagaggaaggttctcagttcaagacctactgagtatcttctttaaatttttaacatttttatttccttttcttcttcctccctatccatttctgcaatacatatttttgtttcactatagaatgagtatagaagattatattccttatgatattaagaaaactaagaaattactgtctatatcataagagctttaatatatggtttgctcattgctggaattaagtgtctttctttttttttttttaaaaaaagctcaattctactacatatgtttgctggatatttgagagaaaaaaatttctgtgttcattttcaactatataaacatttgtgtatttttacgatttttagctttaaaattaagctggtgttctcggtatatgaaattgagttaaatacaactcaaaattgctgacatgtatgccaaagacaaagagtactgtgtcaggaatatgatatcaaaatataattaaaaactgtccctaacaaactatttataaatcttaaacttttaaaataatattacctttaaaatataaactagaaaatactgaaactcataagtatatcttctataatcttgaaatttatattcaagaaataaaatgcaattgctcccacttgcagaactcagtgatgcaaccacataaacaggtaatcaccgcattactggaaaggatgttattagattataaaaagatatctcaatatgttctccaatgaacctcatttgtaacataaattatatcagaaatatacaattcatttaatagaacaattctagttaatcagtagacaacctagtgagggaatgactttgaggagggcagagcatttttcttaatcctaaagtggctaaagttgatctgattgtaataagacaaagattcagtatgcctgaatcaaatagggaaggaaaggagagcaggataataaaagagagaaatcacagacatacaaagcagtctgtgtccttaggtcctgagcagcctccagcacattctcgatggcagcagtcactgacgtaaggtccgtagcatctgccgtcacattgttctgcacacaccgtccttgtcactgcagaagacagagataggaccatgatcaaagtctgccaccaggagaaactcataagctgagttctggagtgacaatttctcaccctgtctttgactcaattcagcaaacatttaatgaatgaggtttacaactagatcaaaatttttatacaaaaatctccaaaattaatttataattatttcatttttatattctttcttgtttcagcaaataattacaatgccttatgacgatcatacaacttaacaagaaagaatccaatttgaagtcaggcacagtggagtgtgcccgtaatcccaactacttggagactgagacaggaggattgcttgaggccagtagttcaaagatgcagtgggctacgactgcacttgtgaatagtcactgcactccagcttgggcagcatagtgggactctgtctctaaaattaaaaacaaaggaaaattgagataactaaatgagacatttggcaggctaggaaaggtgaagtcaattcacacaatgtgcatagtaaggtcctagtagaaggtgtccccagaaatgggtctaagacttttagtagtcaatgcagaaaagggacacataaatgttaagttaattcacataatattttacacgaggaaagaaaggaaggaaggaaggaaggggagggaaaggaggaaggaaagaaaaaaggaaggaaagaaagccattaatagtaaacacaacaaaaatcatcattggtcttttcttataacatgcttcaatccaagctgacagcatcatatcgaggtatactttagtaaaagcaatacgaaaggctatccatcaacattatagcaataagagacacaattctgcttatctcacttattccaaaaatatttttagggtatttaaggtatgaattttacaggatatgtatagtatatcacttcctggtttctgtatttccacttcagccttgtttcttcctatattttcaaacagatcttctaagctttctttgttcctaccttatcaagactctgcctcataaacattagcattccccagacctgttcttgacaattttggggggactatgggctcattcctggataaaagtcattcatcttctacttagcatactgtctaccagtaaatgactttcagatctagaattgagttctctgtggagctacagcatgcatttctagctgtctacagaagtccccattttgatatgcaaggtgtacaaaacagaacataactcttcttcccacacccactactgagtgtatttcttttctaagttcccttatctcaattaatggaagcaccatatatccagtagcttgctagtaatttgcaatgtattttctgtctcctatcctcttatcatcacttctcctacctaataaaattgccaagtattagcaatagttttctaaatattcctcagtactttccctcctctctattctaactttattcaaaagcctatctctaaatgattacatagtgttctaaaagttttctcagatcccatcttttccttccagttaatcctccacaatgccctaaaagtaatggcttgaacctgtaagccaacgcctataaatcagtgttgattcacagtatgaaacttatgaccatccccgtactaaaggattaaaccttaagcaagggacaaaagccctccataagttgaccaccatctctgcccttccaggaatcacattactctgtttctcacgtccagccagatagaaacactacttgcaattaagttgtgattctcattgcttcttcacaaggcatttctccatgttaaaaatccttcctagcttctcagcctaggaaatacttgctctgaaacctttccagacacagctccaagctgagttattttctcactattgcttctgaacaagcaagaagataaagttaatgcagcagtctatgtagtctgaagatctaggctcaaatccaaaatatatccacgttatatgggcaagttatttaaccattctgtattttacttcaccatttttaagatggagttagtacccacctaataggattgaagataaatatacaggtataaagtgctttacatggtccctattaacagtgctcatcaacttagatatttctatggcacttatacatttgtatttttttcaagtttgcttctacctcaccccaactaacctatgggtttattgaagtttattgtcttacttaagttttaattttcagtgataaacacagggtttggtacttaatacacaatataaggcagtattcccttcaagtaaataggtaaatcatatattgccaactcaatggcagtatctcctcagggcttaatatatttatcagagagataaaaaggtgtatagagttaaagagataggtcactaagaaatataaagagacaaatattaaaatactaggatttaaatgctccttaaattctgctgttgattagttcatgatttcatatttttaattggatccttttccattgaacatgatgatgatattcataaaataatgcacaatattgaaagataaagaatattcttccatttgacatgattaattaattattctctatgtagtacaaccaatacaaacatcaaataaagtttaaactaaaatggcacttggactcaccctctgtcatgttttttattttgtaaaaataaggttacatgctattttttaccataagcttatagaagatttggaaaataatcaaatttttatatctgggtttgtgaacgtatattttgtatttgcaattttggttacattaaacttcaaaataaattatttcttctattagtatcctggtacaaaattctgcataataaatccccttggactgtcccttcactttctttaagtctttgaccaaatcacacctttgtattgaagtctgcccctgtttaatactgaatttttcccaatcaactgactccttatgaaccttcatcttcttttttctctctctttctttcatctcccttccttccttcctgtattttgttacagcatcaattaccatctaacatattattatttattccatttattttgtttctaggtgtattactatgtttgtaactgtaactggcacttacatagttttatttatatttgatacacacattatatatatatatatgatatgtacccaaacaatttgtatcctttcattaactcttcatgtcatacattatgcttatattgatatttctatcttttaaccaagtggtatatttgtttagatgccctaattagtaattcatacaatataaatgacattttttaaaggaaacacttttaacagacagttttgtacagaataaattcaaacacaattcttctcttccaaattcaataaagtgcttcgatgcatcaacagtcgctaattaaaatagcagacatatgttaaataaataaataactagatttgaaatgtgttatcacaggagagtttatcaatttgcttctatttgacagctattgctcagctggaaaacaatagcatggagtcaacaatcttataagtcacatcatattttaatcatagacagatatgtctaagtgttactttttatttttaactccatggtgatttaaagtaactagacaaaatgtttcagtttctctgtatttactttggtttttcctgccaaatgagaaaattaatgtagaaaataattacaatgataagacaagtaaccctgaatgtagtttaaaattatgtattaagtgttcacgttaaaatcatttctctcattgagtacactatttaaatatgaaaataatattatacaaatataatccaatgtagtacaatcttagattcaatagcaattattatactgtggaactattaaaatattttaaattatttaatcatttgtgtggaagaaaacttaaaatttttgaaaatagcaacttttccacatagtattcaaatatttaatattttttcaggacacactgatttctgatattatattcccttttagaaacatgcagaaaaattcctctaaattattatccaaatgcagatgcattccacaatttttatttaacatgttaaaagggagttatggctttcattttccaaaatcagtctataattgatttttttcaaagtaaattacattcaactttaaatatagggcttttcaccatcaacatttttatatcccttaattccaaacgaaaattcagtaagcatgaagcatttggacacataaaaggtaggcaaaaagaacaaaacaacaagcttaactgctaaacagtaatggggttaaaaaaaatatttctttatattattatatgagacttgtaacaagaaagaaaacattccctttgtacaattcaaggctacatgcaagacaagtggaaaggcaccatagagtaaatttatttagtagcattttttgattaataagcattatttaatgtgaataaactcatcaaattatactcatattttattacaatggggacacaaaacaaaaaataattcctgaaatcaatgagataagtcagcctctataggaacattaacttataattgctttggtttttattaattccatccttgctcaaatatttcattacatttttttccttgtatttagtttcctttctaaattgcttcactgggtgcattaaaatatttgggtccaattttcactagctttttcattggcggtatgcactaaatgtgattaatataaaatttaaaactgggacgttaaacttcttatattcgggtcagtaaacttgacatggggaatgtgaattcattcaaaatatccatgagaattagacgggtaacatttaaggaatcaaacaattcatggtaagccaatactactgagagaatgtctatcaagtcaaaaaatattaaaaaatcattaagtagcttaatcttatcagtatctcactaataagaactatggcttaattacttctttcaatataatgataaccaatactgtgattaaagttactcccttaggacaaatttattttacttgaagaagcttggcaatttactaattaaatatttattgttgcttcctagcaacaatagcaaaaaagacaaagaatattcataaataatgcaaaacagagcactgacatcacagtgacaagacaaaagatctctgttcgcccgttaacaatagaaataaggataaatttaggcaaagtctttgtgtctttttacactctgacacttcctcctcctcccccatctccttcctctttccctatctcctctgtcttctctccttcagtgccttttgattatcttcatttcctctaaccagtggttctgaactgggttgtatattagatcaactaacagtctttcaaacttgaatactggaattcttctgtaagtaaaacttttcattcagttggtatcagtggggcccaagactttttaataagcccatttctattaagctcccaggtaatgtctctacctactcatctacataccccatattgagtagcagaatatagagtagtttcaaaaaatacaatacctgagaatcacctagtttctattaaatcaaaatcgctggcaattttctagaagctttggtagttttaataagctccctgggattccaatattcagtctagagttgagaacctttattctaaccaatgggagaaatgggagaaaaaaattttaagtcatttacaccatctgattgactgactgattattccttgtctgaaacttaatcacagtgacttcttgctttaatttcctatttgtgttgtaaaggtccctatcactaattggaaaatcaaacaaacaaaaattgatgtgcaagtagatataggaaaatttgggagggaaattacctatattttcgatggaaatattgcctcactggttctgaaggcaaacattatggataaatgaaataccagtagaaaacttcccttctctcacccagcagctgtctgagtgaaaagtatcttggggcaatccccaattgcactgctaagcacattttaaagcatatttattttattttttaaaattttatttcagtttttattcaaagactcatacctctatgctgcctctattctatttttgtgtcaaaattttgacaaattatgatcataaaacatatgttcaataactagatagtatttgaatggaatgtttttattacactgtttccagttacatacttggaggtttgaactagaagggagaaatacttgggttaaagtagaggtgatatgggttggatgtgaggaagaattactgactattagagggataaaaacactgtaatgggcttcttaagtgtttatttgtcagtattttaaaagaaatctcttctacatgctttagacatccacttaattaaagataggaggcttgatgaaatgttctctagaggtaccctctagctctaagattcaaaatttattcctattaatgatgaaattgtgactaaaaaactgaacactttgggttgtgtaacatgttttaagaaagctatcatcaacaggatacacttaaagtgaaacaaataaagctcacagaccatccaagaagaggcgttacttacagagcatgtgtaaaaaatcaggttcaatgaaactaatgccaaactatacactgttattcattcttccaaaggagaataattgaacacatttgtgtgtccagggccaggtagaaactaaaagccaagtagaaagacttaaaataaagatgtctggcccatctcctatattctgactcagtaagtctggggaaggtgtcagaaaattcattttttttttttatttggagccttaagatttttagaagtagattttataagccaatatttccaaacttctgctctaaggcactctcttatttctaatgaaaggttcccatagatggaaaggcagagtcagagctgggttggtcttaaactagaacgctctttcctatctcatattaaattgcagaagaaataagtcaaaaattgttgcctcacagaggaaggcttcatcataagcctatatcctaatttttacaggaaaataattttgcactttaaggatttttcaattcttttaaccagccacagtgtattatctaacatatttaaaaaggctctcagaggtcttttttgaaaaaaaaaattagacctagcaaaatggaattatcaaaaagtatctgggcttctaaatgaccacaatcatacacattttcacaatacaaaataaaatacgactaattttcttttattcctaattcctaattggtttggtgatagctactctaaataaaccgaccaggccatatcatgaagtatataccccacatgtaaaataactgtttaatccaaaatgcaataacctctgtcattcccctggaaaacatagcaaatagctgtacagtcgctactgaaattgacattcagagtcagttaataaaagtagggccaggccggacatggtggctcacgcctgtaatcccagcactttggaaggctgaggcaggcaaatcacgaggtcacgagtgaccagcctgaccaacatgctgaaaccccatctctactaaaaaagaaaccccgtctctactaaaaagtacaaaaattagccaggcatggtggcgcgcacctgtaatcccagctactcaggaggctgaggcaggagaatcacttaaacccgggaggcggaggttgcagtgagccaagatcatgccattgcactccagcctgcgtgactgagtgagactccgtctcaaaaaacaaaaaacaaacacaaaaaaagagtaggcccatattttggcagctactaatcaggtttgacctgatgaatccctggtgacccacggactatgacatgataatattgttagttgtgtcaaagaggtaagggattctgtctaatccattccttatcaccacctgctttattcatttatttaatgaagttttattcaacctatttaataaagacatgatcaatgattcattgagggaccttaaagctgattataaactacacacttggtcaccagggaaattctcccttcttaataggctattagcatctccacagtttgtgagtgaagattcaaaaaataatattgccttgttacgttaactataaaaatattcttgagagtgagtaagagttattttgcatattcctcacaggcctgtagatattgatttcaaggcaataaaggaagagtatgaatctgcgtaagaataccatagtatttttaagaatatttttaaaaattagaattgaggtctgcaccttaaaatctgcctataaatgataggctgcagataaagtagtaaaaaaaagtcataattatatcatagatctttcataaaccaagaaatatggaaaatttggtattcaaattttttaaatcactgtgcattataacagacatctccacatctaacctgatagaaaaacaaacaaaaaccaaaaaaaaaaaatttactttctttcttttgcttattctagttccctatccaaaatattagtagaagaaaacaaatataatctctctctcactcaattttgcaataaaaatacccacagaagggccaggagtggtggctcacacctatacacctagcatttgggaggcagaggcaggcggatcacttgaggccaggagttcaagaccagcctggccaacatgaagaaaccctgtctctactaaaaatacaaaaattagccaggcagaggaaggagaatcatttgaacccgggagactgaggttgcagcgagctgagatcatgccactgtcctccagcctgggccatgcagcagaaaatatttaaaaaattttgaaaaaataataaatatttaaaaattttgtctcaaaaatatttttaaaaattgaaaatacagaatgttaaaattaaaaaaagaacatcatattaggtaaacaatggacaaatatctgttgaaacaataaataccatcaagtccaaatttctcattttattgatgagaaaattaaaactgaaataaacttacttgtttatgagcaaatctaaagtaatgttcagacatctctaagacagatcaccacttcttcagagcattccaggaagtttctagttttgatgagggtgaagaattgggcaaactattagtgggtgtataaattgatacatgattttttgaagactaatttgtctctatcaaatttgtgtatgtaaattcacatgtgaccaagcagttctatttctagaaatctgacttacagaagaatgtgcatctgtggacaaatatgtatagaaaaatgttcattagttgtaactgagaataatacaatgtaacctaaatgtccactaatgaggaattggttaagtaaattatagcacaaccataactagggaaatagctgtagcattaaaaaaaaaaaaaaaaaaagctgggcgcggtggctcacggctgtaatcccagcactttggaaggccaaggcgggcggatcatgaggtcaggagatcgagaccatcctggctaacatggtgaaaccccatctctactgaaaatacaaaaaaattagccaggcgtggtggcgggcgcctgtagtaccagctactcgggaggctgaggcaggagaatggtatgaacttgggaggcagagcccctgcagtgcagccactgcaatccagcctgggcgacaagcgagactctgtcaaaaaaaaaaaaaaaaaaaaaagacggattgttctctatgtcctgaaatgaaaggattttaaaaatataatgtgaagtgaaacaaaagtgatagacgaatagacatggcatacatatttttgtaaaacacacagaacaaaatcccacaacttttatgtgcttatgtgtatatgtaaatataaatacacacacatataccaaatattaccataaagtaatcactttataaaaaaatgtaggttgagggaagcatatttactgatgggaaggcattattatttttaactttatgacctgagtatcacatgaatttaaaaaaaaaactatactaaaataacctgtgcatttggcagagcaagttaattatcccagtgttacagatgaagaagttaacatttaaaaactagcttatcctaggtcaaatcataagttattatcaaagtggagtttaaaattagttttctgactcctatatatcttcatttacatgttttcatcaagttaagagtcacaaatagaaggtgcctaaatgtaaaaatcaaaaggactaaaaggggagaggaagatagttttggaaactgttttaaatacaacgccaaatagctaaagtgatcaaacacgtgtctgcattacgtctctgaaaaacagcttggctgatgctattttaactaccatgattgtgagtgatgataatgaaaactaagatattactcaaatactctttaaatctcagacccagagagggccaacaatgaaaactaagatattactcaaatactctttaaatctcagacccagagagggccaacactgaagtctatacctcagaaaaagagaccttttgaggaaaccatttaaaagagttataccacaagcacattttgagtatatacagaagaatatgttttgcttttctcctcatagaacacgtttgggattatcttcttaaaaaagataatcaggccaagcagagtggctcacgtctgtaatcccagcactttgggaggctgaggcaggaggatctcttgagcccaggcattcgagactagcctaggcaacataatgagaccttgtctctaccaaaaagaaaaaaggaaaaacaaaatagccaggcatggtggtgtgcacctgtagtcctagctgcttgggaggctgaggcaggaggatcacttgagccctggagttcaaggctagagtaagctatgattgtgcctctgtgctccagcctgggcaacacagcaagactctgtctcaaaaaaaggaaaaaaaaaaaaagataatcatgtcctcctacaagtcacataatgcacctttgtagtgtttttcaaacttttgatttttaaaaaataacaatttacagtacaaataacattgtattatggctcagtacacatatccttgatgaaatgttttgaggaataatgctgagcctaatcagtgcaagagcattttgatactgccttttctggtcaattttattccaatgtatcttatttcaataaaaatgtattgttgggcagggtgtactgaagtgattttataatctactaacaagttgcaaccagcaatctgaaagcattgtcttattgcatgaacaaaggtcaaattaagaaattagagaaaccgatctctgtgctcttcttatatatgtacagcaaattagccttctaatgaattcaggaatttagagccactggtgataaaatttcccttttctgaagttttaggattctagaggatatggaaaatcactgcacaatacagcctgccataatgccttatcttcagaattgtgccattgagactgaccattctcagaggtttgtgctttttattcccaccataattactggaaatttgggatcgttcagtctgaatttctcctacatggcagtatattaaattgtgggccaatacaaaacaactttttggatcctctccaagcaatatatttatagaaaataatataatctatagatattaaagcttttatgcatgattaatatattgataaaaaaattataatctctctgctcaggacaaaagttcggaagtcctcaacatttaccaaaaaagtcatgtcgcgataaagagggtattacttattatatttgttgttacttactttcttaaaattctgaaattacatatgcagtacctattttcagggaaatataagtaactacagatatgcagaattaaaaacaattcatttgttctcttactccagcagtaacaaccaatgtcaacttttgagtctctgtgaatgcttgacatccctattatggttccacactagtatgagagttaagagaacacaaaacacacaattaaaagtaattcaaaataactcagatctttacaattttcaaatccaggaaggggacacaatctcccttcctgcctccagaaaattatcccatcaatccacatttctctacatgcagaaatctcatattctcctccttcagaactttctctagtcccacttcttcttgtctctcctaccttatttccagtgtatataccgaaatgattcatgaggttggaatgagataatacatgtgaaactgttagtacaaaaccggcacaatggataactacaggaagttctctggagatgactttacataattttgactttacataatagctaattttcactttacgtaatagctgtgccagattagacacattgcttaacctctctgtgatttaggttttcatctataaaataaaaataacaactgtacttacctcatgaagctgttacaaagattttatgtattatgggaaattattaatttggaatagtgcctaacatgcagtgaacattatataaatattggctcttggtattgttaagtaatcgatgaatggtagttattatctcgctttatagcttggtatttttaactaaatattatatcattaactgtcttttgtagaagcataaatatgcttctgctgtattattttttaaagctctatattatactattgtatgaatataccctgaatcccctttctaagctatttgcaatgtttgtattttttactattataaatactgctgtaatatatactatggaacattcgtttcatgcatatgataatctaagtgttaaaataatacatttcgtggttcaagaaaatgcatatttttaaaactttgatacaaatgactaattagtctacatggtgatttttacctatttataatctaccaagaataactgatactgttccaagctcatactttctttcttactaggagttatctgaatatgtttttaatttataaagttgtatgtcattgattataagtaatgtcaagtattttttgcagatttcttgtataaatgttcaattctttttaattaaaattattttaaaaatacaaaactatacttaactataatgcagttaaagtaatttttcctttgtttttgtttttttttttttttttttttttttgagacagagtcttgctctgttgcccaggctggagtgaagtggcatgatctcggctcactgcagcctccacctcccaggttcaagggattctcctgcctcagcctcttgagtagctgggactacaggtgtctctgccaccacactcagctaattttttgtatttttagtagagacagggtttcaccatgttggccaggctggtcttgaacacctgaactcaggtgatccacctgccttggcctcccagagtgctgcggttacaggcatgagccaccacgcccggccctctttttttttttgagatggagtttcctctgtcgcccagactagagtgcaatggtgtgatcttggctcactgcaacctctgcctcctgggttcaagcgattctcatgcgtcagcctcccaaatagctgagattacaggtgctcaccaccatacccggctattttttgcatttttagtagacaggtcaaactcctgacctcaagtgatccacctgccttggcctcctaaaatgctgggattacaggcatgaaccattgtggctggccagaaaatgatctttttcttatattttattttgtatttgttatgtcatgtttaaaaaggcagtcatcattctgtaatttttatctctatattttttcctagtacttccagttatatcacatgtttttaaatttttaatctataattcatcaatctgtataggtctatctaaatatagactatatatagtctatcctatgctctttagacttttaatgtactacccatcttatgccttttgttttattgtagggatctaacattatcttattccataagtgagccatttattcatactctctttgttaaataatctatgcttttgtcatttttaaaaaatgtcacctttgtaaaaactaaatcactgtagacatttgcctccaaatgtctaactttgttagattccatttaatcaataccattctgaaccagttatacactgttttaataattattactttttaacattttaatacttgatagggaaaatgattccacaaggttattcttttcaaacatctggctatttatttatttatttattttgagacagagtctcgctctgtcaccaggctggagtgcagtggtgtgatcttggctcaccgcaacctctgcctaccaggttcaaccgattctcctgcctcagtgtcccgagtagctgggactacaggcacatgccaccaagcccagctaatttttgtaattttgtgttttggcagagacagagtttcaccattttgaccaggatggtctcgatctcttgaccacgtgatctgcccgcttcggcctcccaaagtgttgggattacaggcgtgagccactgcgcccagcctcatctggctattttattaaatgtatttttaagatattctttagaaaagaaagcattggtaattgattaaatatagttaaaaatatagcttaattttagaaaaactgacattttcaaagcatgggcatttctatcttagaatgcagtagttccctattcatttaattttgtggttacatattggtgaaatattgtagcttgattcttttaaattatcagcaactagttgttaacatcagaatctgtctttttttctgttccctcatcctctctgttttctagtcaatgaaattacatacttcttaaatacatataacatccttattaaagaggaaaataattatcctgtgtgacagttactcaagaaatactgaaatcagaacaaaacttgtaggtatttccgtggtcataatgctctatcagctccgttataacaaaattcatgggtaaaaatattttagatagaccaaaaataactgtcttcagtgagatagtaatatatacaaattattttttaaaatatttttgtatgtttttataactcatcataaattaatagagtgactatttctttggaaagtgcccatggtaatggagagatgcagccatgataatattataaattgttgagtaatatataaaatttatattggcttcagaaatgaaatctttacatgtctgatatttagtgaactcacatttattttaatataatggacaaaaacgtggcttggcacaagaaaagttgacctgtatccagttaccccttcttatcctctttcatctctgtactgtaccccttcctatcctctttcatccctatactgtttacttaattatttcttttctttgtctttttttttttttttttttttttgagacagagtctccctctgtcgcggcgtgatcttggctcactgcaagctccgcttacagggtttatgccattcacgtgcctcagcttcccgagtagctgggactataggcgcccgccaccacacccgactaattttttgtatttttagtggagacggggtttcactgtgttagccaggatggtctcgatctcctgacctggtgatccacctgcctcagcctcccaaagtgctgggattacaggcgtgagccactgcgcccagcctacttaattatttctttaaccaaattgattaatttgaaaaagaatataatacatttcaataattttaaggcaaaactttaaggagaatatctttcttcatgcttgctaaattctcaaaccgttagagtggtatgtaagtgcttgcttttcctagaataaaatctcacacttctttccatttctgtagccaaaatagtatggctgtcctattcatcagaagcatgtcacatgtaggtaattttgaaattttctctttgatagtcaaatatagttactctaatgacagtcagctcttctgctgtgaagacacaaataattcagaataagttgtcatcactaccaaaataacaaaattattttactggtagaactttcagatatatctgactgttcttctcaatgtcctattagtaatccttcaaatgtggagtattcattttctgatccctctgcttagaatagctatctgcacaacaccccacagtttccattctctcaatctatatctgtatctgtataatctataactatatatgtagttatacacacacacacacacacacacacacacactagatgacagacagatgatagagagagagagagagaaagataagagaacttgttgaaactgaggttcttaaattgagttagaggtgggaccaaatctctagttacctaatgtcccagtttaatattctttttgatcatttccaacattcctcacctttgtcttgtatctaacccacagtatggccacagaacaggaacaattttatatatacctttatgcccctgaagcccttggcttgtcattaagtaatagctcctgaatcccattaaactgtaatatacagagtattttaaatatatacatctcctgtagttaaaatgaaacaacttgttcttttaaatctttgagaaaagtcattaaattacaacaaatattatcaacttatgtcaaaatgaagaacacatcagggaagatttttctcattttctaccggtaaattattggggcactttttgaaatggtcagtgtaatcaagtaattagctcattgtaatgtttactttaattttacaatatctccagaaaccataaatccaaaaaaggaaaaatgggaataattgaaatcaataagaaggcttatggatgtgcaaagttattagtaaaatacaagggttttaattaaagatgttggcgtgtacaaagactcgctgttatcctgattgatggggcctgctggctcagctctttccctgttccccattagctcccacttgcttttctctgctctaattggatatttaccacatcggcaccttctttttaaacaacatttgttccacaaagaatgtaaatacaattacactttagacaaattatatgtgtacgcatgtgtgtgagtataattagtttattatccaaataatttgtcattttgctttcacattctacaggaaactgttgaaaatttcatggagaaagatacaatttaattttcaactgcaacatttcttgttgaaattttgaggaacaaaaatatataatcattttgttagattttattattctatttcgaaggagttccagatatacttttgaataaataaaaggacatgtatatatgtatgacatttttcttaagaataaataaaattcataagccaggctaaggttttgtttttttcccctttactattaaactgaaacttttaatatattgcaaatgttaaaaccaattttcttcatgcccaagcataataaattactgaggaaaatgctaaataatttctaaattttcctagcatattctataatgtctgtatggaaaaagtaaatgacataaaatgttgtttggaaaaaggttttattttgccagtgtagtactacccatattaacaattatctacaagaaaaaaatacagtgcttatctttattttactattattctatttttaattaaaaaaaaagattttgagataacctggcaagttctattacttatgatagtctaggaagactatcataagtaagtaagaagcaagaggtaaatcccatcaaaagaacttttcttttggttaaagtaatgcattagtcagtttaatggagacatttaaattagacatttaaatggagagaagtgtatctgttcactccagtggttaaagtatgcatttcttcattaattttgctgtatttcaacttctacaataaataatgtttttaacctattgtcaaactcacatttttcaatcagcttatcagcaagaaacatcacttataaagcaacttagaaaactaaagagtgtattgagtggttatcagcctagaaaacttcacaattatgatgactttaatgcaaaatgtatgcaaagttcaggaaaatcaaactgtaatgtttggatatatgcctttttccccctcctcactcaaaatgcagtgactgagataacaccaggtctagcaggacaaaaggaatgcgtaaaatgaaacaaccaccctttctgataatgggagactggagagagctggcctgatattgtgcttaaagataaaaaaggacatgcagtatctactttaaatgagataagtgtgcttcatatatcttgcagggacagagataactttgtttctttaatcattattatttatttcttaaaccttagtctctctcatacctaaaacctgtagagctcataggttacgactcagttcttatgaatagagagagttgtcattcttacctgtaagcctgctaaataatacttctataagcttcagacttcacatagcagataagtttgtctcccctgacacgactacattaatccactaaatcaatttacttaagctgtgctgtggagcaatgcagccaccatttaactgagcttaaaagtactttcaagtttgagtcactgctccacatgtaacgtagctctcagtgtccaatcataagttctattttgaccctttgcaactctgtgagaaattttcttgttaggtttatagggtcatggtgctctaacatccagaaggatttaaggagaataaattcatgatgttttagaaaatcagactcatgagtaacacaggaagaggggaacacttggttagattttacaagcacaatctacttacattaatatttacaacattctttaagttgaatgagtttgttttaaataatttatctagaaaatatttcatatgttaggaaaacatttaaaaaaaacagctactagtttcacagtttatagcctgaacataattaaatgctatggaggaacaatgacacaattaaattatttaacgtgcaatcaagctaactgtggcacccaaaaaagtacacaaaataacttgcaaaatgttactaaattttactgaaaatgtactaacttttactaaaaatataaaagattttactgaaatttctgtctggtaggtttgcatagccaactgttgttcgtagtaagttgtcggtttgttcacattcttcttccatttagctaaatctattaaaaacaaaaacaaaaaccttttcttcatttcttctgtttaaaacctctggcctcccacagaccttccctgaagctcactgttgttgtgaccggcttctttgtttctctgtatctctattcagagatgttttcaatctgatcaccactctttgcttcatttcaccctaacaagtcattcattttcatgaacttgttctcccagagcctgggccatttgtctttagcgtggcttctcaccatttagtgacaaagaggataactcccagcacatttgctaggagacacctgtgggaagatgtcagcactgataaggtgtagtctatgaaatatatgcgtcacttcagtttccttagctgaggtgtggggctttttaatacttttttctcttttccccaatgtatggaaagtctcaaagaataattatccataaaaaataaggaaatatttggtaaatcatgaagctgaatacttccagaaaagccttcactaaagtgaatttattttagtcatagggaaataggtcatttgtaaataacatctgattgtatctttcagactctaaaatgtacttttatatagtcaatccacaaaagcagaatattgtcaaaaacttacatagcatgttttctgattttttaaaagttaagtcagggtcagatataagtatatctttagtggacctaagagtaaatattatgttttaaataacagaagagtcagtggaaatctagagaaagcctaaaataactgactttaaaaaaatgaatcgtgtgttacaactgtatggggtctctggaggtctcatattgttatggaatctctcgtgagagctaattctcaaaaaatacaacctaaattctaaaattgtgatcttacaataagtatatttttgagtagttccaaaatactttttgcctcaggatgctgggctctttaaatatggataagtaatttcgctttcaagtagctcagactaagagagagagaggacaggaatgaatgtcaaggacaggcagcctccaaccccactccagggtttttgctcttccatgtcccagccaccaggtgtcagtagacttcacaaggtggaactggcctacaggagtttgccttccactttcattcattcagatttaaattggaataagttttctaacagtatcctttccagtttattataatatcggctattattgattgggttttggatatattaaaaattatttaagagcttcaactgcattgttgaatttcattgtgccccccaccctccaccgccagaaaaaaaacaaaaacaaaacaaaaaaaacccttaggtaagtatacttatctccattttatagatatggtaatgatattctgaaagatgaagtcattttcccatgatagaaactggaaacaactgagatttgtatctcttggctaatttcaaatccagcttcctcgactactaaactgtgttacaaaatactgtatccaggaaacagttgtctctagattaagaacacttaggttaaaatccaggtattagctgtgtaaatttagccctttaatcatttcctctgcttatatttcctcaattgtaaaattgggttaatgtaactgccctctttaactcacaggaatattgtgaaaatgaatttttaaaatggaaatatttaataaagttctatgttaacttgtatactattctaacatttggccggtgtggtggctcacacctgtaatcccagcactttggaaggccaagaagacaggattgcttgaagccaggagtttgagaacagtctgggcaacaaagagacaacccatcactatcaacagagtgaaacactgtctctaaagcaaaataatataaaataaaataaaatttgtacttgcttattaggtccatgaatttgttgagtttaaatttggtaggctttgtggagtaagcacagtggccgttaagccaattttggattacagtaaggatagcttctatgctgaaaaattagctgaattaagtaatttcacgtctgatgatttgatacatgaattataacttgatgattttcttagtcaagacttcctcccacctgtgtttggtagcaagtgagaaaactccattcaggctgggtgcactggctcacacctgtaatcctagcactttgggaggccgaggcgagtggatcacctgaggtcaggagttcaagaccagcctgaccaacatggcgaaaccccgtctctactaaaagtacaaaaaattagccaggcgtggtggcacatgactgtaatcccagctacttgtgaggctgaggcaggagaattgcttgaacccgggaggcggaggttgcacggagccgagatcgcaccaccgcactccagcctgggtgacagagggagactgtctcaaaaaaaaaaaaaaaaaaaaccctccattcaaatatactagaagaacatcgtgtttcttatggaacctaaggacagcagtgtagctggacctcacggaacccagagaactaggaggtaaacattgtcaaaaattgttattctttctttcctcaactctctgtatggctgctttattctttagtgactttggggactgtttctttctgcttctcaataacatacgtagttcaaaaatggaaacctcaattagctttaacatctcttcaggttcaagtttctaagttattgtaaccagcacttttggatcccaaatctaaattctctggagagagaatttgactggcccagtctagtcaattatccacccatattacaagatttctcaaccctcagtactattaacatttttatttgtactgactaatgctttgtttgggtaggggtggaagaggctttcctgtgcattgcagggcatcatctctggtctctactttaccagtgccagaagatcatccctcccacccctcctccatgatatgacaacccaaattatcaaatgtctcctgtggggcagaaatcacttctggttgataaacactgccctgtgaagtaaagggtaaagtgtcccataaaacaaacatggctactggggctgaccatctagaagggggtatttttcggagaaggccacgtgtctgcttggcaattatcctgaaagtggtctattatagaaataagagatgttggtggaaattataacttttgtgaaatttagccaacagaagcagatctactaaaataaattaaaaggttcagaatttttagcactgtataaattgaaggaaaatttcaatcaaagttagggaaaaccctaataatcaatgacatacaacttttttttttgcattctaccctaatacagtgattgaatttcacattttttactcatatatctcaatctgagaataaatattcaccatctatgtatatataatatataatatgtatacagagagtctttcttggtatctgcagtaaattggttccaggacccccataaataccaaactccatagatgttcacttcccttatatgaaatggcatataatatttgagtataaactacacacatcatcctatatactttaaatcatctctatattacttataatgcataatacaatgtaaatgctacgtaaatagatgttataatatatagttttttatatgtattatttttaattgtttattattttaattgtttttttccaagtatttttgatctgcagttggttgaatttgccatgtggaaaccagtgatatggaggaacgactgtaaaatcgatacatataatctatacactgcattttgtaatctgtaaaaatacacataaaataagacacagatgaaaataataattaaagtaattattttaattgtaatagtattattaattttaattaatagtgttattgaatacactgtatgagacttctggtatagaaaagatggcagagacctttttcttcccacctgtttaattcaactgtaaaccctgaaagtaacgcaagaggcaaccaaaggagaaatctgaaaggtggtgggaggaagtaattttgttctgggatctagcactggaggaacaacacaacagcagggtgtcttaagtgcccctactcaacagaagagggatccaccccagtgtttcccaaatctaagctccttcctccctcagatctatggtgagtccctcaacagtactggctgaaccccatgggcctgagacagggtgtggttgggcccaccagagtggctcagccacaacaaggagcttttgcagaagcctctttgacccctctgtaaaataaataagtgaataaataaaataagtaggtgagtgagtaaaaactcatttttaatttgatacctcggtagtttttttctgccatgaaatgaccagtggatatctagcactttcacagtctctttggttactttccacttcatcacaaactgttgcagatttttccttattttagagaacttgacttcctgcaaatggtcacatgcgtgtcagaccagcactgggatgcaacttagcctccaattctttgctattaaaagaatatctccaaatattgtgaatgaatttcacacaataatctcatcttatttaaaagcctgtttaagattcttgtcaatacattcctgccataaaacattgtttctattaaataagttaatttaaatctacactgactatgtttcatctaaccctttgacaaagatccaaaaattccctaatgaactacttcgtccaaagaatagggagggaaataggcatttatgtacattgctctcggtagaactaattgatccaacctctatagaaaataagatctccattttgctgttctctacccatttccaaatccacatgtctatgaccctacaaattcacctctagaaattaatactacaaataattcatacacatgcatgggttgaagaaatcaagctgtagtacaacatgcaaaacatgctaatatttgaatgaaaaatggggtgagtgcttatatacatacttccttgggtatgcataaattatttttggaaaaatacaccaaaatagccaataatatttgttgcctatggagagctgagggaaaaaggtgggacccacgtgggaagatactattttaccttataatcttttccatttcatgaattttggatatgagagtgcccatgaattaaaattaataaatttaagaaatcatttatcattggaaatatttttcctatatttttattctttggtggttcacaataaaataatccttttatatctctttattaaaacagaatctagcaaatagaactagacaaatgtgaactgagacaaattagaaatctgtaaagtttcatctaagagtgtaatatttgtatgtttgaatctttaatattttctgtatcatctatgataacaaagaaatatatttcaacttgtcactatattttttccatatcatatttcagtcatttttattgcagcaggaagaatgagtgtttaccacttgtataggacattttatttttcttttttaaagaaatcatttattcttaagtttcatgaaagttcagtgctggtttgagtactaaacaacattaagaatgctgaaaaaaaaatagctatttgtctttatatttagtatgctttgttactatatgtcttagcaatgatgatagcttcatattttctttagctaatgactaatccaagaaacagtataaactaagggcaatagtcattgtcaaaaatagtgactatttccataattcataaagtttttatccctgtgcctggaacagtgcctggaaaaatacagtgggtacatagtaccctttcttttttctttcctctccttttgtaatgaatgaatagtgaaataactagttaatgaaaggactgagagacccagttaacctgaaattgagttactattttgtacacattggatttcccacttctagtgatgtaaaaactctaaagttatagctaatatcaccatagctgtgctgttgagatcattaacctagaaaccacgaagaaacctaagaatcaattatatattaattttcatttgaaagcaatgaaaatcgggtagttttcttggcccaaagcaaatcaaccacaaggaggtgatagctcatttcatgttttagatgaccagaggcatgaaatggaccaatcattaaaattccttgaccacatcaaacctgtgtgctctcactgatgaacacttacaagtctggcaatgattttctgtgggtccccagcaacggccagtacaggacttatggcaacgtccacctgcagaacacgaaaagggaaaaaggacatgcacgttataatctttcactccttgactaggagtaactcctcaaaggaaatactcctgctcctttatgaggatttttatgtcatactagagctgaaacatagcccataaaatgcccacttaagtaggaaaacctgaatgtcaaacatatgtgaaactaaagtacaacctcctggtattcaaatcctcttatcattttttaggaaaataaaataaatgaatttgtgaattttctcaggaaatcaaaagcaaatgattatagttaataagtttcactttcactgttcagcattattattctattgatctattctacttgatataatttccagagatcacaccttactgagagcaacatatattaaaaagtaaagcaacagttaaaaataagtggaaatctatgagaacaagaatatatttttacaaacacatgaaaaatcattagaataaatggtaaaatcatgcatttaagctatacttttgaaagcttaatttcaattattttaatatatacttctaaaatgtttattaacattatttgcattttcaactctaagccttaatctcctatagtggcatcttcttctaccataggtatttgcctcaacaaacgtagttgtcccacagagaaattcccatcgggactgaaaataaagaatattagctggaagaagtcatataaaaacgacttcctttgaatcttatttctgaatttcatagattcactctaaatttctgtgggtacatgacacatttttagaataaaatatagatgttaaaaatctattaaagcttaaaacttttccataaacagaaatgttttctatgacatttccttaaatgcttcttattaaacattgtcaattgtttaatattaattgttaataggattctcccatttaaagtgtttaacaacgttaactatattataaatatcatcaaataacatctcgtcagatgctcccatctttccttgattcaagtttttaattcctcaaccagaaagttcttacaacctggagtgttttcccgcctccagtgaaactgccaaagtgagcctattctgttaaatgagtacacggttaagatgcagattcaaaagacactttctctggctggatctcagaccattcagattgtctacctttgagaaagtaaactgtactatttccaagttaataaaatacttaggttcaattccagtcatcttaaaagtacggggatctttgctacaacagagtttatttaaagcaattctatttgtgaagtattgccgctgacatcaccagtgtataatatcctgtcactctgccatctgtttatttagagccaaacacattataacaacataatgcaagctcattgtagctgacaggaaaaggactccatctggcctgaacaatataactttaatcagtgataatgataattattattaaaaacttacaggagttcttttgtacaaagctaataaatctaaattgatttatactagcggaaattagaaaggactgtgagacaaaataggaagcagtgaaaactttttggagtacaaacttttttatgagaaagtagctaatgttaatgtgttttcttagatttggtataatcctctaaattgatccattaagtggtctgttaattgaagatagttgaagcataagataatctaccatttaatctatgatttatttaattatgtttggggcttgtaaaatatttggccttattctttgtggccagaatactacctaactggaaaaaaaaaaaaaagaaaagaaaagataaaagcaaatagaagagaagaaaagaaaaagtaaagaaagaggaaggaaggaaggaacaaggaaaggaaggagctaagtaacaaaattcatattagacatttttatattctcaatgtttttctcttactcgattaattttttaacttcttattcttgaaattccaatttgccacccagacatctgctcccagattcaatataaaaaggcatgttgctagaaatactgttgacggttcttgacaaggtatcagggcaaggcccacctatttgaaaatgtgatatagtacccacacacacaaaaaacaagtttaaataatttaaccttgactgtctactcgatattatgagattttgttggtagtttccatttccacttgacctacacatttcaaaattctattatgacaaatgcactagaggatctagaattgactgtactcccataaatcgctgttcagccaagactacccttatttaactttctctctggagccttgacacttttggaatctgtcctagtactcagttcagctttagttttactcttcaaaatggtgcaagacatggcacttgtgttatcactggatgttgccaattagcaattaagtaaatgctacaatatctgaccaaaatatctgattagagatatttatgaatcaatgcacttactacatttttatgcctgtaaccttagtttgattcttgtagataattgggaagtacagagagagttcccatagtaattatctgcctagcatagaaaaaaaaaaacaaaatttcctataagcattccctcctacatccttccaaccacgtatccctgattatttcataagtaccttcttcattttgtgtattaagcatgatgttaagcaatggacataaaatattaaactgaaacagagaagtttatcaccttcttagagtttagaattaattcaggaaaagagttttgactactctgtagctaatgttcaccctctatgagtttaagggaaaaagtcagtaaatctaaatttttaacagcctcctagcccaggaaagaagagttggatgaaagcaggtggagctagataattcccaatctaattcccaggggcttggaagtcagctacattccttaaacgatgacacgtccatgtgacatctaaaaggagatcaccctagaccatttcagtgaagaatgttaagcacaggcttcgatatgtcccttgtttatatatatatatttaatatatatatattatacatatattttaatgataacctactgtcttactgggactttcttcctgccctctcttctcaggcatgcactaacctcaaaagtcctgatttttttttttttttttttttgagacggagtctcgctctgtcgcccaggctggagtgcagtggcgcaacctcagctcactgcaagctccgcctcctgggttcacgccattctcctgcctcagcctcccgagtagctgggactacaggcgcctgccaccacgcccggctaattttttttcgtatttttagtagagacggggtttcactgtgttagccaggatggtctcgatctcctgacctcgtgatctgcctgcctcggcctcccaaagtgctgggattacaggcgtaagccaccgcgcctggccaaaagtcctgatttcatctgaaaaagagatcttatgtgtctgtcatattcagtgtgaattagttttataaactacttctccccagagtgtgttttgtaaatgagggccacgaagagaggaattagtcagattctagaatacgtaaatgagagcagtgtttaggggttttgccaatgctgtccaaatcttcccacttccatgtctcaacctggtacgtgattcttcccattgattattgcaataatcccttttttttttttgagacagagtctcgctctgttgcacaggctggagtgcagtggcgcaatcttggctcactgcaacctctgcctcccaggttcaagcaattctctgcctcagcctcccgagtagctgggattacaggtgcctgccatacgcccagctagtttttgtattttttgtatttttagtagggacggggtttcaccatcttggccaggctggtcttgaactcccgacctcatgatccacccatctaggcctaccaaagtgttgggattacaggcatgagccactgtgcccgagctttttttttttgagacagagttttgctcttgttccccaggctggagtgcaatggcacaatttcggctcactgcaacctccacctcccaggttcaagcgattctcctgccttagcctcccagctagctgggattatagaaatgcaccaccacactggctaatttttgtgttttttagtagagacggggtttcaccctgttggccaggctggtcttgaactcctgacctcaggtgatctgcctgtcttggcctcccaaagtgctgggattacaggtgtgagccactgcgcccggcctgctataattcttttgaagctatgtgagaaaatagtccacttctttactaaaaacgaagaatctgacatttccatgtagctcggtgataggagaattagtcaaattagtacgtcttgttattttggctcaaagagatgaaataagaaacaaaccaacattttaaacaaccatttcagttactttattaactatttttaaatgtcttagagtaagtgctaagcctagtgcagcagcacatgtctgtaatcccagcactttgggaggccaaggtgggctgactgcttgagcccaagagttccaaaccagcttgggcaacatggcaaaacccggcctctacaaaaaatgcaaaaatcggtcgggcttgttggcgcacgcctgctgtcccagctactctggaggttgaggtgggaggatcactggaacctgggaggcgaaggttgcagtgagccatgattgctccactgcactccagcctgggcgacggatcagaccctgtctcaaaaaataaaataaaataaatgaataaataaaataaaaataagttctggttactccccatcaccactattttaattcacaagcaatccctctgctttcacaatgcattattcatcatggaagctggcaaacgtgactaagttcatcttttatgcttgtccagcggatgttactaaaaatgtagcctttgcattcctttgtaggaactagagtccatgaactgcatttatgtttttaagagtcacaaattcatctagaagttgtgcttatttgtgtgaccacctgcatgtgggattcactgtctacctctgtaatgctttctgcaagtaatatgccaggacagttgaagagttacaaaatatgaagtcattggcaactataaaagatcatatcctcaaactgcctctagctaaaggcaacgcagttacatccctggatttttcttttactccttttaaaaactggcaggtttgacctcttaaaactacttttactagagaaagaagtgagagaataataccttttttatgaccatataattcaaaataggaaagtagaacattgattgaaagtctatgctaaaccagtccctattcttggtgtgtgtgtgggttcagggaggggggataaaaagacgaatgtcactaccctgtcctcaaggaggttttagggtccaggaaataggcagaggaataggcaagtaactattatgaccataatatttgcgaaaatataggtatgtataaagtggagagaaaggattgcagaaggctctgcagtttagttttgcttgaacaatctagtttgtccagcagtaaagggaagggaaggagaatttcaggctgaatagctagcctaagcaataacacagaggcatggatgagcacaactgtttggggccataatgagtagtttagggttttttgagcatagtttgcatgagtaatagcagctggagcgtgagcttacaaagtatcacgaaagccttctaaacagtttggagtttactctgtgtgtgtattatggagtttaatgggtattatggagttggccaaggtccttgaacattaaaatgatatagtttgacctgtagggtagaaaatggttttgagtcatgtttcccaaaagttagttttgacactttagtagcttgtgcaagatgctgattttatagtctggtgaggtacaggaatccctagttttaaaaagcacttccagagattctgaggttgacggttccaaaatgacaaaagtatatataagataatggcttggcatataattccaaactgttagtatcatagacatattttgagacaatgctttagtattagagctgatcagatgcttggtaaccaaactttcagacaagcagtgtaaaaatctagcagtctctcatgtcttagagtttattctttgatttgtggacacattcccatcaaattgcatctttctccagcagtactaaaatatacatatagctttgtttttcacatttaacttactgtaaaccactcatataatagtaaagtctcaatatgatttgagcaaatgctacatcagtaggaattaatggcattaccatgatgtggaattgctcttctttatgagatgttaatacttccacttgttcttatctgacaattctcattgtcatctgtttatttgtattcactcttctgttatgtgagttgactttactttttattccagtctcaattcaattttcctatcctgcctcttaatttgaaaactaagtataaaatggaaactttaactttcatacatcttgatacaaaaagatgggcaggtattcttccttgctaaaaaatatgaagttaaaaatgaaactaaaaacatttatcgttgggatttttcatcttacagtatattacatcaggagttatgaggtcaaaatatattaggcaattactgtacaggaaaaacaaataagtacggttaaccttgctaaacttgatgtttttgtaagcatcatcatgatattcattcaagcaatttatagtcaaaattttagaacagcatatatactcatgtgatcaagattaatttcaaacagaagtgtaaaatgcacagaagtgtctgcagcgcttccatctacccctccctcaggggctcaactccctcctgctaatttgtgactgccagtgcacaaagtatcttctccagcatcaccttagacaggatatcagacagatagctaatggacaggccagttaatctggcacaaaagttgtgcaaaggcttgaagattctaaagttactttgcaaatttgtatttttcctgaggccttctggaaacatagatcaattatgaggggacatgacagtggtagaaaccacagctacaaataaaaggctgggcaggctggggtgggtagacctatgagagtgccatttttcaaaatctcttaactcataaatggaagcaaccagctactccatttgcaggctgaatatagaactgtttctacatatagatttaaggagaacagatagagcaacaccattttacagttaaaagaaaaattgatgataatccatttagatctaagattgtcgattatcacttacacgtacaagctcatgtgattgtaagaaggactaacagttagaaataacctaatacatattatgccaaaaatgaaataaacatgaacatactaaatgcaatctatttcccaccgaatggaaagatctgctcaatgctgtctatgatattactgttctgtatattctatgctccttccaacatgccttcagaatgctttaggctactgaaaccaatggaaatgaacttcaaagaaaatcacattaaaaggtcttaatgctttttggaaaagtcatatgttaataacaaaatgtctcaaaataataaaacatgaaatttttcctaaaagactaaaagcttttatatatgatactgtcatatatttgttccaaaccaggcacttttaaagcattaattatcactgtttatagctgctagcacaaagtagaatacagaaattccacctactgtggaacagaattagttccaatcaatgtcaaatgtatttctgagcatataaataaggggtctgaactaactgaaaaaccttacctgaaaacataaagaatatactgagatgtgtcagctttttgaaaccaataacaacaataataatgagcacttactatgagcttgccagagccaccaagggtgtccagaagcatctttcagatgtactcaatctacatgataacccttggaggtgtgcagtgcacaacctgttcagctatatgtagtggtgggccttccaaggatgttctaagcattttggatatattaactcatttaatcctcatataacctgaatagtctggcactctccaaaatttgtatgtccagtctagactctgtgatatgcaaacttatacttccaactgcttacgaaccatctccacttgtgcaattagcaggcacttgaaaatacacatgttcaaaactaaatccatactcttcccactccaatcatacaaattattcctgtacagtcttccccatctcagtcaatagcagctcaattctttcagaagcttctgccaaaaactttggagtcatcctcagctctgttttctttcgtcttacagcccagatccaaattcatgaacatatctcgttgtctctaacttcaaaatctgtctagtatccaatcatttctcaccacctgcaccattatcattgtaatacaaaccactatcatctattgcttggattaatgcaataacctcttatccggtgtcctagcttccaccctggcccctttacaatctcttctcaatatattagccagagcgatctttttagtcagaccatgtcaaatctcctaagttgccatgtgcctcatagtacatgccaaagtccttaccacagtcttcaaggacctacaacacgtagccctctcctccctgcctcagtattttcctccgggcttactcctctcactgtcatctcctgctgttcctaggacatacaaggttcactcccacttagggttcttctgtttcctcttcctctcctcctctaagagcctataaagcaggtttacccactaacttgctcttgttagatgtcacctctccatgactcccctgacccactacatttaaatagcaaacattccagatagatttactagattttatttctaatagatgttcaaattggaaatgctgtataatgcataaaaacatgaaagaagaaaaaaattcataaccttgaattttggtgtttttcattttctagagtgtgtgtgtgtgtgtgtgtgtgtgtgtgtgtgttgcattttaacacgatgtaatactttatacagttttgtcatctgctattttcagtttacatttttatcctaaacattttggatgatattaaataaatataattttatttctttggtagatttaccttccgtcatatagacatgccaaaattcaattaactattttgccttatgagatattttcactggtacatgtaggagataaatacatattttttaatgaaaatacacattaagaaaataccactaatttcacatcatatttttcagcagatttgtagctcattaaaagattacttaaacaatagaaagaatgtgaccatgtgtttcattgtgtccttgtgtaaaacactgatgggatctgaaatagatgaggggatttgtagatgactggcacatgtatcagaacatttgataaaagtatgatgtgctaattggcctggattgacgtcctagctccaggagtgtgccaaaagcttctgtacacatctatcatatttgaccttttagtcactgagttgcataaaatgtttgaaatacacttatcatacttgcaaatgacacaaatctggaaggggtagtgaatactcttatggagaataatcattcagatttaggaagaacttggtggaaggaacaataagctgaaattaaagctatgatatttaataggatcaatgtaaattcttgcatttgtggttctgaatcaacatttcatgtaagtatcaacagatatgtactcttacataaaggctctctggcatgagacacattagaatttcaaatctcacctgttactggttgtgtcattcctcaggcaggttagttaacttatttcactttgtttttatactttggacttaaatgtttatcctaaaaatggaggtgtacactatactgcatactccaatctatacagcatgatcaacatcatcaacctcaccacatcatctaatgcttactgagcactctttactctctgcacagcgcagtaggtattttatatacattatcttatttaattttcacaacaacatgatagcataagtactaccatttgttttattttataggtgagaaaatgggtcgggcgtggtgtctcacgcctataagcccagcactttgggaggccgaggaaggcggatcacgaggtcaggagatcctggtcaacatagtgaaaccccgtctctactaaaaatacaaaaattaactgggcgtggtggcgcgtgcctgtaatcctagctactcaggaggctgaggcaggagaatcacttgaaccagggaatcagaggttgcagtgagctgagattgcgccactgtactccagcctggcgacagggtgagattcctcaaaaaaaaaaaaaaaaaaaaaggaaaaaagaaaataaaaagcatccttatttttattttttaaaggtagaaattttaattaatcttcacacttcctaacatactatgactgagaactctagaagtgtttttgatggtgatgttttagagctaaagtacattatataacatccacagcaaagaaggatacgtaatatatgctgttatctgtccttctagtttcatatttggttgtttaatcagcgacatccatcttaatcagaaattattttttctttttttttggaaaaagcgtcctttaagtagagccagagaattgtccctctgtggcacatcagccctttttatacgtagcatgtttctagtcaaacatttttgttcttgcccattatttcatttctaattggcaattactttgattctattatttgtttattaaagttcagcagtaaatgggtctaaaataaatgtcaattaaatacaaacacattttagtaattggcatttatttctaaaggagaatgtgataggaaattagagctcacagtttaggaaagctaaaatattcaaaatacaactgagtatgtaaccaatttacagtattgtcacttacttctctaagtgttcatttatatgctcacaaaatgcaaaaaatacaagcttttactaagtgctggtaaagtgtggaaaaccccagctattaaatcatttttgtctcctttcaggctccattatttacaattggtggaactgtgggtaaagaactttacctaagagttgactttcttcattaagaaaatacaggtaatgatacctacttcacatatttgatgaaggaatgactaagttgaatatcacatgcaaagtacctggcttgtaataagcagtaatcaatgttagttccctttttcttccatcgcaacacattacataacaattttactgaacagcaaagacagacaaagagggagagggtcagtagaggtgatatggcagatacataaatggagacagaaatgtttatgcaaacagggttgaaatgatcagtaaggtaccacaggtcaagcaattggaagcggggagggtgtgaccccttagaggctttcgcaggcatagcagacaaagacaagcgggtttcaaagatttctgcatcctttgacaaaggcgtgaaaagccacagtttcagcaagaatgttacgaataacccaactccagtgaaactcactctgccactggaacttcgggctcttgtagagttcaggctggtgcacgtggagagagaaaaagaaggcaggaaatatttccaggtatgtttcagaaagggaaacagaaacccatggatggagcaatggtggattagtgaagaagattagatgtcactgatgtgggggtctcagcccactccatgaccttcatctgtcagattgctagtgagacatgctaatgggtccctgaggaactgtaaccacccacgtgttcactttgtgagtggtgtcacatttgagaaacgtggttcaacagctaaaattcaagcaaaagaaatttactgctctcaaaggacatgaaatgggatccaaagcattgcccatggcaacagttctaaactgttttctcacatgactctcactctcattcagcaaaaccccaatcctagttttctctctcttcctgctgtccgtcatcacaaaccttttgtccttctactcccaccatcattgtatcactattatgtgattgatggactaaaccattctcctcaagtatttttcattccatttagctctcttatcaaataattatttgcctgttttttgttatgtatcttaagtgtgcattacaacatctagggattgtgtgtgtgtgtggtgtgtgtgtgtgtgtctggagacatgagaacggtttggtctggtgcactgaaagtattaagcagacacaaaatatctgagaaggtacaaaagatagactatgaatattcccatatttgtacattttatcctgtcagaatagtcagtgtttaaggagaaatgtttgggttctatttcaacatgaacataaagaaattctgataatctgtgtgtagtatggtctccatggatagcctgtgttttcatctggcttccacttgatagttccaagaatagaaatatctcctatataaattcataagaaatgagtgttgtcatgggaaaactgagatggataaaattattatgagttccttaagggaaggaaccatttcttttccatagttcctaacagtgttcaaaacacaatgggcttctcagattcaataaaccaacatttcctttactaagaggccagtatcttcacatcatagtgctaacacagcttcttcaaccctgagtacattttgaaaggtcttataatatctgtggtttgggactttataattatggctggggccattaatcttacagccttccttttttattatatataagattgagactgagtttttgttacagattgctagcctgtagcagtcagttgtggagattagacatcaccgagacagataacaaagaaaaatggataacaaattggaaaagattaggtagctccacaccacaatattaaacaaagtcttctgaggtctaacagcccaagactcatcgtatgttactaccactttttcatctgtcaaagggacttgctgttaaaacaaggccttagctgtgcgtgtgtatacacacacacacacacaaatatatgtatatgtccaagtcctttcacttaaaaagaactcaaattaacaaataggcacatttctaaaatgccactgtaagccaaaggaataaaaatgtgattttaaagttgatggaggttataagaaaatgacccaaaaggcattatagtaagtaataagcctaaaatgtcttgctgtagaatgttttcagtaattcaccttcgaagttcatacacaaaaaataaattcaaggataatggacatataatatattttaaaaatctgattccatcaaaaagctatttcagtggagttccttcttaatatactactagacagatctggaaattgagttattatttatagaaaaaagataaatgatttgcaaaccactgcatagacatctcttgcattccattgcaaattatttttaagtctaaataaatatcagttctattacctatctttcagctccagttttctgttttctaaaaaatgtttttggtcttgtaacttctgaaatacaaatcctttaatcacaatgaaagccctcgttagctagcatgctaaagaggtagttatagcttaaatatattacaattttattatgtacaaggcatggttctaggcaatttatttctatgataaacttaggaggaaagtactactacagattaggaagctgaggccagagaaatttaataacttgcccaagatcacacagtttgcaataagcctgggtctggagcctaaaaatactatctccggagcccatactcttaaccaatacaaccaagtatctaatttatgttaacagatacaaaaatagaatagccatttgggacaaaggagggaagagcacccaaaatatattagaacacacataggaagacaaattttgtgtcacaacaaggtctgatttctaatgggattaatacaaatgctcagaaagttcaacggattttaggaggacaggaatccattaggcaaagatgttgaatgagatcattataaagacactcattcaaaatcacttagggaatgacttgcatggagttaaaaagatgatttgggtcatttaccaaaatctttgatgtgtgtgataaatgagcggtttagtcaataacagtcagggtggagggtggtgtaggtggacgtcaagagcatggaaaaaggtgcccctccccatctcactccctcgcctcacaatattttaatctattattccaattcagttttatatgagaaaaatgagggatagaggggctaagcaagtgtagttagaaactcttggagacaagattcaaactcatgtagaaacacccaccttgagctcagacactaggctacctttcaaagcaaagaaccagaggcatcatcatgctttttggaaggaagattcagggggctttgtcctgaaatatggtcagataaaagactttggtaggagggataggaagagaggagaaaaagaaaagtgatgtctaatttttctctacctccttacatattttaaaaagtattcaacgtatattatactcttactcttaatgtaatttactattgataagaccatgttttgtttcttatccctcaggaaaaaaaaatctctgagcccattgtatatactaacagaaatgacttactatttcatgagaatgttgcaaaactgcatgatggtaatcaatctttctcttctgaaccaaagcaggcagattcctgtccagtatacaactataaggacccttagacatttgtttattccactaagaatgtatagcaagtcttttcaataaaaatagttggtatttaaaattatgcatttcaatgaaatttagaaatgtagaagtgatggttgtccatcattgtattgctttaaaaaacttttaaatttatcattgtattttttgtagtaaagccaatttctttattctgggaaaccttcactggcatatgttttaaacgactagtttaatgctgtattctaattcttgagtacagagtttgaattgatgccacagaaaatatttttgaaaaaattatctagatcaacatttttgtttaatgaagcacagaaaggtaggagaataaaagtggctgatcaagataactacctgtttgatgacttttcctttgtgcatttttattcaagcttttttctttcttttatgtatttctcttacttatattttgccaagaactttaagagaaatgtcactgcataattttctctccatttttctcctgtgtagaaagagcacctacaattggcaaaagaatcacctctaaattgaacataatgtgttcttgctgagcaggaaagaattaaataaaagttgcatacagctgcttgcaacaatctaggcttgaaagattgccaaatgggttagcagtttgatctgcttgttcatctttctcagctccctgtagataccacatcccttgccccaatcctctagtgtaaccagtggtctctccccttcctcctctctaaactttgaaataaaagtcctgaatgagggaacaccaataggagaggaaagacacatgtgaaacatcttggtaaatgttatgaaaagggaaagctgaatgtctgcacatgttttcagttattcataaacatcttccttttgctttctagttttcaagtgatgagaaattagagaaaaaaagggaaaatagttccttaagttctatttaattgtgaaactgaattctatgaaacactttcattagtaaacaaggatgaacttgtgagttgtgatgaaatctgtgaatgatggttgtgaggcaggagaacagggtctgaaggcagggaacctaacgccgatctgtgctgatttcctagaatggaatcaaaaggaaaaccccacctctccactctcgagtaacaaaaggatcaaaggctactccttttgcaacaccccactcccccatttctgcattgtggaggagaaagtaaagtacttctgattggtctgctcctgaaaccggtcagactggtcatgtcggccttgtcttcatttgcataggggtgtgacttggtaacttcacttcagtctgtttggtcaccttccaacaccagtctgactggttgggggccaccacttcattaatagggtgtaaagcaagtaaccaatgggaaacctctccagggtatttaaacatcagaaaattctgtaaccagcactctggagtcgcttgctcaaggctactcccactctgtgtagagtacttttgttttaataaatctgtgcttttattttattgctttgttcgtgcatttttcccaattctttgttcaaaacaccaagaacctggtcaccctccactggtaacagaacacttacataattactctcacccattacagagtaaacaaaaatagaagagagtaatactgaatagagtcagtgtaattgtcattcaattttacacagttactttaaacaccaaatatacaatcagggttttatgttaaaaaatcaattatggaatgcttcgtaaatctctcttttacattaattaggtgcttattatttgactcaatatataattttatttagtaaaaatgatgtattagtccgttctcatgctgctaataaagacctaccccaaactgggtaatttataaagaaaagagatttaattgactgacagttccatgtggccggggaagcctcaggaaacttacagtcatggcggaaggggaagcaaacacatccatcttcacatggtggtaggaaggataagaatgagcagaaggagaaaagccccttataaaaccatcagatcttgtaagaactcactcactatcaccacagcagcatgagggtaacagccctaaattactaaattacctcccactgggtccctcctataacacacggggattatgggaactacaattcaagacgagatttgggtgaggacacagccaaaccatatcattctgcccctggcctctcttaagtctcatgacctcacatttcaaaatgtaatcatgccctcccaacagacccccaaaagtcttagctcattacagcattaacctaaaagtccatgtccaaagtctcatctgagacaagtaccttccacctatgagtctgtaaaattgaaagcaagttagttacttcctagatacagtggggttcagacattgggtaaatacactcattccaaatgggagaaattggccaaaatgaaggggctccaggtgccattcaagtccaaaatccagcggggcagtcaaccattaaaactctgtaatgatctcctttggctccatgtctcacatccaggtcacgttgatgcaagaggtgggctctgaaggccttgggcagctctgcccctgtggctctgcagggtacagccttcctcctggctgctttcaaggcctggcactgagtatctgcagcttttccaggcacacagtgaagctgtcgatggatctaccattctggggtccaaaggatggtggccctcttctcacagctcctctaggcagtgcctcagtagggactctgtgtgggggctacaaccccactttgcccttccgtactgccctagcagaggttctccatgagagctcttccactgcaacaaacttcttcctggacatgcagacatttccatacatccttagaaatctaggcagaggttctcaaacctcaattcttgacttctgtgcacctgcaggctcaacaccacgtggaagctgccaaggcttggggattgcaccctctgaagccatgtcctgaactgtatgttggctccttttagcaatggccggaatgcagggcagcaagtcctgagattgcacaaagcagcaaggccctgggaccagcccatgaaaccattttttcctcctaggccttttggcttgtgatgcgagggttgccatgaagacctctgacatgccctggagacattttccccattgtcttggtgattaacatttggctccttacttatgccaatttttgcagccagcttgaatttctcatcagaaaataagtttttcttttctattgcattatcagcctgcaaatttgctgaactttaattctctgcttcctttttaaacataagttcaaattccaaacaatatctttgtgaatgcataaaactgaatgcctttagcagcaccctagtcatatcttgaatgctttgctgtttagaaatttcttctgccagataccctaaatcatatgtctcaagttcaaagttccccaggtctctagggcaggggcaaaatgctgccagtctctttgctaaagcatagcaagaatcacctttatttcagttccaaataaattcctcatatccatttgagaccacctcagcctgcacttcattctccatatcactatcagcattttggtcaaaaccactcaacaagtctctgggaagttgcaaactttcccacatcttcctatcttcttctgagctctccatattcaaacagggaaacaatctctgcctgttgtccatttccaaagttgcttccacatttccaggtattttttagcaacacctcactcctgctatcaaaatctgttattagtcagcgttctctagaggaacagaactaaaaggatatataggaaagagagtttatgaaggaaaattgactcacaggatcacaaggtaaggtctcaggataggacatctgcaaattgagaatcaaggatcccagtgtaaatcagcctgagtcccaaaacctcaaaagtagggaagccaactgtccagccttcagtctgtggccaaagtggccaaaggcccaagagcctctggcaaaccactggtgttaagtccaagagtccaaaagctgaagaacttggagtctgatgtctgagggcaggaagcattcagtgtgggtgaaagatgaaggccggaagactcagcaagtctgctcttccatctgctcctgtctgttttattctagcagcaccagcagctgattagatggtgcccacccatattgagggtgagtctgcctctcccagtccacttactcaaatgttaatttcttttagcaacaccctcatagacacaaccaggaaaaatacttcgtatccttcaatccaatcaagttgacactcaatattaaccatcacagatgagtgttttacttggagaaaatttaactcagttttaccaacctagcattttaacctctacgcctaattcttccaggcttagaaatttttgcaaattctcatatagcaggatgacttaaactttacgtgaagtacattttttaaaatgtggaagatcaccagatgtctcttactgtgaatcacttcacattaatgttccttgctttgtattttgtggttctaaaacattttaaaattcaaaagtattcaaagcaaagttaattccaccttattttccttattaaaggaaatatgcaatacagaatttgtttagaaaaaggtaacaaaaaaagcattcttaaattccaaaaatctctaattcttttttaaaaactcaccattttaaaaaatgttaggagttactacttcgaagaaaagttaattattcaaattgctttgtctttctccatctattatgtttgaacggtgtgaaaacctttctcatatcagtgacattcagttatagcatgatatattttttcaataaaattcacatattttagtgaaaatgcttgttaaaatgtacttaaaaataagtttcagagaaacaatgaaacctgaaggctgccctcagatagacaatttgaattccagagacctactatttcaagatattttgatcacttcagctcttcattggaagccaacaagtctgctccatactagaaattgcaagctgcttgaggctctcagaggcccccaaatcaggctcttaatacctacctcacataacatgcaaattagaaatagggttctttaagtgcctgtgatataccaggcccaggaggtcacaggcatttaaagcactgtgatttttattattgaaattaatgacatagaagtttcgcaaaacaacagagaactaaatattctctaagaggggactcgtgtatttggtagttggctcatttgtagcatgcccatatgttctatgccaatttcaaactaacacatggcctgaaatgtctgcatcatattaggctttgctaatcattttaccatcatagaaatcttatgctaggccagtgctacttacacctcttcctagaatcaataggagaattctgaagatagtcagattctcttctttaaacaaaaggtactcaggcagaatctctgagtgaattcagatacatacccacgattggaaaccttaatctagttacctgtggacatgacgaaccttggcctttcgtgctagtgctagaccatgctacacaacatctctgctggtcaccttcatgtaatattttttcttccaacaagctatggtcataaagaagatttaaggttcatcagtggaaactgaatctaaacatagttgaaggtggaaaattgccattttaagagctagagcagtaagcttgtggggtacagaggagttaatctttgagacagaaactcttgtttaatctgacagggaccacttttctaaaccttttagtcaaacataaataaaatctactcattagtcttgtggaaaacttgaatgcaaaagttagcatgagtgcaggtaagtatacagtttaataatttaaatgaaaaatgttagcagaaaatgatgctgaagagtcaaatgctttttctttacaaattttgagctaagctgccctacccctaaagaggctaaagtgattgttctttcttgcgaagtgtgtgtgtatgtgtgtgtgtgttttattcagcatttgctcacaagagactaggggctacgatcagttcataccatgcatgaggtgctggccgaatctcttggtgctcttatagagaaaaatgataagcaacggaactggcctcagcctaccattacctttacagggctgttcatattcacaggtggtagtacctggtgtacaaggccaactactaaaaatttctagaattttgagagcttttcattaaataaccattactaaatattaaactatataaacccacaattaaatgttattaaaacaaaggtaatatatactagaaattcattatttcctgaatagtttacaatgttttactatcttctgtgtaattgagtttacttacatctactgaacctgtatggtggaaatactacataatggtgtgatacctggacatctcttccaaaatccacactgattgctcaaatgggaagacgttagaaatatttataccatgaaaatcagtaagctcaacaaattggggcttttttcccctatttttggagagtagttattaaatatttatcagcacggcactgacatatggtataatttaagactgaagaaatcatgcttttggaaaatgcactattaaaacttgtctaagggatccacaccatattctgtgtggagtgtttcctaatatgacaattgacatttccactaaatcagaaacagaaaatgaaattagctttgaactgaatgagaggcaaaaagacctaggggaagataaagagactaatccctaaggtctgaacgtggtcagagggtctcagtagtgggggatatcttcaatgacaacacatggacagggacatggaagttaattttgggcctctctctctccaaataaccattcttattaataacaaaattatgttgataactaatgttttttcttctttttttgagatgaggtctcactctgtcacccaggctggagcacactggtacaatcatggctcacttcagtcttgacctcctggacttaagtgatcctcctacctctgactcttgagtaactgagactacaggtatacttcaccatactgggatatatatatatatatatatatatatacacatatatatatatatatatatatatatatatacacatatatatatatacacacacacacacatatatatatacacacacacacacacatatatatatatatatatatatatatatatatttttttttttaaagatggggtcctactctgttgcccaggttgctctcaaattccaggcttaagggaatcctcccacttcagcctcccaaatttctgggattacagcatgagccaccacgccttgtcaataactggttttatttgtgctttgaagggatcaggcacctgggtcttaaaagcagttgagggagtgcctagcccagctgtgacatgacgggagtccttggtagcagaggctgggaggttggcagtaagagaataagaccagagaggtgaagctatggaatttactccaagtttttggttaagttatatgtaaaagataagtagaaactaattaataattataaactgttgagactaatattgtatgtatgtgtgtatgtataaatttacataaatgtttactttttatgtacttattacatacaaatgaattttttatatactcatatatgttatgattttcaggaaaaagtaataatacttgcaatgcatgatgaatacgaggactaagatgagctaaggaagagagggtatgagataatcttctgttctaccacctggaggtcaggttaagtacttccaaggaataaatactctgtcactttcaagaaagtaaggattatacttctgtaactttatatatatatatatatatatatatatatatatatatatatatatatataatatatatacacacacacacacttcatatacatactatgaagtatatatactttatagtgaagaatatatatatacacacacacacttcatatatatacatatatcatatttatgtgaagtatatatataaaggagaaatgttaactagatagaaaacaacctggattactccggtctgaattcagatcacgtaggacattaatcattgaacaaacgaatcttcaatagtggcaacacaataggatgtcctgatccaacattgaggttgtaaaccctattgtcgatatggactctagaacaggattgtgctgttatccctagggtaacttattccgttgatcaaattactgggtcagtgtgtaaaatctcacttggactagtacggtcttagattgttcagatgctctgtggtcaccccaaccaattttttttttttttcttgagatggagtctccctctgtcgcccaggctggagtgcaatggtgtgatcttggctcactggaacctctgcctcctgggttcaaacgattcttccaccccagcctcccgagtagctgggattactagcacctgccatcatgcccgactaattttcgtatttttgtagagacggggtttcaccatgttggccaggctggttttgaactcctaacctcaggtgatgcccctgcctcggcctcccaaagtgctgggattacaggtgtgagccactgcgccaggccaagcagtttaaaatttttaatatggggatagtaagctagggcctgtaggcttgagtttttatttgcattaatgaattaaagctgcatagggtcttctcaccttatttgtttatatccgcctcttcacggataggtcaatttcactggttaaaagtaaagcacagctgaaccctcgtctggccagtcatacaagtccctatttagggaacaagtgattatgctacttttgaacggttaggatatcgcggctgttgaacatatgtcactgggcaggcagtgcctctaatactgataatgctagaggtggtgtttttggtaaacaggcaaggtaagatttgccaatttccttttactttttgtaatctttccttagagtatgactgtgttgggttaacagtgaaaataacagggtgcttattatatcgtttattaatattgggctgttaactgttagtgggttattccggtctgatgtaagcttatgcaatggagaatgtcttcatgttacttatattaacatgattgcttctgttaagtaatagattagtccaatgtaatgttaggagttcagtagagtgactagaatttaagatagttcgatgttgaacttaaatgctttcttaattggtggctgcttttgggccaactgtggtgctaataatttttactctctgtaggaaggttgtttcctaaggtcaaaagagttgtccctctctagactaacaattaaacttacaggggaattaagtaattctttgggtaagtttaaaattgaactaaggttctatcttggacaatgagctatcaccaggctcagtagggttgtcactgctagtcatgaatcttcccactattttgccagataggtgagtgtggtctttcagctgttcttgagtagctcgtctggttttgggggacttggctatagttctctgtgtaaagttatttctagttaatagattatgcagaaggtataagggcttgtctttgcttttttagtgcttgatatagctcttccatctttcccttactgtactatgtctattgcaccaaggtaaaaatttctattgcctacacttttgtctaagtaaatggtttgattaagatagtttgataacatttttagcaaggtttggggctagagttagctaaaagtgatcaggccatgatgaaatcttctggccataagccagatgctttgggttaagctacactttggtttgtccaagcacactttccaatatgcttaccatgttataacttatctcctctatagatgtgtagacaattattagtaatagtgatatctagagtaatacttgaggagggtgataggctgtgtgtacgtgcttcatggccttattcaaccaagcactctgctcttggtttactgctaaatcctccttgagccctcagatttcacaaaggttttcatgagatttcctggacatagaaaatgtagcccatttcttgccacctcacgggttacaccttgacctaacgttttttatgtgtatacttatgcttaatctataacttttttagggtttgctgaagatggtgatatacagaccgggggcaagagatggtgagttgtatcggggtttgtctattatagaacaggctcctctagagggatgtaaagcaccgccaagtcctttgagttttaagctgttgcttgtagtagtctggcgaatggttttgttaatgtaactattcgactttagggctaagtgtagtggggtatctaatcccagtttgggtcttagctattgtgtcttcagggtattaaagccactttgtagtacatttgatttcagctggagttttttacaacttagatggagttttttacaacttagctttattgaggatagaccttaaacattctttatgccgagttctattagcttgtgttaatcatatggctgtggtggctggcatgaagttaaccaaccctaaatattagtaaagctcagtcaagcttttgtttattactaaagatttatcactgctgtttcccataggggtgtggttgagcaaactcttttgagctgcattcgtgtgtgcttgatacttgctccttttaatctgggtgatctagagggcattttcactggggtggggatacttgcatgtgtaatcttactaagagctaataaaaaagaccaggacaaaacctatctgtttatgaggttgtgtgaacccatctagacattttcactgtcttgctttgaatacttaagctatactaactgcatggaatacgtaagtgaaaattaaaatatgagaaagaaagaagtaaatacaaatggttgtttacagttctggaaattcaggttctttaaagttgaattggcagaggtttggctgagaggatgactcataatttgaatatggttgatttaggggtatgttatattggggcagtgctttcagagggatatgctcaaggtattatattagtattagggcagaggtttagttactctatttattatacagaatggagggtttatttggtaggagggccttaagattttttagaaaattacatcaattgaggtgtagctgttggagcgttcgtggttaaaatatgatttctgggctctgactgggttgcattttagtatcttgtttttggggtttggcaagggtacatttacctaggttgatggtaaaggcagagatggagggaggggagtttgcagatgtaatcggaaatagttcttcaaattgagcataggtgcgtgggggtacatgcatgagcgtatatgcgtgagcatatgtgcgtgagcatctactgattaattgttatgtccttcaagcatgatatacttctcctcacatgacaaaaactagcccctatctcaattatgtttcaaatcttcccatcaacaaacctgaacatcctcctatcacaattctatccattatagtgggtggttgagggggacttaaccaaacacaactgcgtaaaatcctagcctactcctcaatcactcacataggttgaataatagcagtactaatttatgacccaaacattaccactctaaatctgattatttaccttatcttaacaacaactgcatttctatcactcaacctgagtataagcatcacaaccctgtcactatctcatgcctgaaagaaattagcatggttgacacctataattccactaattctactatccctacgaggtttacccccattacagggttcctgcctaaatgaatcatcatccaaggatttacaaaaaattatagccttgtcaccccaaccattatagctatcataaccctactcaacctgtactcttacatacacctcatttattccatcttggtaacactattccccacatctaataatatgaaactaaaatgacaattcgaaatcgcaaaacccacactactccctcctcacttgtcatctcttctaccgtcctcttacccacctctccattaatactaactataacttagaaatttagtttaaataagaccaagggccttcaaagcccttagtaagtaaatgacacttaatttctgtaacagacctaagggctgcaagactctattctgcatcagttgaacgcaaataaaccactttaattaagctaagcccttactagactggtggaattcaaaaccacgaaaatttagttaacagttaaaccccctaatcaactggcttcaatctacttctcccaccattgggggaaaaaggcaggagaagccacggcaggattgaagctgctcctttgaatttgcaattcaacatgagaaatcacttcagggctggtgaacagtggccttgacctctgtcttcagatttacagtctaatgcttgctcagccattttatacccccgccgccgcccccctgtgttcaccaattgttgattgttttcaactaaccacaaagatatcggaacactgtacctgttattcggcacaagggcggggatagtaggcactaccttaagcctcctaatttgagcagaactaggccaaccaggaactctgctaggagattatcagatctacaatgttattgttaccgcccacacattcgttataatcttctttatggtgatactaatcctaattgggagtttcagcaactggctagtccctctgataattggtacacccgatatggcattcccccggataaataacatgagtgtctgacttctccccccatcttttctactcgtacttgcgtcttcaatagtggaagccggcgctggaaccggctggacagtttatccccctttagcaggaaacctagcacatgcaggagcctctgtgaacctgaccatcttctcgctccacttggcaggtgtctcttctattttaggggccattaactttattaccactattattaacataaaccctccagctatatcccaatatcaaacaccccttttcatttgatcagtcctcattacggcagtccttcttactcctttcccttctagtcctagcctctggcattactacactattaactgacaataacctcaacactactttgtttgaccctgctggtgggggtgaccttatcttgtaccaacatgtattctgctggtacaaagcttcgggataatctcccacatggtaacatattattctggaaaaaaggaatcgtttggatacatgggcatagagccatgatatcaattgacttcttaggatttatcatatgggctcaccatatatttacagtaggggtagatgcagacacacgagcatacagcacctctactaccataattattgctatccctactggcatcaaggtctttagctgattagctaccctgcatggcggtaacatcaaatgatttcccgcaacattctgtgccctacgattaattttccttttcacagtagaggtttaaccggcatcttattagctaattcatcactagatattaccttacatgacacatattatgttgtagcccatttccactatgtcctatcaataggagcagtactcgccattataggaggctttgtccactgattctccttattttcaggctatacacttagtcagacctatgctaaaatccacttcaccattatattcataggtgttaatttaacctttttctacagcacttccttggtctatccggtatgccttgacgttactctgattatcctgatgcatacaccacgtgaaatattatcttatccatatggtcatttatctcactaacagcagttatactaataatctttatgatctgagaagcctttgcttcaaaacgaaaagtactaacaattgaacaaccatctgctaatttagagcggctttatggctgtccaccaccttaccgcacattcgaagagccagcctaaaggaaaacctaaatgagaaaagaaggaatcaaactcccagaaactggtttcaagcccatcccataacctctatgactctctcgataagatatcagtaaaattgttacacaactttgtcagagttaatttataggctaaaccctatatgtctcaatggctcatccagttcaattaggccttcaaaatgccacatctcctattacagaagaagtactcactttccatgaccacgcccttataattattttttataattatacacacacacacaatttggcaaaaggttgtttgagaggaacttatcatatataataaaaatgaaggctgggcgcagtggctcatgcctgtaatcttagcactttgtgaggctgtggcgggaggataacttgtgcccagaagttggagtctagcctgggtaacgtagggagagcctgtctctacaaacagtaaaaaacaattatctgggtgtagtggcatgcatctgtggtctcagctactcaagaggctgaaacaggaggattgcctgaacccaagcggtcgaggctccagtgagctgtgattgcaccactgcactccaactgggtgacagagcaagacccagtctaaaaaaataaaaaataaacaaaagaaaagaaaataaagatgtatattgaaaactgtactcaaaaagtgaaacaatacattttcatctcaaggaactaagagacaagaaaaccaggctagcaggtgtattgtgcttgcttccgtaatgttcttagtaaaacttaattcctagagtgagtttcagttgacctggaaagcctcttcttataaatagagtgtcaaaggccttctatggtgtgggtcaggtgcaagtccttactttctcaaaacagcattaaaaaggcagctgagctgccacttgatcttagtgcattcttttttaaacacattttagattctgttagttctctttgctaatattttattcagaaaaattgcatctgaattcataagtgatcttaagttcttttgttttttgttttattaaaacaggtccataaaaatctgttttatcggtattttagaaaaatgatcttttggattcatacagattcaatgtatcctttccatgtctgatgtttttcatatattcccatttccataatttagggttttatttaaaaatatcttttgaaaacagtgtgatttcattctgtgtatacatttatgcaaagttagatgtattgtatgtctaatgcacacaaactgaagctgtactaaaatacatcgagggtaaattttcttgctacttttttatttcttattttttgctttactacacaataccttagaaaggcacatctattttacctaaatattttcatatagaaggagtaacacaagttggtaatgtaatagatgaggtttaattgtactctatctcgagaattctatttcaagaaagctagttatatgtaatacaaagtgcaatattaattaggagtgggtcattactatgatatgtaaaagtcactgaaaaaaaagtttaaaacatggacagaatgaatgcaggcagaacatctggttaaacaagtaattagtcctggaattatgttcatgattatagtggtatctatgaatttgccaattccccctctcccacttcagttgttagttggtatttggttctagaaagcaactaagaatgagtgatgtacctggcgtaatcaaagaaaaaggttgtagggactggagcagctgaggattgttcttctcagtgtcttgatgagctaaacctatgagagacaaccttctagttactaaaacacacttaaaatgtagaaacatagttaaatgtcaatgaatatataatgaaaatgtaactgtcacatattttaaaaatacttctgtcctcatatggtcaattcatataaaaattataattgcaaggtcctttattcttttgtcataagaaatcacccttggattgacacattaactcatttattgctcgtaatagccctatgaagttgataataataacagctcctgggcaaaaaaaaagaaaaacctatgtgtaatctttcaggcaggagcacagacaattactttacctggcaggcctcctggggcttcaaagctgtcctcccacgccagacttggtgcccagtcaatgcactgcagtctctaagggggttgcagtaagacactcagggtttgctgaccagccatgtctcatatatgtctcccatcctggcccaggtacgctattcatagacctctttattaaggtcttttgacagcggttttccttaggtgctttcactaaaatctccttaaggggaggaagtaagggggcctggaagacaccttttctccactctgactccatacttagtacttttcactcaggccttcccacccctctctccttcaagcttccaggttcataaaactttcagaaccattttttttgccactccctcctcagtgaaacaattccccatgtctgcactcatccatctgaccctcagctggcactgttctatggaagaaacatgagactgtgaagttgatgctttttctggtttagcctttggaataaactattgcagtaagtgattaaaagcttgactgttatcctcatttttgcttgtctgaattgaccactgtcacctagcagcttagctgtcagctcagctcagctcagctcagctcttgacactctctgtcttttataggtaaggagatagagtgactgagggcatagatgacttgcttaaggtcaaattgctggtaagcagcagtgccatgatgtaaataagttgccctctaaaatttaagcaaataggaatatacaagaacattaatatggaaaaatagagaaacaatgatttctcatcagagaagatggtgtagttcagagaatggattcgggagccaaactgtgtggtattatttctgagggctctgttctgttccattggtctatatctctgttttggtaccagtaccatgctgtttgggttactgtagccttgtagtacagtttgaagtcaggtagcatgatgcctacagctttgttcttttggcttaggattgacttggcgatacgggctcttttttggttccatatgaactttaaagtagttttttccaattctgtgaagaaagtcattggtagcttgatggggatggcactgaatctataaattaccttgggcagtatggccattttcatgatactgatccttcctatccatgagcgtggaatgttcttccatttgtgtcctattttatttcattgagcagtggtttgtagttctgcttgaagaggtccttcacatcccttgtaagttggattcctaggtattttattctctttgaagcaattgtgaatgggagttcaccatgatttggctctctgtttgtctgttattgatgtataagaatgcttgtgatttttgcacattgattttgtatcctgagactttgctgaagttgcttatcagcttaagaagattttgggctgagacaatggggttttctaaatatataatcatgtcatctgcaaacgggacaattagacttcctcttttcctaattgaataccctttatttctttctcctgcctgatggccctggccagaacttccaacactgtattgaataggagtggtgagagagggcatccctgtcttgtgccagttttcaaagcgaatgcttccagtttttggccattcagtatgatattggctgtgggtttgtcataaatagctcttattattttgagatacgtcccatcagtacctaatttattgagagtttttagtatgaagggctgttgaattttgtcaaaggccttttctgaatctattgagataatcacgtggtttttatctttggttctgtttatatgctggattacgtttattgatttgcgtatgttgaaccacccttgcatcccagggatgaagcccacttgatcatggtggataagctttttgatgtgctgttagattcggtttgccagtattttattgaggatttttgcatcaatgttcaccagggatattggtctaaaattctcttttttttgttgtttctctgccaggctttggtatcaggatgatgctggcctcataaaatgagttagggaggattccctctttttctcttgattggaatagtttcagaaggaatggtaccagctcctccttgtacctctggtagaattagactgtgaatccatctggtcctggactttttcattggtaggctattaattattgcctcaatttcagagcctgttattggtctattcggggattcaacttcttcctgatttattcataattacagttaaaaaaagagaacataatatttaccatcttaaccacttttaagtgtatgtttagtaatgttaagtatattcacattgttttccaacagatctccagaactttttcaaccttgagcaattgcaacttgactcgttaaagagcaattggacatttagccttccttccaacacctggctaccaccattctacattctgttttctttgagtttgacagttgagttacttcatgtaagtgaaatcatacagtatttatgtttttgtgactggcttatttcctttagcatagtgtcctcaagatttattcatgttgtagcatgtgaccagatctccttcctttttcaagctggataatatttcatcattgtatgtatatactgcattttgtttattcaatcatccatatatgacatttgggttgcttccacctctcagttattatgaataatgctgctatgagcatagatatgcaaatatctcattgagaacctgcatttaattcctttggatatatatccagaagtgggattgctgtgtcatatgataattctatttttaatttttgagaaaccaccagactattttccatagtggtcacaccattttacaatcccaccaagaaggattccaatttcttcacctcctcacatttgttattttcttttttatattttaatattagacatcctaataagtgggagacaatatcttattgtggttttgatatgattttggggttggtttttctctaatgattagtaatgttgagcatctttttatatgcttgttggccctttgtgtaccatcttgtagaaatgtctatacaaatcttttgctcactttttcattggattatttgcttcatgttattgagttgcaggttctacatatattctggatattaattccctatcagatacatgatttacaaatatttttccctttctataggttacctttcattctgttgattgtaccttttgatgcacagccttttttttttttttttttttattttttgagacggagtctcactctgtccccaggctggagtgcagtggtgccatctcggctcactgcaagccccgcctcctgggttcacgccattctccagcctcagcctcccgagtagctgggactacaggtgcctgccaccacgcccggctaattttttgtatttttagtagaggcggggtttcaccgtgttagccaggatggtctcgctctcctgatcgcgtgatccgcccacctcagtcttccaaagtgctgggattacaggcgtgagccaccgcccccagccgcacagacgtttttaagtttaatatcgtcccatttgtctattttagcttttgctgttggtgtttttggtgttatatccacgaatttattgctcaacctagggtcataaagctttccccctatattttctgccaagacttttatagttttaagtcttatgcttaggtctgtaattcgcttttgagttaatttttgaacatggcatatgatgaggcccaagttcaatcttttgcacatggatatccagttttcccaacaccatttgttgaagagacttccctttaaaatatattatttatgcctatcactgcttgaaaatgatattagatattaatcctactgctaatatttttaatttaatgtatgaataagcatattactatattaggtatctgtttcttaagcattttgataaatgtatctcaacctaacttattttccttgtaatccattgtaattcattttatgtatttattgattgctatgcattcatgaattaaagtatttgttttgtgctcattttttcttctaaaaatattatgagaagaggtcaatgggcttcaccaggatgctacagtgtccattgcctcaaaaaatattaaaaattcagagtttgttttagtaatttagacagatgaagtcttgaactagggcaatcataataataaatatgtaaaatcaagaaatgggcaaagatcaggatgactcggtgattaactcccaagagccaagtgaaagtaaagataataatgaccccccaaatttttaacttggttgagtgattggttggtggtatgtagttctagggagtcatcaacctagaggttgcatttaaaaccctgagagtgtctgagattacctctggggagaagacagagaaataaattgactaaagataaaaccataatagtcaaaaaacagtcaattcattattaatagctatggtgtcatgcagtacatataatgtgtcagcaaataaaactactatgtaaataataaaactttggcaatcaattggtagttaatttgtaaaagaccattggttatgactctactctgcatttataatttttgcacctgcaattatttacatgaaaaaaacaatacagccacagttgcctaattataggcacaaccatccaaatttgtcttcaaaaagaatagcacaaagagacaccatctgtgaaagtgcagcaaacccctcagacctttcctgctccaaattctgtaaggctggtgggcacacttcccttttggcttctgtctcaggctctattcttgcacgatcttattcatgccttacagaccagtcagtctgataagctgagagtcagcaggtctttccttttacccaaccaatatccacacctccccaccactaccctgccaatataatatgtgcaatagcatgggcagactgaaaacagaaggcatttctgaaacacatcatttgtcttgttaatgtgaaaagattccatttttctcacatgtaattttacaaagtaggcaacatgaatgccataaagggaaaatcccatacaaatttctgttcaaaggtgacaagaaaattatgttactctactttttacataaagttttagccatttattaaaaacacagctgtcagttttgatcaaatacattcatatttcccattatattattagggccatgatgaaatttaataattgtcccttggagtttgatttttcacaaaaatgtcataacacaatcagtaatatagcaaataattattgaactatgttgagacagttatgatttcaggtgggaaatatataatagatgagaaatataaaacccaggttaacacttgatgaaaattctgttttcatacaaatgtcagtaataataaatgtggggatcacatagcctgctttatgaaaatgaaacagataccagacagaataattttcaaaggtttaaatcatggttcaaatattacttgcttattattaaatcatattaaacactttaaatctgataaattctttgtggtagaaagaatacacattttaagaatgagaaattcagtagtttattcgactaatgactaaaatcagactgtaacatgtttcttctatatgaaatctatatttctccattccataagtgtttgaaattatcataaagtatgaccacgaaggcttcaggggcaaatgaaggcttaagaattctcaatgttcactagtttttacttttttattgaaaaaattatagtgaataggaaggtacatttttgttctactacctttgtctcaatgggatatgggtcacagagacttgaagcaatagttagataccagccttaagtttgtggatagtggaacacacatttgtacattggaagtatgataaagtaatttaaattaagcaaagaggaacatgttaacaaaatgagaatttgtgaagaggaaacatgatttccaaaagagaattagctagaagtaaaaggttgatcagccatttgttctgccatatataactgaacatttcaatgaatgcaatcaaagttcaaaatattagtaatgacataataagcataactcattcatcgccacatagggtagaacattttgagaaattaaaaagaataattctacttacatcctgaactaccatttgttgacacaagagtcaagttggaaggccatgggttccgaacaatatcttgccaatgaatggtgtctgcataacaaaggaatttgttctggtctacatagactccaccatttaggatttctgtattaaaaaacaaataaacaaattttttgtcaaactgcttgttgatgaaaaggtaatcaacaaaagtgatttgctcttaactattttcaatgttaaattagagtcatgttgctaatagccaagatatcttttaaaatatctttcaatgaatcatatacattgattacaggaatttgaaaagattaaaaattacaaaagtgaaaaacaaccactcatattctacactctgagagtaacactcctaacattttggtataaatgttacagtcttttatctgttttcttccctggaattgaaataatattttatataatattttataacctgcttgtttagtttaatattatgtagtgagtacttaatggtaattactactctgtattttaatgagaacaggatatgtcatagtataaattaaatggtaattatttaaccaatcctctcttgttggtaatttaacttatttatctctcattggtctttacaacaaatttccacacatgacattccaaggtcatagagtgtggatagttttaagatatttggtatcaattgtcatattatccttagagagattgtttcagtcaaggtgacattgactgcagtcagtaggtaagtaattagcacaaagtggaagctaaaattaatgcctcaatcacaaaaatgttgtcatctcaaatgaaatcgataagattgccaattattcttaacaacacaaagcaatgtataacaaatcctgtggttcactgaagtaaggatacggctgtgggataacatgcactaaagccaatttgtacttgattctttatttcacaacactggccttgattagctaatttgtcctccacaaacaatgactgaccacagaaatgaattctctttcggatagctttaagttatccaggaaaataaaaactgaaatatatcctctgaaaatattattcttattatttgaagaaattagctacaaatacacatagcaccttccagcccaatatgtaccacatttccccttcctgttcaatacaaaagcaatttaagagaaatcatgcatcagtccataaagtgttcaactacaattaatcaaaacccaatcaacagtttatagagataggggatttcttttttcacataagaaacctataggaggcagttgcagatattagttcagctgttccgcagtgcccactatctgttctgccatcctcagtgtgtcagttttattcatttcaggcacaagatggctgctacatctaaaaactaaactgcagtccttctgaattgcaggcaggatgaagtcacaagagcaagcaagagacttcctcctagtgaagctgtgactttttatttgagaagaaatgctctccttgaggattatgtctgcatttaactggccagaacaatatcccatggttatctctaccgcaagagagattgaataagtaactattgaggtggaaatattgctactgggacaaaacccagaccagcaggggtgttagtgaggaagaagagggacatggatattgggaaggcaaccgacaccatctcccacggtagccttgagaaattcatctctcttgtgtggaaccccaagctaagtttgtaggagtcatcttcaactgaagagagataaatgaaaggaacgtgtcacaccacaagagggttatttgtggactggtggtcacatcccaagtgccttactgcattgcatgtacgaaaccctccagattagttttgatattgtagttctttctacatttaaaatcactcccattttcatcatcagtcatttcactgactattggttccattttgtcggtgaggaaaaaaaaagaaaagaaattagatcatctttctacttctaaaacccagttcattattttttatgacctaaccatacaaccttcatcaaagcagaagggagacgtaagacgtaagaaagattgtgaaatggatttctacattaatgtttggcattaagtttttatctacgaaatgtgatgatctcatactaatagctttctcatgagacattaggtgatgctcttctgctctaggaataattttccattaggtgacaaagaaaggagattttgactgctatccaggaaataaaggttatttttcagtctacatttagaaaagttctacttaaaaaaaaaagtgaaaaggtaatagctcaaacattgcagaaagagtgtatatttttcaggagtcacattgtatttcaaatagttcatacaaaggaacacagtatccatctccaacttcctatctaaaatttttcaaatagaatcagattatattatactgaataatagtcttatcaaatccctttcttcaacagtattaatctgctatgaatgttgacatttgtttcttagaaatagtctgttcgagagcttggcttatacttggaaaagggatttagaaaggagacaataataaatccagcataatcttacacgttaacatttcaaattaagacacatgatcaatccagatgatacttttatcattcctaattcaaaactcagcatctgctagcaattctggtcaggaggatttataaatgtttagcaattaatgatgggtagtttatttatgtattgtttgttttccttgaaaatattcttttttcctttatgtttggtatacaccctattctgctgttgaatgtcaaagcctcacagtcagagaatgtagaatttcattgacacttataggacagttttaatgtacagtcttacactttcttttgattaatttgattacctaaatatgtgtcagaaagtaatgttataatggcatttacatatattcttaaagttttcattgattttgtaactttacatttttaaaatatgaatttgacatatttttgtgagaaaatatactcaggtatgtttattactgtattaaaaaaattctagagaatagatactaacctgtaagaaagttcttagagatacaaattatttacttgttagaaggactgcctaatgtttctgtcttggttgactacagaggcttgaccgcattttttagataagaaagagggacaaggattaggaaaagagaaaagtttgtttagatgtttatctaataagagtacaaaaatgtctggctatatttagatcttgtggtgacacacaagaataacaaagttttccacaagttttatcaaagattttacaaaggaatcacctgtgttataccaaccaacagtttccccccactaacatgaaataaagtaacaaataaatgttaagaaagataggcaaaggaggcacacatttaattgatactcaaagaaagatgcaaagtgtctggatgagtgcagaagctaaaaaaaaaatgttgaatgcgtgaatgagttcaaagtatctcatttcattttattttacttccactgcagaaaattatcagagtaaattgagagagacacagatagattcttggtcattgaatcaattgatagaaaaaagctgctatgagttttcttatcatattatacacaaatatttctggcaagttcacaaaacagaactgtctctttttaataaatgtcatggttaaatagagtaagatatattagacatgacatcgatgaaaaaagtatcatttcattgctgaaaatttccagtaaacacttaaatatgtttgtgtctcaaacgtttccgactagattaatgcatgcaagttgagtaaaagatgtcacgaatctttttttatttagagtaaattgtaatctacactattttccaatatcttgaatttaacttatatatagcatagtatttgtagctgagatataattagactaagccccatgaaggtaagaaatgtttttcagtgctgtatctatagcatcaaacctagagcaacagtcactccatgaataattgttagatttaattgtgtatggaaaaaaagtaccatggaatttgcaatcaatatttataaggtaacttctattgtagttcctaattttaaattatattctgaccaaatcaaagtaagaatgaaagttatcgtttcccataaacactctacaggttatcttgactggtcctatgtttcataaagtatgaagctgttactgttttgttcaaaaccatatctccagtttcaatattatgcaaggctcaaggtgatacacaataaatatttgattaattgaaatatctatacagaatatcttgaatttaagaaaatatatatatataattctgtggttagagaaagccgaaaggaaaatagcatttattatataaaacgcatataactgataatatacaatattactgcagacaatacatttgatatttataaggcatttttactccctaacctattttgtacacaaaactcaattattagttaccaggtaaataatgacgatctttagctatcccatacagaccaaatttctctaagcctgtgcaaatcaccttgcatatgctacagagaagcctaaattttcttgtattgaactgtaagtctacctcacattgtccttacatttttcagaaaggtataaactgccaatatgacatttgaaaaaggacagaaagtatttgtatctttgtcattcactccacaaaggttaaccattggaccatgtctttccttgatttccattttcatgagtctaataaataaggaaatgtttgtgttatttaaataacttcttttgtattcttcatttcttgtcaaatgctagttactgcagtgaatttggggatgagtgcccattaacagaatcattgacattttgcaaatatattatctccaaaactatggtaaaatactgaataatagctttttttctctgccctgtatgaaatgacctaattgtgatgtaacatccctgctgaaaatacagattaatatgacccctttactaggtttaagaaatttacaaaattgcatggaccccatgcacaatttgtaaccattttgtgaataagattgaatatctttctctttttccaaaataaagattataattttaaatgcagttacactatatttcactttagtctatatgatcgatattatcagtgaacattttaattctactcaaaatctaccaaccatatgatataagaaggatctaataaacaggaatgaaatatttaacctctatccctgattgtatatctaagtattttgttttgcaggggtgcatctacaggtcaaccttagaattaaaatgataattaaaataataaagattagaaatattgcacttatctaatcacaataggcgcatttaaataatgcatatgtcagacttatactatctatctaagtcaaagggcagaatcaagaatcaaaatccaaggcagcaaaacccattttcaagatgaagccacagaaagcagttacaagactttctcggacataaagcaatgtatctttctcactgtcatcaccttaagccacacaagtctgttggcagataatgatacaaaagtaatatagctcacatcatccacctatgatacttaatacatgatctctggaatggacttggtccagagattcctgtatctttcccaaacccagacctttcagctgggagcacaatgaattgctgctaccccactgggtcagccctcaaggttcattattaataagctgagactcaaaaggctaatgagaaccgggtgcttgaggagacaatggctcattcatcatcaatcaagctttgaagtttttatacagatgatttaaggagagttgaagtgtgcaaaattgaaatgtcacgtttgtattgggagcgggtagagggtgataatgtaaatgagtgacgtaaccttctatatttcagctcgatgatcagagtcaaaagctcatggatgcagataccaaatgtttttccatcagagtatagcaatttcaagatgaaattattagatccactggctgaaaatcagcttaagatagaaaataatatcttgatttcaattgaatgaagctcagtaatgcttgttgcaatgttctaacttattaatacatacttcagtatccactacaattcttagctttcattatgtttcaggtttgagttctagctcctctgagaggtttgctatgaccacctagttcttagagttcccccttcctctaactcctgtaacactgattacccgagccacttatctgacatagagcaaatgctaccttaccttcttatatattcttttgtgtatttgccttgtctcccctatcttattggaggtccctcaaggattagaactatgatgtacacctctttgtgtccctagtgccaaagaaagtgtcaagcacatagtagaatttcaaatgtttttgatgattatgataatgataacatccatagaacatgaccaacttttgtaaaaaattacttgcttagtgatagcataatgttagtgatatgcactagatatttacattgtaaatcccataaaatattgaatacatttattttgatcttaatatattctttctgtcctaatattaagaaagtagtaatccacttaaactcattgatattccccggaaaaaattaaaactatattttatcttgtaacagtactcaaattatgaacataggatttccttctcaaattgtcttattatataatcccatacgtgtgtcaacgtctaacttttttctaataattttcccgagatttgtattctccctgtgttttcttatttctgttaaaatcaacataaatgctgtaaaagtcacatagactcaaagtttgaaatttattactatttcctttatttctatatttaaccatttatggtgctctacagaaaatttctcatagtgtctctttttatatccacaactgctacttaattcaggttctatcatctcataccagatttaacttcttgcctgtaatctattctccccacaaatccatcttgcatattaaagtcataatatatgctatattataaagagatagataatatactctaggtaggtggagagagacaggtggtaggggagagaaatcctgctctatcacggctttgaattgtaaaggcaataatactgaatctagttgactggataaaataaagctcataatctagttttgtttcaacaaagcaaaggtgggccttgtccacctttatgaagctgagtttgctcaattctgtgatgggtttattgtactcacggtatctgtcgcatagttgcttctattataattttaaattgctaattatttaaatagtggttacttcttggtatgagcaaggaatatgcttcttttgagtattcatactaacattgctttaatcagtattagattaggttgtagtttaaagagtatagacatttttttcttctatataaaaatctggctaggttatttaaggctattatataaaaatccacaatcatcagggagccccattctattttgttcttgtttctctaccatcttcaatacaagaggagtttccaactggcaaaaaccatgcaaaagacggagaaaatcatgaaggacaaaagaacagaggaagagtacatgtattttaatgaaaattcctgcaaattgccacagcacaattatacttgtatctcgttggtcagaatgaagtcaacgagccacagctaggtgcatggaaggaagggaattaaagtattcattctgggtgatcatatgagtagctaaactttatatactatttaaaatttagaaagtggtaatagatattggtgacaactagcagtctctgttatagtgactcaaaagaaacctcgcatcttctggatatttataaaacataaatcttgtgacttgaacaaatgtaaagctttttaagaaactttttaattgaattataatatacacacatagatgtgcattatcatattcaattaacttttacaaactgaacacacttatgtaaccagcactcagatcaagagcttgagccataccaacaccacagcagccttcctcatactttccacctcatgtcactctatcagaaccctgatcctgactttgagcaagataatgtgtgcttatttttgtattttacgtatatagaatcataccatacgtattctcttgtgtctggctccttttgctcgatattatgtttgtgaaattcatctatattgtttattttcattgttgtgtggtattccatggtttgtcaattctgcattgatgggcatttggatactttccacacttgggctattataaataactgctgctatgcacttcctagaaaatgcctttagatgattatatgtacacatttatgttgcgtgtatacctagaagtagtactgctgggtcatagtgataatcactttttatttaaccaatttaacttatttatatgcccattagtagtatatgagaaatctagttgcttcttgaccttgtcaagtcttgattattagttggttttgttgtatttcattgtagtcactcttattggtgtatagtggtattattttaatttgcacttccctagtgactactgaagttgaccttcttaaatactatctttaaagagtaatttttaaaggcaagagatttatttctgtttactccaagaaaggtcttactatgtgtaaaacatttacaaagcactgttaaaaacctgatctttaagttattggcaaacaatttagtaaaataatttatcaggtgtaaccctcataacttatttttgttgttattgttaagagatctggttcaatgttttgaaaatgacactttaaaatgtcttagaaaaaattaaaactacattaataattataaagagtaaaatacgatttctggaagacggatgggaaaattcacagtaggtgattatctctctgataacagacaaacacaaccaaaggtatataaaaaggatgagaaatttaatgtcttcttgctattaaaatagaacactcttttacataaagctcacatatttttattcctatatccaccagaaagccctcattacagacaacaatcctcttaaataactgttccaagtttccagaaaatgtaattgcttcagtagaacaaatcagtagagttcaatgttttcattaccaataaggggacggtcatattagtactcagaaatgatttgtcccttttatttacaggatttaatacaataagcctggggatatactgcaaggtcactttcaaatatctcacccactatattagtttgtatagttttaataactcttctcacaatgtgtgatttctacactatttcttttttagaatacttcaaaaaagtatgatttttcttgatgacagtaataataaataatattgctatgtatgtttgttgctggcatgttaagacttgcaaataaaagataaagcaagagaaagaataatgatttactcttgtaagatgattatatgattttcaaatatgtcaagatttttaaaaggctatatttgtgaatattaaaaatataaataagtgatttgggggctagaagtctcagctaaaatgcctagaatgttaattttaaaaataacacataaagacaacactttacaaaataagaaattaaagaaggagtcataaaataagattgcaagcaagccatactggaagattattttaaaagccacaacacgaaggtccaaattaattttcttttaaaatgaagtttaaatctggagaaaatcaggaaggaataattgaataacagtaatcatcattttataaagcactggttgtcaaaatacaaaatatcaggtactgtggcaaaatagaaagaaatggctttttagattgctttgtatacagtttcaaattagtatacattaactacagtaaaatggacaaattttaagctctatgttttacatatacatgtatacaatatttgtacatctgtatcaagcagccgccacccagataaagacacagcatatctctatcactccagaaaattttccctgcttcattccagtcaatactgcatagaagtcagcatagaaagtcagccactatgctgacttctaccacaacaaattagttttgcctctttattaaattcatagaaatagaatcacacaatatgtatcttattcctttttcttatcttctttccctgaaaataatgtttttgagatttatttatgctgttgctttaattcataggctgttcatttttattgttccgtattattccagtctgtgaatataccacaatttgtttatacattagttcactttttaaccatagatttggcacttttactaggtggttgcaggcaaattacttcacgtttcttttctaccatctacaaaattggaataataatctttactttgttgggttacaatgagaaatacagataatatatacaaaactccagttacatactaggtgttcaaaaggtactagctatttcaaaataagttaataatatagttcaggagctttgtctaaactattttaaaacctatgtacattggtcaaagtacaggttttgggggagaaatgatgaccaaatgaaaacctttgagagatacatgaaatccccattaagtttggtgcctagcataacaattttagagatagatatattgagctaaaatattattaaatgtcttactaaagttagttaattaaaaaattgggtttctctgtatttcataagttaaattcttcctaagaacaagatcataaattctataacttactatctttcccacactgaagtatcttagatatctggttgagttaaccctttagtaatttcctgtcatttctctaactatattctgtgacagcatttagagctgctagatttccctctgtttggatcaggttggtgcatagttcgtaggtcacaaaacctccctcacaatctccaggtggcctttacctctgctgtcactaccactgtgcttcaaataaattagcataaattccaaagtcttgtacaagagagctgagctcttttcttccaggccaagggtctggaatttttacagtagaataatgaattaattcaaaaacacaatattctatggtccttaccaccacccaatcattttctccactgtaaaaattattttcatattgtcacatctgaggtcataagagaatagcctccattatagctctgtaatgtgtattaccatgtcttctaaattacataaaggaacatcttttattttagaatgtttctgctttcatagggtaaataaatattttaaaatctttgcggatctttgtctgcttcttgaggctagacataaagaaaaattctaacatgtctaacaatgccagatggtttagtccactcaagatgccaacattcaagaagggaaaactattgagaaattgatatctgcaggggactgggtaaccatgactctgccatagagcaacagcctttcaggaagggaattatcaaaaagtatgagataatttttgtaggtatcctccccaaatctcagttctcttctctataaaatggtgataactcatagtgccacgttcatgaggcaactgaaaggagaaaatgagttatcatatgtatatgttgaccacagtgtctgccatgcaacacatgttcagttgatgtactattattattattgagggaaagataagaagagttctctgataagcagatttcttctatcctgcttgatgatttttctccatttcctgtcataaatacccttttcagagagagctaaaaccagggcaagactactaggccacgttaaaattcatgggtttgtgcatttgctcatttaaaaaaatatattttaacccacttttatgagtttcacatgccctttttggagcacattatgcttctggacacccataaaattattcacaatcactaaatatagaactttcctttttaagggtgggatttctgcaccccaaaggcatagtaagtgagacacacaatgatgaagcaagttgccaaatgcctcatgcatagttggggatcagactaggattccaaagtctgtctgcctggctccacagccccattgttagccacctcactgtacactcttcataaatgctgccattgtgtgaatacttataatgcagtatttctcttaatccttacagaaatcctatgaggtaattattactaatctcattttacagatgaaaaaactgaggtttagagagctaaataactggtaagagttcgaaagaaccatgattccaacttagtctgatggctgagttggcttttaaatttttagtctgtgctctccccattgtagaaaggaaagcgtgagtaatctaaatggaaaacaaaacaaaacaaaacagtttaagcagagatgaggcacaattttatcttatgtaatctacttctaagtataattaagaactcacagtaatttccctgaagtcctttttgaaaatattttatggagttgaaaggtaaaattatgcttttaagggatcttttctacatgaaaaactgtgcgttaaaaaaaaaaaaaaaaaaaaacctcttggctctggtagatgtctggaccatatcccaacctcgtctcttgaggtgcgtttcttttgcctctgtcaaaagtagatgcagaggaaaaggcagcacaataaaaaacttcaagaattcagcccacttaaggaaaagcacttcaatttggtaaaaaaatagaaaataaaaaagtgaattaaaagaaagccaattttattattgtcaagtactgtgggaactctatgcttagtgtttgaaagctctgctttaatgaatagggtaaaatgattttaattaccatatccaaactcataaacttataaagaatttatctctatgtgctttatagctgtatttctaaaaatataaaattgatattcaaatgtgtagggcattcagttcttctaaccgaattccattccccttataatttatttcctattatttgttgagtaattcacataaagaaagcaaaagtgcaaaatatttacattattaattcaaataaatgaaaatgtatttaaacattaagcttaatattctaatcactgtaaaggtaaattggattcatatgatggggaaaaaaagggaatccaaaattaaaacaggtggttaaatgtagccttatcacagtatcttttgttaggtgaacttactggattaaataccgctcaatatcatacgagaactgaaatatcttcttgaaatatatattttttaaatcatcttttttctttgcttgatatagttaaaaatattcatctttagacatgcctattagctaacttttatttaaaatagtgaaaaaaggaagctgattttatttgtgagtttgggatattttctttattttatgtacattaatttcataaatgtgctgagttaaaaggtaatataatatattgtacacagaagagtttttattctagcacaaacaaaaggatatgttcacttctaaagatataattatctttaaaagtagaaagttcttaactaaaactttctcagatataaagtaaaataagagaaaatatttttagaagtttcatgaaactaaacatttatttgtgaatttaaaaagatttaaactggactttacagaagagaataatacaaagagtatcttgtatacattcatgttctacgcctaatttatttttgtagggcatgtgtttatatagttatatcatatttgaaagaatcttacatagaaaattaagctctggtgataatctctagttcatgctacctagctgagatgcaagggagacaaaaaggaacactaatcagattagcataaaactggaatacaggccgggcacggtggctcacgcctgtaatccctgcactttgggaggccgaggcgggcggatcacgaggtcaggagatcgagaccatcctggctaacacggtgaaaacccgtctctactaaaaatacaaaaaattagccgggtgcggtggcgggcacctgtagtcgcagctactcgggaggctgaggcaggagaatggcagaaactcgggaggcggagcttgcagtgagccgagatagcgccgctgcagtacggcctgggcgaaagagcgagactcagtctccaacaaaaaaaaaaaaacacaaaaaactgaaatacaggtagtgggaatgctaataagagtaccaatagtgtcctcagttctaatttcaccattgtcacatacatatctttccttacaattaatgacatcacaagaacattatttactaaaaagctataatattttgagaacttaactattaggttctctattctcattttactttgaagttcagaacaattagctggcaacaaacatcttgaagaattgttgcaaaccagatgctaaacctaagccttctaaaagtatctgtgtgctgacatgtggaaaagagaatgatgatttattaataaataccggaaatacatttttgaaataaaaatatgtttaaaatgttgtttcacttgtaattgtttaatattttattttctccagagcttcaagagttataatctaaattgcaactgaaggaagcttaagctagctgatatgcacctagctatttccccgcttcaaagcctacagaaccatctgcttgttggcaggtgtaattaattagctaagtggagaagacgctcccttttagagtgaataggaggagaggagggagaactctgtgaaagcctaatcctaggcagacccatcagctgggtgcctctgggcaaatttccgatgctgaaaactcattgaatttaatggttcttaatttcacaagatttctaattacagctaggataataagatgcgatccaaaagttgaaaaaaagttggcacattttcaaggaaaatcctttcacacaatgtagacatcctaaagtgtagaagttcatttatttacacattttccacttattccctcaactttgctaataagcaattttgaatctatttggctgacaggtggcaaatgcctattaataatagtaaaatgtgtcatgctaaattttgtatctaatccaacattgcttttcagaatagtcaaagaaaagtccatccaagcaacattattattcattttcaatagattttaaaaggactacattctaagaatagaaatggggggaaatataacactaagaccataaaacttcctataattttatcagtatagattatattagattatcaccgaagagtccagaagataataaactctacaacacttccttcttttaaacactctgtcagaaacaaaattccctcttaaacatctcctggtatttggttttaatgggtaaggtgagacaggtataaggaatagagtgagtagaactatggcaaactggaaagcacccatcacaactaaaagagcactgactgctcagccccagaagatgttactaagagacaatgtgaactcagggttgccagaggttggttttattcagaggggccagaaatgcagaatttatcggtaaattccctcaaattttaaacactcttctatgcaaagcacgtctgtagattacagtctttgagacagcagtttaccacatctggtttattgaataattgtatctgtgaactcctcaatgatgagcaagctcttactacatcaataaccagactgagatatgctctcatggaactagtcttcacagctcctctacctattgataaagaatggaaagggaaagggaggcagttatacagttcatgagagagtaaagaaaagtgcagaagcccctactgttacatgaacagtagagaccagaaggcactgaattccataagacttcttcatacttcttgtcatcatttgttgcaatggagtagaataagcgtctggctatctaatgattcttgaaatgtgtgctgcagacatgtcaccccagaatatcacacttccactgctgaatatttacttccacgtgtaaattttgaataggaaaggcttacatgtcatctggaagataaaatcaaataactggctgtcatgttagtatggacctgtttataggattaacataataacataaaaaatctaaagattagagggactggaaggttaaattataatttagaaaaaggaagcaaatgtacaaaaaggttgcagtcagggatatgttcccaagttttgttagtcctgcattaatcactcaggtgagactatatacttgatccttgggagtagacgtggcataggagaaaggaaattttcaacctgcttatttcataatgctgaatggtcttctacttgttctttggaaacaaatgaattgagtgactttcagctcccctaccactgaatccaataggccaatacaattccaaaaaagtctttccaatagtcagaatttcaaaagacaaattatctcaggaattgacatcagtcaactagtatgctctcagccagaagttgggtgcagggaaaattatagctgcccattgtggggttttttaatgctctataaacacgccaggtaataccaaaagacttatgggaatcaaattggagtccaaggttgatttcttttctgtattcagtacacaggaatttaaagagacctgggctctttcccttagctccatctcttaggatttctggcattgtagccttccttctttaactgtccattttagaggaacatggttagagtgaatccttctaaatgagctcttcatccctaacagtgagtgttctttctacttctgagcagaggttacagctctttcaaaatattctttttttttttttttgagatggtgtgttgctctgtcacccaggctggagtgcaacggcatgatcttggctcactgcaacctccgcctcaaaggttcaagtgattcttctgccttagcttatccagtaactaggattataggcacctgccaccacactcagctaaatttgtatttttagtagagacagggtttcaccatgttggccaggcttgtctcaaactcctgacttcaagtgacccatccgcctgtgcctcccaaagtgctaaagtgctgggattacaggtgtgagccactgtgcctggccctttttaaaagattctattcaactcctccatgccataggctggaagttggtctgtgatcctcaaatccttttttgttttctttgagtatggagaagagttgagtgagaacaagaatctgtctgatcaaatatccgagggtaatgatagtttctggaaaggaaatcagtggagaaaaataatataaaagggtgttaaaagtcaaagaaagaaaacacaagagtatgagcatagaaaaatctaaatagaacaaggagagacgtatttatttaaaatattttacctatgtattacttccattgatttgttctaagtctttcaagagatgggtggcctcttcgccaaaccatgtcatctcttgccagaaaacagcactgtgtctctttgcttattctcttgcctttaaacaattaatttgtcacagtcagtcaatgtggtcttttcaaaaccaaaattaaattgttataagatgaacaacaagggtggaaccaataccaaaaatagataattcagaagctagtatctatgtcaagatatatctagttcatattcacagataatttgagaaaaaaatacaaaaaaaattctattctataggaaagaataatcaatgaagaaacaagtattcttgaaaattgcaaatgtcatatctgataaaatatttaataaatataatatttaacaaaattgaagaagtctcctagaaagtagagaaaaaagagaaatataaagaagagaaaaaaataaaagaaataaaggatacatccaggaagtcaagcattacaagttatagagagaagaaagaacatatagaagaatacattatcaataaattgaggcaaataatttcccttaagtttaatcgagccaaataatttcccataattatgcagaaaaagattttaaaacaaaataaatgcctagatgtgtatatttaaaatttcagaatcttaaaaaaaatgtaaaatcctacaaaagaataggacagggatataagaaaggcagagacagctagaatgagaatgagagactaaggagagagagacagcagggatcaaaatcacatcagacttctcaacagggacaccgtgtgaaaagtagtaacttcaaatactaagtgaaattctttttaacttagaattctaaacccagtcgccattaatcaaaccatcactaaattatgagtatagaaggagacattttgatattcaagaacccagtaaatttacccttcaccatttttttaaggaatattttaaagatacccttcaagaaaataagggagcacagcaagatagtgaaaaataggtgatgcaggatccagcccaggaagtaactaaagagaagtatcacaatgcaacagaaatgtacagaaaataatacggattggtgacataaaactgagaggccaaagaaggtagtctccagggaaaagggggactgatataatgcatcataggaaatctgacaataattggactataacaaaaacatgtagtgtaagaaaatgaaagccaagtggaaacatcaagaaaaaacaagcaaactgcacaaggaaataaatataatcatagtacattcttccctctgctatgattttttaaaagttgcatgaatgtaaaaatcacaataatgtaagtataatgcatattgattttcaacttttagacaaagatagtatcttttaacaatatcttttaaagatacttttaaagatagtatctttaaacaatattgtttaaaagacagtatcttttacacaacaaaaacgtcaagattgataatatattctgttcaatagatgccttaaatgataaatcaagaaataattaattatattttaaatatattcagagatatgttaataatcatcagaaacagcttaatgagctagagagtagacaaaacaggagactgttgattttttttttaattatactttaagttctagggtacatgtgcacaacgtgcaggtttgttacataggtatacatgtaccatgttggtttgctgcacccattaactcgtcatttacattaggtatttctcctaatgctatcccttcccctggcccccaccccaagacaggcccctgggtgtgacgtttcctgcgctgtgcccaagtgttctcattgttcagttcccacctatgattgagaacacgcgatgtttggttttctgtccttgtgatagtttgctcaggatgatggtttctagcttcatccatgtccctacaaaggacgtgaactcatccccttttatggctgcacagtattccatggtgtatatgtgccacattttcttaatccaatctatcattgatggatatttgggttggttccaattctttgctattgtgaatagtgccacaataaacatatatgtgcatgtgtctttacagtagcacgatgtataatcctttgggtatatatctaataatgggattgttgggtcaaatggtatttctatttctagatccttgaggaacaatggttgaactagtttacactcccaccaatggtgtgaaagagttcctatttcttcacatactctccagcatctgttgtttcctgactttttaatgatctccattgtaactggtgtgagatggtatctcattgtggttttgatttgcatttctctgatggccagtgatgatgagcattttttcacgtgtctgttggctgcataaatgtcttcttctgagaagtttctgttcatatcctttgcccactttttgatggggttgtttgctttttcttgtaaatttgtttaagttctttgtagattctggatattagccctttgtcagatggatagattgtaaacatttttttcccattctgtaggttgcctgttcactctgatggtagtttctcttgctgtgcagaagctctttagtttaattagatcccatttgtcaattttggcctttattgccattgtttttggtgttttagacatgaagtccttgcccatgcctatgtcctgaatggtattgcctaggttttctcctagggttttcatggttttaggtctaacatttaattctttaatccatcttgaattaatttttgaataaagtgtaaggaagggatccagtttcagctttctacatatggctagccagttttcccagcaccatttattaaatagggaatcctttccccattgctttttttttgtcaggtttgtcaaggatcatatggttgtagatgtgtgatgttatttctgaggcctctgttctgttccattggtctatatctctgttttggtaccagtacaatgctgttttggttactatagccttgcagtatagtttgaagtcaggtagcgtgatgctttcagctttgttctttttgcttaggattgtcttggcaatgcaggctcttttttggttccttatgaactttaaagtagttttttccagttctgtgaagaaagtcattggtagcttcatggggatggcattgaatctataaatcacttcgggcagtatggccattttaacaatattgattcttcctatccatgagcattgattgttcttccatttgtttgtatcctcttttatttcattgagcagtggtttgtagttctccttgaagagtctttcacatcccttgtaagttggattcctaggtactttattctctttgtagcaattgtgaatggcagttcactcatgatttggctctctgtttgtctgttattggtgtacaggaatgcttgtgatatttgcacattgattttgtatcctgagactttgctgaagttgcctaacagcttaaggagattttgggcttagatgacagggttttctaaatgtacagtcatgtcatctgcaaacagggacaatttgacttcctcttttcctaattgaatacccttcatttctttctcttgcctgattgccctggccagaacttccaacactatgttgaataggagtggtgagagagggcatccctctcttcataaaatgaattagggaggattccctctttttctattgattggaatagtttcagaaggaatggaaccagctcctctttgtacctctggtagaatttgtctgtgaatccatctggtcctggagtttttttggttggtaggctattaattattgccttaatttcagagcctgttattggtctattcagagattcaacttcttcctagtttagttttgggagggtgtatgtgtccaggaatttatccatttcttctagattgtccagtttatttgcatagaggtgtttatagtattctctgatggtagtttgtatttctgtgggattggtggtgatatcccctttatcgttttttattgcatctatttgattctcctctcttttcttctttattagtcttgctagcagtctatcaattttgttgatcttttccaaaaaccaggtcctggattcactgatttttttgaaggggttttgggtctctatctccttcagttctgctctgatcttagttatttcttgccttctgctagcttttgaatttctttgctcttgcttcactagttcttttaattatgatgttagggtgttgattttagatctttcctgctgtctcttgtgggcatttagtgctataaattttcctctacacactgctttaaaagtgtcccagagattctggtacattttgtctttgttctgattgatttcaaaggaaatttttatttctgccttcatttcgttatttacccagtagtcattcaggagcaggttgttcagtttccatgtagttgtgctgttttgagtgagtttcttaatcctgagtactaatatgattgcactgtggtctgagagatagtttgttgtgatttctgttcttttacatttgctgaagagtgctttacttccaactatgtggtcaattttggaataagtgtgatgtggtgctgagaagaatgtatattctgttgatttggggaagcgagttctgtagatgtctattagatctgctcagtgcagagctgagttcatgtcctggatatcgttgttaaccttctgtcttgttgatctgtctcatattgacagtggggtgttaaagtctcccattattattgtgtgggagtctaagtctctttgtaggcctctaaggacttgctttatgaatctgggtaatcctgtattgggtgcatatatatttaggatagttagctcttcttgttgaattgatccctttaccattatgtaatggccttttttgtctcttttgatctttgtttgtttaaagtctgttttgtcagagactaggattgcaaccccggccgtttttttgctttccatttgcttggtagatcttcctccgtccctttattttgagcctatgtgtgtctctgcatgtgagatgggtctcccgaatacaacacactgatgggtcttgactctttatccaatttgccagtctctgtctttttttttttttttttttttgagacggagtctcgctctgtcgcccaggtgggactgcggactgcagtggcgcaatctcggctcactgcaagctccgcttcccgggttcacgccattctcctgcctcagtctcccgagtagctgggactacaggcgcccgccaccgcgcccggctaattttttttgtatttttagtagagacggggtttcaccttgttagccaggatggtctcgatctcctgacctcatgatccacccgcctcggcctcccaaagtgctgggattacaggcgtgagccaccgcgcctggcccagtctctgtcttttaattggggtgttcagcccatttacatttaaggttaatattgttacctgtgaatttgattctgttattatgatgttagctggttattttgcccgttagttgatgcagtttcttcctagcatcgatggtctttacaatttggcatgtttttgcagtggctcgtactggttgttcctttccatgtttagggcttccttcaggagctcttgtaagacaggcctggtggtgacaaaatctctcagcatttgcttgtgtttaaaggattttttctctccttcacttatgaagcttagtttgactggatatgaaattctgtgttgaaatttcttttctttaagaatgttaaatatcggcccccactctcttctggcttgtagagtttctcccgagagatccgctgctaggctgatgggcttccctttgtgggtaacctgacctttctctctggctgcccttaacattttttgtttcatttcaaccttggtgaatctgacaattatgtgtctcggggttgctcttctcgaggagtatctttgtgaggttctctgtatttcctgaatttgaatgttggcctgccttgctaggttggggaagttcccctggataacatcctgaagagtgttttccaacttggttccattctccccatcactttcaagtacaccaatcaaatgtagatttggtcctttcacatagtcccatatttctcagaggctttgttcgtttctttttactctttttttttctaaacttctcttctcactttatttcattaatttgatcttcaaacactgatacccattcttccatttgatcgaatcagctattgaagcttgtgcatgcgtcatgtagttctcgtgccatggttttcagctccatcaggtcatttagggtcttctctacactgtttattctagttagccattcatctaatcttctttcaaggttttcaaggttgttagcttccttgtgatgggttcaaacatcctcctttagcatggagaagtttgttattaccgaccttctgaagcctccttctgtcagctcgtcaaagttattctctgtccagctttgttctgttgctggtgaggagctgtgatcctttggaggagaagacgcgctctgctttttagaattttcagcttttctgctctggtttctccccatctttgtggttttatctacctttggtctttgatgatggtgacttacagatggggttttggtgtgggtgtcctttttgttgatgttgatgctattcctttctgtttattagttttccaacaggtccctcagctgcaggtctgctggagtttgctggaggtccactccagactctgtttggctgggtatcaccagcggaggctgcggaacagcaaatattgcagaacagcaaatattgctgcctgattcttcctctggaagcttcatcccagaggggcacctgcctgtatgaggtgttagtcggcccctactgggaggtgtctcccagttaggctacacaggggtcagggacccacttgaggaggcagtctgtccattctccaagctcaaacactttgctggaagaaccactgctctcctcagagctgtcagacagggacgtttaagtctgcagaagtttctgctgccttttgtccagctatgccctgcccccagaggtggagtcatacaggcagcaggccttgctgagctgccgtgggctccatccaatttgagcttccccagttgctttgttgacctacacaagcctcagcaatggcagatgcctctccccctacaggctgctgcagtctcacaggtcaatctgagactgctgtgctagcagtgagcatggctctgtgggcatgggacccactgatccagacatgggatattatctcctggtgtgccatttgctaagacctttggaaaaatgcagtatttgggcgggagtgtcccgtttttccaggtactgtctgtcatggcttcccttgactaagaaaggaaaatcccctgaccctttgcacttcccgggtgaggtgatgtcccgccctgttccagctcgccctctgtgggctacatctactgtccaaatagtcccaatgagatgaaccaggtacctcagttggaaaggcagaaatcacctgtcttctgcgtcaatcacgctgggagctgcagaccggagctgttgctatttggccatcttggaatggaaatcaagattgttgattttaactatgtgaatgtaatatatgttttaaaatacaaggagaaaaaaagaagctgaaataattcagcaatggtcgtgtataatggaattctctgagattagggtaacatgctgccaagtgttataatagcaggtaaatccagttgcaacgctgtgtggttttgagacctctacaataatgaatcttgaaacattaaaataatataaagaaatgaattcagcagggacacattttattccatggcacattctacacttaccttcagtttgctacatgaagaatccaatttccttctatttcatatattgacttttttcaaagaaattccaggtgcttccctacattttctatcccgtttatctttgcatgcagtgaatgtttttaatcatgtcattattttaaataacactttttttctgggagtttttttcccctttgactctgtattactattcctatcctacaagtgtgaaatccaagacatgtagaaattaactgacttacttcaagaaagacaggacagtaaactagttctcattgcctttcagaaaccttgctacttgagtacttaattttttaaatctgatatacttgaaaatcctaatgttaaaaatacctttaaacgactctcaaaattaattcatcaaaaaaatcaagaaccttaaattagtaattctcttttaattagagcattggacaaaaaataatataaatcatataaatgaatatttgtgggagtattaaatataaaatgccaaatattgaaaattgcaaaatatctagcaaaagtacatcaattaattacacattatgtatacatattctaaaaactatacagccattataaacatgttactaagttttaaaatatgggaataatttcatgaatacgtgagtaaaaaattgagactacagaagtctaaatacaaatataaatgcaatttgtctaaaatacaccttaggcatatatattcataacgcatagatgtcatactgggacaaaataccatccttaacacctgtataatcttagtaaaattctaaacttcactttcttcatcagaaaaatgtgtaactttacttcatagtaggataaaatgagatgatgcatacaaaaactaatcacatttttggccaaacagtgagaagtgtctgtgtatttactataaacataaggcatgtaatatatgacttagaattatatgataatgtattcagaataattaacttaagacattaaattaaaactctaatattgtagcaaattgcacagaaaataattagaatagtatagaggtactaagatgaaaaactgaaatcaacaatatttaaattacaaatacaaccagggcccaaattacagtcttattaaggaacctatttaaaccaatagaaagcaaagcaggcattttagcgagacagataaaaagtcactaccaaaaaaaaaagtaaatttacaaagaaaagggtcctttggtccttcttgaagaagtctcaaaacaggtagaaactcacttatctggtaaatcataggctttgagtcagaaatttatattatctaatttaacaaataataaaatcaatctgaaagtttctcgataatgtttcccagcattattgtgagtgtcatagtacaatgataggaagtaggttccagagcctgtgcttacagttgctatggcacaggaccttaattacatatgccacatttatacacatgaatacaccattacaaactgatggaaacaccacaggtgctgtgcctacacctctgatttccagggacaggctcagttgataggtgtttttccagagtaattataaataatacctctttttcctctcaaaaggcttctcgcatggggaccctattcattaaaaaagtgtaaggacttataaaatttctataagaacagtcttcacaaaggaaaaaatcaaggttgaagcttaaatgcttgctacatttcaacgcaaagcaattatatgataaagaaagtaactcatagggttattatgacaatctactagaataatagcaactatggatttgattagacatatagtaaattataaaaacataaagtgttatagttattcaaaacaatattttaaaaataattccaaatacgcatttcataggaataactttataatagaaagaaaagtgtttgactctcctcaggtgttatgttttcttgttttgtcaaaaaattcagcagttcaccttttcccaaaagagtaaggtaaaaagcaatctatcaaatttttagagattgtcaaaaaagttaagaaatgataacaaaataaaaaggagattttttttccccataggaatttcaacccctcaaatattccacttttaagtctaccaaaaatatttaattcattgtaaacagcactcaactaaatttttgtttatggtgtatgtgatagttaatattagatgtcaactagaccagattgagggatgcctagatggccaatgaagcattgttcttgggtatgtctgtgaggatgttgccagaggagattggcagttgagtcagtggactgagagaggcagacccaccctcagtgtggtggcaacatataatcatctgccagcgcagctagaacaaagtaagcagaagaagggggataagcagctttcagaatcctctcactctccctttgctggatgcttccttcctctccggcccttggacgtcagactccaggttctttgaacttgcaccagctgcctccctgggagtgttgggggtgagggattctcggtcctttagcctcaggctaagggtctcactgtcagcttccctggttttgaggctttctgactcggactgagccaccctaccagcttctctctttccccagcttgcagatggcctgttgtgagacttgccttgtaattgtgagccaattctccctaataaactcccttttttatatcctgttggttctgtccctttggagaaccttaatacagtgtacaatgctgattaaatgtaaaagtatatttagctgttaataaaatatcagttttcatataaagataacttggccaggcacggtggctcatgcctgtaatcccagggctttgggaggctgaggtgggcagatcacttgaggtcaggagtttgagaccagcctgggcaacatgatgaaaccccgtctctactaaaattacaaaaattagctggatgtggtgtcacacgcctgtagtcccagtgacttgggaggctgaggcacgagaattacttgaatccaggaggtggaggctgaagtgacccaagatcataccactgcactccagcctgggtgacagagcgagagcccgtctcaaaaaaaaaaaaaaaaaaaaaaagatatcttaatgtgtattattcatgaataagcattgataaacatttctaaaaataaaaacaatattttgaaaaacttattgaccatgttggtgatacagaaacacatatctcaactaattttaaataaaatagttatatcacataaacggaccaccaccactaccagtcaccactactaccaccaacaaaacacagaactctcctgaacaaataatcaaaaagtgaatcaataagaaaaatctttgtgattcagtacttagcattcacttccctgtttgtagaaatgtcagtagttagcaagcaatggagctggaagcactgtgttcccataggtactgttttctagatgacatgtaaaactctatgcttgaccataaacagcctttaaaaaaatcccagggcacctttcagggaaatagcagtgtttgcctcaacatcttggcttagttccaactcactaattacattcagcctgcctggataattttagatagttttaatgtgaaagtgcattgcctttgtttgattatagtccctggctcttcctttgaaaagtccatcctcaaacagtcacggggggatttttaaggctgattatttctcttaaacaaaaatgaagacctgggctggcctagcatcttcctcaaagataaataattagtgtccccacattgaattaatactgaaattttggatacacttatagatttaggcaagtcctcagagaagggaaaggaaacctttacatttggagcctcaatagagcggagtaccttcttgttaaaggggttgtcgtagacagagctaggcaattctaattactttattgaacttctctttggtatagttgcaaaaatctggttattactctactcaatatcaaataacaaacatatacatgtatatcaaccctgtaaaaatagatggttttattttccaggacaaaactttgaaaaggtatcataaatttacttttcccctttgatgctgtggcagggattgctatcagtccccctaaatcttgtccctccctgtcttctacagtaatggaattttcactgggcatatgttcaccaaaccaaggcagtattccctccttgcagctaaatatggacacatgactaagtcctgatcattgtgaagtgagcagaagtgagatgtgccacttctggattttgcctttaaaggtaagagatgagcccttatctttcccatttcctgttcctcaaggccacatgattgaaaaccatcttcaattgtacacatgacagcaacattcaaggggatggaaagaatttccacaagatggaaagaatttgggaccccaacattgcagaactatcgaatcctctatatacgttcttgcaggctggatgtctttaagctgctatagaagacagataagaactcatatcttgttaaagttactctaaagtagttcattgttcattgactctgtatcttaatacagatgatattacacattgtttttctcttcccatctcttccattaaaattgacaaattgaagatcacattcctcatctgaaactagaagttgcttcacatgtccagccacctttgcaggaatataaacatagggttgaataatcctcaggatttttatttcaagagatactgaaaatccctatgtttaagtattaggaaaaaaatatctaaatatttaggggacaccatgctggacaaaacacttctagagcctgttggtgcagaagttgtggtgcattgctgatataacaaacacagtttccaccatctgtctaatgagagatcagatacaatatggcaaggagtaaattctttctcagggtactctgagaacatacaggagggcgaattttaaggagatacgttagctgggtttcgaattaccagtatgtgctagttagataaatgtgggtgggggttggggcagaagggtattccaataaaagaaactatcaattaacaatggtctccaaataacagaaatcctatctacttatgtttaagtacttaaagggagcacaaaataaggcagtttttcacttaataaaggataatatctctgacttttgaaaagatgataattcaggcattagctcttggaataaatacactaaaactcaactacatatttccattaacttgaaactattttttcaacaaaaacattgaatatgtttttaaaaatacattccacaggtccacaatgaagacagattctgtgaggaatgatatagtcagttctcttataggtggatggggatgtatgatcactaagaagagaacaaagaagtaaggaaggtagttcttgtctccaattgaaacatttttcaaatgtatttataaaatgtctgctctaaaataaacaagtgacacagttttaaatttctaaaagcaatattttaaattattttttcttgattgtctatcaaatttgaaaatgaagcataatattggcttatggtagcctaattttcagtagatgccacaagataaaacccaaataatctgatttgaaccttgcctaaaatcttctctcaccattgttttcctgtggcagagaatatatccatgattatttagataaaatcattttttgcattcatgtattcaattttcattcatttatttgctaattcagaaaacattttgtgattgcacattctgagacagacatggtgctaagatctagagatataaaaaaatgaaatgacatggtctctgatcacatagaaaacactaactaaattaacaggaagatataaaaataaattatcacaagaaaagacacatgttataatggagatacatacaaagtacaaagggagaactaacagtactggaatctgccaaggggaaatagtaaaagctttagtctgaaacttgtctcgaggactagaaagagcattctaggaagatccccagaatttgcagaaaatagaaatgttagaaaatgcttatagacagtaactattaggagtatttctgcatctttagagtacacatagcataaattaagcaagggaggatggacttaagaacagagcagagaggcaggggcactttcacaaaggtctcaaaattttttaggtgtaatgggaaattatcaagtaattctgagatggtaagtggtatgttttaattgttaggatagtgaaagatttttggaagcaatgctaagaaagggtagaacaaactagaggtgaaaaaaacagtaaggagggtattgcaatagcctgaggagagtgttgacctggattagtggcaacagggataaagagagtaggaaatagattttgtttaagttgtgatagtttttagatgtgggtgataaaggacattgtataataagttccatgcatcacacttaaataaatgaataaatagcaaattttagaacagatgagacccaccagattgggaaaagcaaaatgacacattgactattagatggagttcagtttaaggtgcttgtgggaaatgtttcacattcaaatcattaaccattattctaatggttaattgagtaaggtacataaacagataattcaaaagcagatatcaacaactcacaaatacatataaaaagtatataacttttaaataaccaatggaatatctaatgaaaaagaagtactaatttatgcttgcttaacagcagcaacaactgagaattagggactgttcatgctggtgcaagttgaatgaaatagtgtctcttctactgtgaacaactatatgccaataaatttgaaaacctagaggaaaagaataaatttctggatacatacaacctaccaagattgagccaagaagaaacaaaaatcctgaacacaccaatgacaagtaacaggtttgaatcagttaataaaatatctcccaacaaagaaaagtctaagaccaatggcctcatcactaaattctaccagatctttatttaaagaagatttaataccaattcttttctaactattcaaaaaattgaaaaggaggaaatttcttcctcatttaactaggccagtataaccctgatactaaaactaggcaaagacacagtaaaacaagaaaacttcaggccaatatctctgatgacatagacacacacacacaaaatcacaccaaaatatgaggaaaccaaatctaacaacacactaaaaagataatacataatgatcaagtgcggtttattccagaagtgcaaggataggtcaacacacaaaaatgaataaacatgacacgtcacctcaacaaaatgaaagacaaaaactatgtgatcatcttaatggatgcagaaaatcaggataagaactctcaataaataaggtatagaaggaaagtacctcaacacactaaaaacaattatgccaaactcatacgtaacatcaaaagtttccagcttttcccctaagaactcaaataaaacaaggatgcccaatatcaccactcatattcaacacagtaatagaagtcttagccagagtaatttagcaagagacataaataaaggacatccaaactggaaaagaggaaatcaaattgtccctgtttgtagatgacacaatcttatatatagacagatctgaagactaccaaaaaacttaggactgacaaactcaataaagttgcagattgcaaaatcaacatacaaataacaaaccagctaaaaaagaaagctagaagacaatctcatttacaatagctactagaaaaataaaataaaatacctagaaataaatttaaccaagtaggtaaaataattggacaaggaaaactacaaaacactgatgaaataaattgaagaggatacaaacaaaagaaaaagtatcccatactcatgaatcagaataattaatattgttaaaatgaccatactatctaaagcaatctacagattcaatgcactccctatcaaaatatcaatgatgtttttcacagaaatacaaaatatcctaaaatttgtatgaaaccacaaatgacgctaaacagacaaaacaatcctgatcaaaaggaagcatcacataaccagacttcaaaatatactacaaagctctagtaaccaaaacagcatggtactgacataaaagcagacatgcagatcaatgcaagagaatagagaacccagaaattaattcatgtatctacagctatctgacttttgacaaagctgctaaaaatacacattgcagaaagaacagtttgtttaacaaatggcgctaggaaaactggaaatctaaatgcagaaaattaaactagatccctaactctcatgctagatatagttaattcaaaatggatcaaagacctaaatgtaagaccagaaagtatacaactactagaagaaaacataggaaaaatgcttcaagacattgttttgggaaaagattttatgaataagaccctaataacacaggcaacaacataaaaataaacaaatgggatgaaattggagaacatcaggttaaatgaaataagccagaaacagaaagttaaactctgcatgatctcactagtggaagctaaaaaaatttgatctcttagaagtaaaaagtagaaaagaagatattagaggttgggaagggtaggggaaagagagggatgaggagagatttgttaaagaatacacaattacagctagatagcagggataaattctactgttctacagcactgtaggataactatggttaataataatatatagtttaaaatagctagaaggagaatattgaatgctccctacacaaagaaatgtttgagataatggatatgctaattagtctgatctgatcactatatattatgtgtatcacaacatcactatgtaccccataaaaatgtatagatataacgtgtcaatttaacttttttaactgaaaaataaatttaaaaagaactaatgtatcacttgtagctgatggagttgcaataacttttaaaagtcagacatctatctgtacactttggccaaataatccatcttcagggaagctatcctgatgaaagaatattccatagaaagaaaattacatgcacaaggatgtacactgctgtattacataagtaatgcaacaaaccaaaatccacataaatgtttcagaagttggggagatttatataaaatatggcataattatttgatagaatattgtataactatttattatataatgatgcatcaatataactgtggtaaatcgaatcattagccacaacattcctttgtctctgacaaccacatgcttgtcatggcttctctgtagcaaaagcacactttcctatcacttggttttaggctgggccctatgattttctttggccaggggagtggcagaaatgagaatgtgccatttctatatctagagcttaataggcatcgtggatttctgctcccttttatggactgtaccatcatcatgggaagaacttccaatgctgttacaactgttagcccttcccctgggccacagaataaatcactatggaacaaaactgccccaatccaacctagatgaacttgtgcttggagcagagcttttccagtcaagccctgtataaatcaccagaccagaacttagccaacaacagattcataagaatacataattgttgttccaagtcattgagttttattaggatgtttttggatgaatcatcttggggcaataggtaagtgaaacaatagctatgtgaggacattcatatggaaaatgacaaaagaaaatattcaaaattacaattgctagtgtatgtgggttttgcgattgtgagatgccagacccaagcttaatctagtattttcatgtatttgaactgaaaccaacataaggggtaagcatctcttagagacagaattttttaatgaaaaatataaaatattcattttatatgtatcttcattttaaaataaaaatatatattattttgctttaggttatttttgtttctttaaaaaatcccactaaaactcattcctagcagaattcactttattactctcagctgcaaatggagaatctatagaaccttatgtaatcttatctaacttaaaatatcttccttatgctattgtggtaaattcaatgttaatacaaattcatatttctactgcattatcaaagtatattaactcaaatagtttcacagcttgaaaatgtcattaatcaatgatggggcttctataatctgtgtaatttttgtcctctgataaggtcaggttttctaaatgactggcacgtgctaagcatttcactatttctgtcatttaatttttgagggcccaattggccaattcatagttaattactcaatgtttacattcaaagagaagtagaaatgggagatataatacacaatatgtaaaattgtgtatgaaagaaaatgttttcaatagcatggacaacatgaataaaaattattacgaccaagaccagctttgtgcagaatggtgatttaggctccccgactctgtccaggcttgggcatggagtgttctcacacaatctgtatacttttccttatggcaagtgctttcccattgccctctagctgccagtaactctccactgaagcattttacgagtactgcttaaaaatatttcctacttcctttcatccttccccttaaggtttaagctgcctagattctcattccttctcagctaattgctttcgaaaaacagtatcttgtaaattaagtccccttaaaggactgcttaatgtgatacctggtttaggaatagttactatttagcaaatggtacctgtgtatgcctcatcgctaacgtatgcagttctgttgtatggtatctctggcattatggaaggcaaggataggaaataattcaggcaagcaaagttccagagcacgcttcaaatcataccatttagacaactgtctattttatttataatgtgatctgtcctgcaaccaaattacttctttttaagttaaattcaacccataaaactaatttatattcctgagaaaaacgaaatgctacttcaaaagttttatgaaagttcatatttttacaagttttacctaagtagaatagattatttacatgtattataatagaaggaatatatatttacaatagaaaagaaatgaacttgacaatgatgatttgattgtcaaaattagataagacttaataattaaaaagaccgaaaataattaaaaagaaaactcacttcaaactataattttacgttatttttcctactttcaatgttctctgaaaaaaatatgtttgtttttacacaaaatttgcagtggcaccaacttatttaaaatgttaattaccggactgtaatgaagaatttttagcaagacacatatttgacttcatctttgttaatatctctacattctacactagggtacagtaaaacttctgtatcttacctgccatctagtaatactgttggaaagattattatgattgcattatgaatgactgatttaaataaagttaataaatcaaaagagaggaacaaagcctttgcaggagaccagaacagatataaatttttccataagagaagaaaaggacagtctattcttttatatcaaaaatcacttttttttcagtagaataagtctgttttaagatgttaaatttactgaatagtttggacaaaattaaaacatgtagatttattatcatcatcataatgataataagtagttaacggtaatgaacatatacgtatttccaaagcttttatgagactacacattgagaatacatacttataggcccttattatttctttaatgcagaaactctgaacaggctcattgaaaagagcaaaagatggcattgtataaatagcaaaatgaattcaagcttttattattttttgtctcttctgacttctataacttagcaacaacaaattaaatcccatttcaatgtaacactatcatgaaattctctatttaacaaaatgtcttctagaccccagctgattatctaattgttctgagcatttagcaattcagtcacttttattaaatatccactatgtgctatgtgctttgaaggacagagagataaatgtgagtcagtccaggagcttataatctggtgggtaaggtagacttttaaaaacattttataaaacaaagctgaattaaatatgatgtttaaaacagtcctggtagaaatgtaatatatttgtcattatatatatattatatattattaataatatatcaatgatatatttatataatacattagttatataatgtattaatatattacactatattttattatattatattaatctacaatatagattaattatattatataatatatataggataatcctgttaatttgggagctttggcttaggaaaaaatctcttaagatttttctagagcagaacttccaagttagactaacattttggatattaatggtctacatatagcttccctagaatcaacctaatcccaagaagacatggagatcaatttacaatgagcttttgggcttccatacagaactaagaaaacagactgaaatataatcaacacaaacactaaaagttaaaatttcaatgtatttcaaaaacattttgaaatgaagtagtgtggtataaggagaattgcacaaaattagtaagaatcatagagtgcataatccttcattgctttttttaaaaaaatccagcacatattgattgaatgcctgctatatttcaggcactgtgttatggattacggatataatcataatcaaatacatatattggtcctgtctttatggaaccttctatctcaagtagtaaatgttcaaaaaatttgttaagtaataagttatgaatcataaaaatatatttcaatgcaggtccctattgtgtttccatccatagcccttattatcttctcttatactatattatttatttatttattgtatttattgcagactatctccccaaactaaaataacatctcacaagggagtagatctctgtctgttttatttcctcctggctcccaaggacctagaacagtgtctggtatcaataaatatttgttaagtgaatggataggcctgactttgcttaacaccaagtatgcagaatgggaacaggaaactaaatttagcaaacaggtactaccctgatagccacaaaaggatacaccaatataaaataaaggaagctgactaattctctaacaccacatacaagacacattcatatgctatatgtgtatttctgcatttatcaaaacattttaatgacatattttacttaaggcaatccttagagtttaaagaatgaattaaacttcttgcccaactgttatttgcagagatggcttttgtaaaggacttgttcttcccttttgcatgtgtgtatatatttaaacacatgcaggtacacggttttcagttaagtttgtgttgggataaacacacagcatgaatcctgggggctatgaaatacatctgtgtatatataatccaaaatttattatggaaacacaagaaaattcttcacttttaagtatggttagattggggattaagaataaaatttagaatgttagactcttaccctacccatgctctatccgaaaatgactttctacccatgttgagtgtaccctcttctcattatctccagctctgatttactcattcattcattcacatgataatttatgagtgctgttctaagtccttggagttacctaagagctcttctaagcactgttgggacagggttatttccttctgcaagacacaataagaaggtttttgtttgttttgttttgttgtatatcttttcaaattgccattcatcattattgacaatccacataccacttagtttgtgaatatgtttgtgtatttagtttgacattttgggtggaaataaaagccttctgtttgtagttaattaaaaatgaaagtattcatgttgggattttatttttaaaaattgatctggtaagacaaagtggtttttttttcaatcttgctgatatacagttctttttttaatgaaaaaatgtcaaaaaacttaagtaaattaaattttgctatctgctgtatttgttcaatttagttggaaagtttaaaaatacctccaatccatctatatttgctgaagaataaatctagactttatatgtatatattattatacattgatggctataagacacattcatgatcatgcagtttcttcatttgcacataatatttacaacatatgcaattattttatttttattatatacaataaaaggcaggccattttcactttttaaaagtctcctctgaatgatacattgatggctataagacacattcatgatcattctaggccagccccctcactttacaggtgaggaaacagaggcaaaaaagcaagtcttgccttagcagagctatgctagaattcacatcttttgacattaatctgtattgtgtttattccaggactccagattaatgttaatctgtaggataatatatgagtttaagattagaaaaatcttagggaatgtgaacaatatcaatgtgactgaacagagtcttagtcatattaattaaagtggattgacttttatatgttcagttggatgggaaatcagtgttctatcagtatttcctcaatatcatattcatggcagaatattcctttagaattttcaaaacacattttgctactatgaattgtgtagttacgtattaacgaggatggttgtatggttatcattttcgcaccagaagaaaaataaacccacaatacacaaccctgaaataaggaaagtagaacaagctcttctactatcaaattttcttccagagcctgtggcatgcctccacatctgtgatctgtgtctgggccctagaattcttctagggtcatcacaatgctgcagagatggactcaaatcagatgcaaatttaatcaggtgaacaacaacagactcagaacacatctaagatgattatttttacatttttttgtcactgttgctactgttaagcagtggtctcttgctaaaacacaacctcactcagaaaccaatatataaagaaaggttccctagatgaaactgagtgccccacagaaatgtctggttcagtctcattattttacaaggattgaaaaggaagccagattgggagtccttcccacggtctacatctagagtctggacttacttctcaccactcctgcacacactggctcttcccaggtctcactccaccttttccttcctgccaagcatgctccagcatcacatgctgcctccttttctgggagcactgttgccacagtcttgatacagctccttcgtgttgaggtttcagctcaattttgcctattcaggaaatttgctggtaccaaccactctctttccttctttattgagagaaactcagttgcataaaattggactaatcttaatctttggttcatgaagcattctcatattggagccatgcatggtttcctttactttcattagttacttaattagttattttaaatgtgtactaattacctgtcagcttaaagcacacacaaaaagctaggatcttgataatgacttacatgtattacttccattaacccgtccctatgccttctccaatctgaactctgtggtcacatcattattttcagttatatgtactttcattgcgtccatatataacatacacacacacacattattttagttgttttaaactttagtaaatagttatcagtctgcatgcaatcttttaggacttacaatttttatataatatttgattgttgaacttgattcatatattcatatgctactcaagttcacttattttggttaccgttaagtatctcattgtgtggcttattcacccatcagttactttctacgtcatcactctgtcttatttgcttcataaaacatagcagtatttgtagaacataccaactttattaatttgtttacttgtttatcatctgcttctcactgctaggacatactttttaaaggacagagatatatcttatttatcacgctatttcaaattattcatgtaacatatattgcattaaaaaaatgaaaaaagaattcactctagacaaactgaacaccttgagtttccttaatatgtcaggttgtttcttatctattgtccttccttcattgcctttaaagctctgccacttagatttgtgatttgaagcagcctaacatacgcctgcttctttttacttatcgtctatatttacaaatttaaaatggatgacttatcataaaaaattataaatgacataaaatatacaaaatgcctggcacattctgaatggtcagcaaatagtaacaagtatgactgctactccaatcacattacttggagtgaatataacccccatccccctgggtagttttctcatccatcaaggctcagcaaaagtttcacccgcttcagggaagctctgagatacctctctatcccctgtacctatcctaacactagcacactgctctgaatttgttattctacttatccacccccatatcccacaactctttcttggggactgtgtcttatttgtttacttattgactagtcctctttcctctaatgccatgttaaacaagtaccctttgagtggctcattccagcttccagttattgtaaatcacactggattttattaacttgagggcatcatcagtatctgcttccctgatctctatgctaacaacccagttaagaaataaggggcttaatcaaggtgctaaatttgaggagcctactctacttggccaaataactaatgggctctttcctatgacaccctttctttataatgattccctttttatttcgtaccacttctattttactcttttgacttaaagatacatttaattattagcctttaatttgtttatttctatgtttgatcttttaaatttcctactgttaacaatatatttttagttaactttatagtagcttctaaaattagcataactaaaataaattaacgttgaatactagaaagcaataaacatcattccaaaatgaaacaaaatatcaaaatttgtataattttcatatttttatcaatgcaataaaaatataaaaatgtatgtttaagtaggtcacattaaaaaataaaatacaacccaggtagcagaaatgtttataacaatgaagtgaaatgagattacatttcatctacgtgatcttttaattatatttttattaatcttgcaccattaattaatagggttataagacagcacatttaacaaggactgcatagagcactttgatatggccacataaggcatgagaatctaatactgatggtcatatattctataaaacttaacatataccaggatgaaaatagagtggaacacattaaaatgtaggttaaaaaaataataaaaaaaaacccaagtcataaaagcttatgctaaattaaatacagagggatagaaagaaaaacagcaaacattatttgctaatgaaaaagtacttagcttggagatgaatgaataaaaatcataattaaagaatctctaattaggctcattctaatgtttcagttcttgtaagacagttccaactacgctttccaaaggtttttcaaaatttcagagttaagtggctactgggacaacaaaggcaaccctcgtgtccacttcaaacaagtccagtctaatactgaaatagatgttttactcatgaagggtcatgttatgtgtgcagttcactgtgctctctatatcaattggataatgagagagcttttcagggtcttgttaaaaactttagccagatgtcaccccaaatcaccaccactaatttccgtactacaaaacagcctttgacctaatgagtagtcaaatattccagctatggctttttcttagtgtttctacaaacatgactgttatctaagaaaaaagactaagaaaaatcattggaatgttatgtttcctaacaaactattaagtatgatttagttacttaaaataatagtaatgttgccagtcatggtaacattaatacctgtaatcccagcactttgggaggctgaggtgggtggatcacctgaggtcaggagttcaagaccagcctggccaacatggtgaaaccccatatctactaaaaatacaaaaaattagccaggcgtggcagcaggtgcatataatcccagctacttgggaggctgaggcaggagaatcacttgaacctgggaggcagaggttgcagtgagccgaggtcgcgccattgcactccaacctgggcaacaacagcgagactctgtctcaaaaaaaaaaatagtaatgtcttcactgtacttttaaaagtaaatcatccatttgtatttctttttaactagaaactagaccagaagttctgcagtaacaggacaaatgtggcgtcaagccaaggtgacacactcatttttgttcttcccaagaacatcttcagctgtctgtacttgaaagtaaaaggtgaataaatacctgaatataaaaattcatatagctactgtagcttttatacctatcatgtcacagcattcaaattagttttcagtaaatattaactattatgtcttactctagtgatagcatctccacagacttgacatataagccatggatttgaaaaaaaagttgattattatgagagatgcatatgcctgagtattctgtccttactgagaataattttttatatcttacaaattaataagatacgtttagagcatagcactcttcacaaaaatacattattaaaactaaaaatacatttttctctttaagaactgtcacaaataaaatgattctatttatgtattagcctttagtctctgataattggatttatcttttaaaatattttagacataatgcattaaagataaaaactctccttatcaaatactgaaatatgtttcttgaaataacaattaaataaatatatgtatgtgtgtgtgtatatatatatacacataaacgtgtgtgtgtatatatatatacatatatatacacacatatatgtaaccagcatccttgtgtatcagaaggggttagattctagtgatggcaatttcaaaaaggggctggcatgtaaagtaaatatgtgaaccatcctggatagaacagggagcgaggggtcagaggatagctgaagaacacattccctgtctatacgcattgatattaaaatagtttgatgcactgaattgaataaactacatatatatagtttatatatatataaataaataagactatatatatagtttatatatatgtttgcaggtgatatgttgacatataaattagaattcttgtgttcaaatttcagtttggcagctatgaaatctctagaaactgatcaaatattttctaggttcagatattctgcctgtgaagtgaggataacacttccttcacaagtaaaggaaaaataatatataagagtagatataaaaactgcctggaacagtgcctgacaaacagcagatacccagcatattctagaatcctttccccatccccttgtaatcacaatctatcaggatgaccttgggtgcaagtgcagtgaagtatcatatggtttttcaagtaaggagctgatgattgcacataagtactctagaaataaggcagctccctgactggttaattcaattacttaaagatgtcttaagtctaaggacgtcttagttttcaggttctctccatttttctgctctgccattctcagtgttccactgaaaagaaactcctttacattgatttcttcatccagtagaggaaacccttcccagaagcttctcagcagagttcactttgtaaatataaggcataattacaaaagattcccatactctaatcaagacctggcaaggagaatggactacaatgatttgtttagactcagatctagctctgagctatagatagatatgatcatcttccctgagggatggatagaaaaaataggaatttttctgttaagcaggaagaaaagatatgaatttggattggcaaccaaccaaggatactcatgttggattctgtaaatatatcaattttcacttccattaattttatgattagcataattgttcaagcagaagcagcattcttggctaacatggctcaggtttccactgagtcattctaatatcaagctaaatgaatatcagattagactagacctggtcattttcaaactatattaaagtatcctttttaaaatgaaactttctagaagagtcccaatttatctaggagataaaaagtagatctgcctggttgaactgaagcatggtatgtgactgtaccccagttcactggatgccacccctaggtgcatattcagagcatttactatgaaaacgagtgtagtcgatctttacagtcccttctagacctttaattttatgtctatgaaactgacaatatgtcatccttccgcaatttgctaccatgtcagtttgcttcaagatgtgtttgatgggttgcatatttttatgatacgacaaaggagtagtataaagatatcagagaaattaccatataacacaattgaaataggctagttgaaaggaaaatgcaaaatcaaaaacaaaacaaagcaaagtcactgtaaattcaccctgaagcaaaactggaggcagtgcaggagaattctagtcccctggaaaggcaggtggcaaagtcactgcgactgctcaacaacttacagactcttaacagcagatctcaaaggagtgatgatgaaaacagctgcagctgctaaccagagagtaggggcaaaatacatatggatagcttgaactgtaagatctttcgtgtaaatttttgttttatcaacaagtgggtcacttaaaaaaaaaaaagaaggggggtaggggcaactgactttaagggaagaagacattttttaattagatcatattaggagaacagttaatatttttttactttgttccaaataaactaggtagaaatcaagataaccaataaaatattcctgaaagactcaataaatatcgaatttgatgtcatcaatatggaagtgggccagtacaaggcctggaaacagtaaatctcagcagatatcaatacaatttgttgtagaatctgaatctcacaaagtgaaatttaggatcacttgttcagcagcagggtcaaacttaaaggtggagtaatagcaatttaccttcttgatgtaccacttgggtaatctgtgaaagatgctggcctgtaaggagaatctaaagtctcccagggggaccaaatttcaaatggtaaagtcatatagattttaaaaacctattcatatattttaaaacttttttcctaagctaatgtaggccaaagctttacattcagtcataatgcataaacatgtcaaccacaatcctttactgagagatcctacaatctcctcatagggaatatttttccttaatatttttagggaaagatcttttttaagcccattaaagttgcaaaggctaatgaaatgttaaataatgggggatcttattggatttaatcatcaccccagctctgcttcattaaccatctctgctcagccttccacaacttcagctcttcaaaagttacgcaaagtaacaaaaatacatcttttgaaggctgatggagcaaataatccagatgaatatttagaaatgcatggctccattgtgatttcctggttctctaccatgccatttttctgcctccagtatgagttagccacaaggactctctacataaaaccactctgacacttgaagttttatgtgttcaggaaagggtaaaaacactatgcaaggaatatctaattgtggtttaaaatttctgttgactggaaaaaatagggcatgtgagattcttgattaattttttttattttgaatggtcctaaaatttcatcttatgatgtataatcaatatgaagtcacattcagtaaatagagtcatggttaatttgaagcagatcctaaaacatttaatgaaaaacatcatttccactcaccttcattctttcaaagaattcagtctttgaattcctatgtcattttattttttggtaggttctgatgaagacaaatcatttgcttatggatactttggctgagatgcatttaatgaaagattcagtaccgtgaagtaggtcatgatcatattaaatgagaatacaagcaaatattgatacaagtgaagcaacaataaagttgcaaaaccaaggggaacctgacctacgagaaatgtgggagtgtgtgtttgaggaacagttgaataccttggggttgcagggttgaataaaggagcttcctagaattagaactgggaagagtatacaagacacataagggaaaacttaacagtattgcctatgtttattgctacttaaaaggcaaagaaatgctaagtataaataaaaataagccaacaaaatcatgtcaggtctttatctaaaaataggttgtataatatatatcttgccttcttgatggggatttctgaagaagttagaaagatgaagtgagttaacgatggaaaaatattttgtaaatgatggctgctctgggagtccccaacattagccttcattcagatatatagacacacgggtctcaatatacagttttactcatggataaaattgattacagcaatgaaaataagaacacactttcagatcataaggtaaaaagtcacaggcagagtctgcaagaatccatatgcaaacttacttatacccacttcctcccatgaagggttacacagagagcattcttcccccagaaataaacatgtagcaacatgtgtgtgatatttctacgagggaaatccattagagatttaggcatccaaaatttttattagaaggtagtcacatatattggtactctctgcttagtacataccaaacttccagagtcatagaaggaaagcaggtgttcagcataaaccacattgtttgcacaacaatcgaaggacaatagaccatgcatatcagttgaagaatagtgagaacactacaaatattcaacttcccaaacaccagacaagggccaatcttgcaagcaagcccttctatgaatagcagtttcaggtctgctgtgttaattaactcttttctgcacaatgacagctgcaaaatagcttgctatatattattatataatatttcggtaatattataaattagaaaagattatatgaaatgaggttattaaattataaggaagctttagttttaataagaaattatgtgtaacatacaaaggcacaatgggagccaaatagttaagtacagtagaagtaagagaaaagttttttaaaatattgttccatctctaaaaaaggaaaccagttttaggcaatagaagaaaaatgccattaagcaacttttaaaacttcttttatggttccaaaaccatttgattatgaaatacatctaaataataaattttggtggttaaacttcaaacatggcaagattatacataaaatagatcttaaaattctataattccatatcacaggatattgtgcatgataaattgttgacaggttaatcctaatccaaatctatgatactgaatctgttcgattcacagctaaacatgacttgaagagtttccaccaaagtgctccaaaatgcttatagaattcagacatcaattctagagggaaaggttaaaagtacttgggttattgaaccagtagtcaagtgaatgactgaaaaactcctctcaagtacataaagggctcttaaatagattctctgcaccaaagaaagcatgagaggcttaatctaaagcatagaggattaaggttagataaaaggaaaaatttataggcaaggagagttgtttaacacagacatgtatcgtagattctcctcgggaaatattaagacttaaaggcttatgtagcaaagggtttaaaatcatagactctcaatccaagctgcctagggttgaatctccttctcactaactaactgggtaggcttgggcaagttatttaacttctctgtaactcagtagtctccacatctttaaaaatgaaatactaatcgagtttgtgtgtgaataaaaaatacacataaaagccctagaataggtcctgtcatctctctaggcactaggttcccatttactaatgttgtcattttctgtggataatatattatgttccaggtattatacagggtagcaaataaagacagatggtgagacaatgcagttatagaggtgaatcagaaaatgactcatattcttgaagaaacttctaatctagtggggaaggtggtcataaacatatctacaaagcacatgggaggagctctgtggcccgtgctgagggttagctgaatgccaaagtggactgcttgggtaccatcattcagatggtgaattacacagtgctatttcatgggtaatgactgtgaaatcagagtgaaaaagtaggagtaccagagtgcggagaatcaacagcagagctggtgtcaccctcacttgtgttcgctttccatgtattgcaactttctgtagtttacaatggcccacttgagtgagtttatgaaagtctggttatttgagtaatttctgtgagtgtgtgtcagcggggtgggggatggtggtggtatttgatcctatctgaaagttatccaagctcttgacttccaataatcagtaccagccatcatctctacatagcctctgcttcagtcatcccctcagtgtttaacttgagataattttaaaacacatgttaaatatcacatatgatacagctttacctttaaaatgcagaatattttccacttattacttagtttataattactatggacagcatattcttgaaagcagctgttataaaactcaagatattaaaagtgaagttttttaaccattcttttcccattgtcttcacttcaactttcaaaaacaaatacaattcatatccttattgcagtttcaggcattttctgcttatgtgggtatgtccaaaaatgtcagtgtaaaattggcattatattgtatgtaaacaaaattcaataatattaaacccttcttaatgataaacattttatagtttaaaaatatatttgaaatagacaaataattccagaaacacaataacgggtctgtgattcggactaacgggtctgtattggaggtcacagctcctattttaaggtacagtgcaaactggatcaccttccaacatgttggctagaactgaagctattgaactctgatttttcacccaaggaaaagctattttctaagcatcctactgtgaaatttgcttacagcaagaaaaaagaaaagcagaaatgatttaccaactgaataagtgtaggtaattttactgtatgtgcattcttaaatgtttaatacaacaatggaccacctctttgcatggagttaaagattcctttttacataatgtgtcccaataaacaaagaagcaaaatattgaaagaaataaagagagagagagagggagagagggagagagagaaggaggaggaggaggaggaggaggaggaggaggaggaggagggaaagaaagaaagagagagagagagaaagagagaaagaagagaaaagaaaagaaaagaaagaaagaaagacctaattgtcacccttcacgctcatatttctcttctgtgccttaagctctagttcacttaaaaagtagctcttcatggagaatagatatacaagatataataaaaaaaaatacttgacctctaggggctacataacacttatgagatgggtatagagaaaactgtattataagcattaaggtgaaaaagattaaaagtatattctgactggtccccaaaacaattctcaactaggtttttttctcaggtgcatgtaactatttttccacagtacagtagatccataccacaagaagatagtcatgagtcatcattcaatataataataacaataactgcatatttcttattctgcagcaaaatcattgacataaatattctataatccaaatctctttgtaaatatatggtattggtactgaaagataaaatgcttaaaacactggtgtaaattaaaaacatgtcttgatttccttctcaagtgttgttaaacactataggtttacattcatattacgtgtagttctctatgccaatggtctccaagatgggtgagtgtgcactcctatgtacaaaaagacctactgggttaaaaaaacaaaatgttaaaagttctattcattgttttattttaaaaataagaagaaatgaaactaagctttgctaataggtaacatgtagactgacactgcccttacttagtgggtattctccagtcctgttacatggacaggatggaggaatcatgaaggaaaaactgaagctgcaacagaagaggatgacagtgaagctctgtgatacggtttgggtgtgtacctacccaaatctcatcttgaattgtaactcccataattcccacgtgttgtgggagggacctggtgggacctaacagaatcatggcgtgggtctttcctgtgctgttctcatgatggtgaataagtctcaagagatctgatggttttctaaaggggagttcccttgcacactcgctttgcctgccaccaagaaagacgtgactttgctcctcctttgccttccaccatgattgtgaggtctctccagccatgtggaactgtgaatcaattaaacctctttcctttataaattacccagtcttgaatatgtctttattagcagcgtgagaacagacaaatacactctgccttactctcacttgtaacgtttgccctcagcatatcacaacttgctgcagtttccatggatgggcctgcttaaggagttgatagatttatgatccagttttaattaaacttaacctcacaaaaagcataaaattggctttaaaaaaggttcttcagaactattgaggaaaacatgaatttttcctcaaaaacagcacaagaatggctaagctggttctcctaatagtgcaagttcttcatggacattatgcagtagacactgtgatgatccaatccaatcagacaagaagttgacagaaattcaaaaatatatggatttatgtccaatatcattaatgataaaccttgattcagcaaggttttgtgcttgaaatattatctaataatagcaatgcatttatgtaatttataaacaaatacagtatttgttctcaacaatggggtatgcaatttaaactttggagatcaagtgggacacttgccaaatgctttagactaagtaaaacattttactaatgtcacataataaaatgtattttttctacattccctaaactaatggcatataccaatatgtgcttagattagtcaattctgttatagtgaagaatataattcaaattcagtgagccaaattttacactaatttgaacattgaaaatttgaaattatacattaatatactttatgaagaaaattttagataattccctccacaaaaaataaaatcaagaatcttataatttcaaggctggaaaactgaagttgccactatagttagataaatgtgctcttattagtttccaatgtgctatatttgtgtttacagacaaaggatttctctgagtaattgtggtgactattgggctattttgatactaacagctattgaagtcaaaattaacttttacaactgtaacaatgtcaaccaaaattcatcaagtaatgattctaattatggttctgaaatattgtgcctgacaataacatcatcatgaaatgctttaagaaagcaaaatgataccatgacacattgtattgttactttaggccacaccttttgaaatattaaagttagtgtggagaaaataaaatgtggcattaaggtaaggtatagtataaggattatatatttggatattttgaaaatgtgttattttcatttatcctctgatacatttcatatattattttattatttaattttaaatttatctccatgtttttattccaccaattaaggaacaattagaatatttaatatgaggccttcaaaaatattttccttaaatgaaatatggcttccctggaattctcaaatgtctacaatacattcacatatgattttaaagcagaattaccaattgtatttgacttgattggaattaaaatttgttagcacctgctaggtattcatcagttgcacagtgggaacttgtagcctagtgaatctagacaaatatttaaaagttggtaatggataattcagcagttaaaattatatatggacatttttgcctgacaattcatgtttcaataattttttttcaaatatgtcccagaattaccaccctcaaggaagcaagtattatttacaattctgtcccaaatttctaaacatatgtctgtttattaagtcaaaagtgatggcaaaacagcaatttaccaattcctaaattaagttgccgattatagattactcttaaagttagtaattaaaacaaggtgatttgaatttttttgaatattgttgcttgctggacaaataacaatatttctgaatttctgacatgttgtacatatcacaaaaaggaataaggctgttgggtttttttttggtagtaatttctggtaggaaataaaggggttgatattagcaaacatttttccttgttaatacaatgtgtttgagatttcaaatacgtttccactttttttttctgacataaatctgtaaacacacaaggtaacaattcattcaaacttgagataaatgtagtcaatatcttttctggaaaatgtattttcaagaaatagattatttttgtatgtgactacaggtagtctcaaataacacatttcaatgtacctatattgcaaacataatgtgtacaacatagaatatctcctatctttttcagtgccacattgtgatatttaaagtcaaaggaactgccattaaaccctgcctaaacattttattttgttaagttattcaggaatagtctttgaaattagaaatatcacctcacctcccgccactgacacaaacactgagtttatttatattcaagatttaattctctattttgaataatttaaatttaaaagatatttaaaccaaagaaaataaatttgaatcctttcaacacaggggtcgtatctgtctttttaaattattacattccaaatgactataacagtgcttggccggtagttggcatgctgtaactatttgtggactaaataaacacattattcttacaaacaaatctgatagctacatgatcctggacaactccacttcttctggtccactcatctttaaagttataaaacagttaaaatcattcaatggaatagttgatgtttataatagagactcatacaggcaaaagcactaacagctattgaagtcaaaattaacttttgactaacataagttctatgttagtttgagacatgaaaaccctaattaaagaacatggagtagataacattattcttattatgttgttttgaatatatgtttttaatgacttgcctctactgatatttcctttttgactttcactatttatcttctcctagaaattgtagatgtatccttaaatcaacttttaaaaagtcagctttcatattgggtgaagacaaataatgttccaaaaaagccagtctaaataagaagatgcgtcctagagctttgcttttttagctgtcggtactagcaggccaacactcaggctggtgcacatgtgcgtgcgtgtgcacacacacacacacacacacagcatcaaaccaggatagttttgcataatggctctagaagtcattgtataccacagactgagaaagattggtattttaaaagtcctcttgccttatataactttgaagagaaaaatttaaaagatagctattcttctaaacaagtgattggatggcagcaaaggagattttaaaaatgtttttctagacatccttaagctagttttatgtttatcttagtttcgttctgtgttcccttttaatgatatgtgaagtcttaactagcaaaaaaatattttaatgagctttcattgttttaactaccaagaaaaggctatttgctctgtataaatatcataaatgatcatgtctactccataattagtgtatatcactagtacttgataaatgtattacaagtaaaaatctaagcaggtttgacaatatttataagaaaacgtgactttcttaataatatttacagatgatgccttcatacacaaagaaaatgagtttcagaggggtcaaatgaattgccaacttttcacagagagcaagagaggttgaagtggattttgaactagtttattattaatgctgatgttttgtttattctatctacactgcctcacacatagtgacagacttcgtcaaataaaatccctgaaaatacacatccctggctatttcaagttctatgttagtgtgagaaatgaaaacactaatttttttgacttactagatgaatgaacacatacgtaaagtaatatttattaatcattaatcacaatagttattttatctaaatatcatactaagggcaaaaacatttttaaaagtaagttgatttttccaaaaggtggttgaaaagtgtgatcccttattaacaccttcacattttatttggataatagcactagatatttttcacttatcttcataaccatgtagatatagtgttgtgctcatttaaaataatgataaatgaataaactaattttcagaatgataaagcaatttgtcaaatatctcaactctgataaatatctgacccatgtctcttgatcaaaagctttatttctctcagttgaatttttgattgctaacctagtggtctgagaacctctgaaattgtatgtataactctgtgtggactgtcgagggagaagcttcataactttctacaacatctcaacagacttgacaattcaaaattcttaagaaccacagatgacacttttataaacattatatataatagatttacatattttcaactgttgtttgtttagtttggctgcattcacaataatggatgatacatgactatagtatttcttcaatattccagagtgacactgaattttaaatacaatctattgaaatctaacgactacattaagcaccatttaactgtggatattcaatgcctgagattactcagtgatggataacccacacatcttttatagactaatttattcttagtgtcctccagcaaagccatcaggcattcttgggacagctgaagggcactgcactgagagaaagaaggggtggcattccatggaagtcatgatggtgttcttcaccaattcttgtagcattgggaggcactctgctctgaattgaaggaagcatggtcagtattgtcctcaaagagagtgggctctgtttttgttttcagtccattccctctttatgagtaacaggtggaaggtttccccaaagctcctgcagcatgccagctcccgactaacagctggcatgaatactgagcaattgtcctcaaatataccaataccctagacaaatcaaatcagaaaccacgctccatcactatccccaccaccaagaaaagtgccacatcagaattggtaaaagctgttccctgggttatttaagtaggtagccaaggttaagaacttctttgttcagtaaagccatcctaggcaggcaaaatctcatgagacgatattaacacctatagaggactggctgagtattattcccagataggaatgttaaaagtctttgtttcttcattgctgtttttggtaccagcagccagctaacacagttagcagtggcttcagacctctcaggggatctacaaatctctcactagctcaccagattgccttgatcacaggttgctgggcttgtgtggaccatgattacaaatttaagaaacatgtatttttagccctttgtgaatgggaacctcaatctgactttagtacatccaacttttgtaatggttttagaaacaattttctgggaaaaaaagaagactctgtattttatgtttggctatttgtttaaaagttgaatgttgtgcaaaacgtactcatctattacaacttgttcaatcttatctactttttgtcagagtgacataagcctctcctcctacaaggtacaatagctatgctaatttgctagcccttttgttgtctggttatcaaaagccatgagtgacacttaggatttgagagcatgcaaattatttcttaatctttatgtattccctgaattgtcaattacacttaagaaacgaaaagaaagagaaagcactatttccaacaaataagcataactgacaatttttttcaactacaatactgttaattgttgtttttttttttcatttatagtgaatatcattcatgttgtccactctaggaaaaaaaaatcatccctagggcatttccctctagcaattctagttttagccatatcactcactgtaacagatgagattaatgcagcttttcaaccatctttaggaagaatattcagatgctttagcagctgcccagcttcttaagaactcactaatcctttaatctccagacactttttttcataaaagattcacaagcaaaacaaatgcaatatggatcaaaaaatttaatcagaatgcttaaaatgcaattacattcatcagggtgttctgttaggctgggtattaaatctgggctttattcaatatcctccttttattataaagcaatatttttccactctgtaaaccatctgatccctaggctaatgtcctctcagcttaaatattaaaaagagagcgctatgaaaaatgagctggagaaatattcctcttatttcagtggaaaaagttcaaaccagtctcttcctgaaatcttgttttataaatgaccagataatttgaccacctggaattctaaagttacactttcaaacagtggctgcaggatcattatcctactttaaatgtcaaatgtatatcctcctacacacctcctcaattgagtaaaaaatgtcaacaatttgaacttgaaaataatagtctatttttccctaattcggcatttgcaaagtctgaaggcaatgctgatttcttcatgcaagcacagaaccctgaaaagtttaaaaaaatccatcttagttatatttctccagttccctatttcacatctaatagcattcaactgtaacaatagctttgaaataaagagctgtccagcacagcatgatttgaaacagttgagtgcttcttttaagtctataccctagctataacatggtggttggagttttgtaagacatatggaagttaagtgaagcagtggaggaagttcaaggatttcctctgacaaatgccatcctcagagtaagagaaacttggtccataaatgcagacacactaacatcttgagctgtgcttaacatttaatggattctttgtaaaattagtaagtggcccaattatgcagggagtcagttttccctgtttcctcctaaaatgagtttgtgcaaataaaaaataattaaatttcacttttcaattccaatgtttccacattagatgaaaacagaaacaattgagcagtgaattatcatagtcctatattcagtcaacaagcggttacaataaccaacaagtagttactacaataatgttaaaatctatcatacataattaattcatttgccactcattatgctgccaactgagcccacatgaagttacaataaggatttgcaagaagatttaaggtttcaaatggcccaatgcacaactgactgtaagttatctataaaggctagacaatggccacaggcaaagatactatacagcaagcttgtccaacctgcagtccacaggccacatgtggcccagaacagctttgaatgtggcccaaaacaaatttgtaaactttcttaaaacattatgatttttttttgcaatttttttggctcgtcagctatggttagtgttagtgtattttatgtatggcccaagataattcttctaatgtggccctgggaagccaaaagattgtacacccggctacagccatcacttctattaccagtagtgcaattattgaggctttcctttgtgccaggtttaatatgcactaactgattaaattttcataatagcgtgatgccattgtgtgtattatacaatttctcatctaggccgtttttgtctaactttgatatatgtggttatagtaattactcttgttgcagataagaaaactaagaagtagaaaagttatataccttgagcaaggccatactaaaagtaagagagacagagcggggcttcaaacccaggccgtctggcttaagaccccatgttcctaattctccagactaattctgccttccaaattcattctgtatcctctatttaatttcctatctaggcctgtttgtcccaagttattttgaagcatacagtttaaaatattatctacctgatattggctcaacaagtagaatatttagaaacacagcccctagctaaagtgggtccatttctgggtataaagtttgtaccaccttgtgtcatctgtgggataggccacatccagacacagcatagcctgtatgacacagaaagaaataaaaacaaaacaaaacaaaaaacttgcaagtaatatggtgtgataagacttctttatatggaaattgcaattgaacctggaatcatggcctgtcttctagtctagcctaatggagtaaaatgacacaagtccattgctttctgggcttgtatgtttctcaggtctctcaaggctgcactgaccacctgacttagggactgcctctttaggaattgggaagcaatatctattaatgtgtatcctcatgtataattgttctgtttatggataaactgaagggagaacaatcttgaacctattcaaagatgtcagtcttataatactacaaaaccatattggtctttgtggccaatcctgccacaaaaagtactatgcagggaagaatccaatagactagagattaggcacctggaagtcacccaacacagtatagcatattcttggacctctttctagagatttcaaatatgaggggtggtggagtgtaatgcatgaataacaaatagaatatatcaaaataaaacagtagtttatcagctggtatgcaactagcagatgctcagctgagcttgacatttgtcactccttattcttcatggtacataaatttatttccaaagtgattggtatgtcattgagcaaactacatacaaaatgactttctcagcaggtaatggttcaaattttatgcaaaacctaatgattttcacattcaactattttttaaatccctgctaattcttagactgtggaaaactatgaatggtgtgtatgtaaccaataaaccaataagtacagtgtttttttcctatgcagaaatatggaagacatattttcctgatagatatcaacatgaaaaagtattatgactagatagttctgctttataaatagtatgcatatattatttatcacccaatctgagatgattttgatagtggaaatatacattaataactaatactagaaaaacagatgggagtattctaagaaagcttgtgcatggttaccatatttataaagtactacagattaatttgtacttttattgtatatgatttgaagtttgaaatataattcctacttctatattacaattaattaaagcaatttcaatgaaacagtagtacccaattattatagtaataacacataattattttttctgtgcaatgtttaattattaaagttgatatctatcttgagcaagattcctttaaaataggtatatggtgctaactcttagatttccaactatgcccagatcctttatagacatatttaaatgtacttcttactattgtttgaagatgtagagaagcctactcattatttttctttcttttaaggcaatatttggtttttctttttactattaatgtgaaaaattactaacatctcatttataaagataaaaccatacatagccactgaatggcatttttattaagatcatctttctatattggcattccaaagagtagaaccaaaagtatatcttactgcccagcaaaatgcaaatgaggtggagaatagcacattttatgcacaaatagcatgtttggttttaataatgactataggataaaaccacaaattattcaaataagggtttctccatgaatctcagcttttaatctcttgctaggctgtttaaaaatatatacagaattgaccaaactgttttcaagacgctgcctgcaattatcacactgatgctttttaacatttctatcttccatccaaccttctatgcttccatcgctgtttgcatagaaccatatatttattcactgaaagttaccagttcttaattacattttgtttccatttaagctatggtagtaagcagtgtattgtaatattagcaataatccagtgagaattccccaaaatgcaatgctttgtctgggttggtgcttaaattgtattatatgttgagtttagtctttgagttcttccactttaagttactgttctcttattctctaagaagcagtatatatgccttttattcatatacatattcatatacatattcaacatatatgtagtgtatatatatgttgaataatttttcaacttgtgttgaatatatatatgtatacatatatagggtttactctctcaaacaacatacagtcaagcagagaacaaaggtaattagatatgatctcagatatttagaagtatattaaacaacagggtacagctttctacaggcattcagaagccagaacagatgcctagttgggataactagagaagatattgataagttaacaattgacagagatggtggaaatattcatttcagctgggggagctgtcatgtatgattagaaggagcaaggtgtttggagaacagtattaattcatatggctggtaggtatttgacatgtagggtcagagtggcagatgaggctgttaggggccagatcatggcttagtcatcaagaattcaatattatctacagacaggtaagacagcactatctaaaattatttttctttttattagaactgaaagataatctaaaactaagtaataatatcaattatattaagacactgaagagtttagattctgatgtgtacacaattatatgtatcaggtttaaggcagcacatttggaccttgcaatttgactcaaagttgttttgactctgctctgcctgatagtcaatacaactgataatctgcagctgatcttaaattgtctcagatactcatattgaaaataaattattacctttagaactaaccagcctgcaataaaactaacaacagataaagtagtatacaacactttttgttttgaataaaaattgaaaatgatgtacaaaatttgactgaacaaaatggaactccatagaagaaactgcaaaagaaaattcacaagtgaaataacccattacgtaatatgaactaatgattcagttcatggtgttaaggtctgcaagaaatataatttatttaatgaaaataaattcaaaagaaaaaatcaaaatggaaaaattatatgtcaaaaataggtcaagaaattaaattggcttaatccaattcaatccagaaaataattttaaaatataactaggtcaaaatatcagaagcaaagcatctctgggtcaaaatgttgtggcccaattatctttaatacactagagtttccctcttcgctaaactaaaagcgctggcttcttgctcatgtttagataatggggatgtagcacaagttctaaaatatggtaacaaacatatgtaagttgaagagcatatttgctgtaaaacataaccttgtgcatcatcaaaaaataatcattgttataaggatcacgtggtatattttgggataatatttatatcccataaaatagcccttgccttcaaaaggtgtttgatcctattgtgataagagaatagtgaaaaagcaaataagagatatatgcattgaattcttagaatacagaaatttcaagacaaatttcttgagaagagtttctcaagaatttttttaatcaaaagctaaagagatatgagcaaaggctaaatattctacattttactttattaaacagtctgaatatctaccttgatgagtgcttttattaagcccaataagacctttactgatattttcttctatagagacatcttgtgaaatagtcacagaaaacaataaaaatattaacaagcttcaacatgaatttatatcactattgtcattatctgtaactttcattcagtttacagttcttctactctagtccaggctcttatcattctatgtcagtctcttttgggctttgaatgcttccaatatcttcaaattttaattcatttattacttgcagattaatcatccaaaaacactattttccatacattgccccatgttgaagccatggaaaagctctctgacttcagtaaaattaaaaatgaggaaaacatttaaatctttttaaaaaaatgacttggggccagtattagtacattttaatatagaaaaagatgattgatagtatgctgaatcggcactgacactggccttaagctagaaaacactaccctatataaaatcttggacatcattttatttgggagaagggtttggtaagtattattttagtctactgcagtaaagtaggtccttatgcagtatcatcaattggttcttggaaactgtgacttttaagtgaaatgacatacagcaggtcctcaaattacattgttttgttcaacatcattcccctataatgttgatgagaacaaaaactacactaagtgaggacttactgtacatggtacaatggccaactttttttttttttttgccgttgccatcactaagctgtctatccactcttcaatagatacacaaaacttttttttttcctaatggcctacatttatttagtttgtctaaatatgtgggaaaagaagatgtttcatgtttgtcctttgggctcctactacttgctgcaaaagattcagcttttctcagctcaatactacctaaacaagaagtgagttgcaagatcctttctctggagctattactggcagctagaatttacaggtatgctctattagaaaataaataatagatatcatcacctctggcatactatcttaacttcctaaatttttcatgtgactgttgttggtctaatagtcttgtcatcacagcctactactggatctagttctgtcgatttgtgcttcccttttgctgtcatccctttctgtgcttggggaaacacaggtcttgcttctgaagggggcataaagaataatattaagtagaacagtctctgagatttcacagagcttcccaatgcttatatggttttaggctggaaatagagatcagattcttgcataattgtgtgaaagagactgaatcatcaacagatcttgctctttttttttcttcacttacctatagtacatcaatgagtgaataggtccagagtgagcagtctatgttgcctttcttttaactgggaatccattctctatgcattttaggtcaaaacgtttattccaaggtgacaacttcagtcatatggttctgaaaacctctttggtctacttgtatgacttgcattaaaaattattactcccatggctgttcaaactctgttgataacctctggcagattcagaccattactctgttaggcacactaattagttcttgatgacccagtcctggagatcattagcctctttcctttcaaaaagaactacacactcttgagtgatatggaggcagtggtctgaggtactgcctttatacaaaattagttattgactgctaagcagaaacaagcattcccaaatgattcctcttaccttattccaaagcatacacaacaaaaactcccctgcaattatcagaaatatatgtgtttttttctatttaggactttacactattgtgattatgatagacaataatccaattagttacattttaccacaatttgtcaacatgtacaaaggaggacaacaatgactcaataaaaagcaatacattagttataatgacttaaaaaggagtcatcaccagatgccactgtgagattggttatgtgtgttcagaaaaggggctttaattctttattcaaacaacagatattttctcattcttaacaatatgaaccttttaacccatttggaccatttgaacatttacctccaaggaaaacagtagatcttatccacccaaaggaacaatgttacggtgtttgaattttctcaaattgttgcttgagaatataaattgtgtaacaacagtaaaaattagacctagacctatattttatgaaattacaaatctcttttcagaaaatatagagatgattattaggatagttttatcatctacaaaatcaaggagtccatagttagaaggcctcattatttgagcaggaaaaataaactttgtgttaattctcatattatcatatgtgtagtttggatatttaattgttaaatattatattgaagtgtgccatacatggaaaaatgatgaaatcagaaatatgttcatcaattttcacatttttttaaaaagggcaaaacactcgtgtagtcaccaccctgttcaagatataaaacacagtcagtgctgagttccttttgtgtcccttcacaattgctacatcctcacctttcaacaggcaatgccatcatgacttcttgaagcacatattagttttacctaattgtaaataaactatataaatgaaatgacagagttggtatgctttcatctctattctctttcactcaacattatctttgtaagattcaacccgtgttgtacaaaagacagtattccatccactttcacgactgtatagtattctatgtgtgcctataacaaaattaatcatctcagcctactactgattgaaatttaggttgttagcaccaataatgctaccatgaatattcttaagcttgtcctttgaagtgtgtgtgtgtgcatttgtatatgtgtgtgtatgtgtatatgtgtaaatttcttttgaatataaacataaaagtgaattctaagtttctagatcacatggtaggcatattatacctttagccgctattgctacgcagtttcccaaagtggatgtaccaatttaaactcccacctatagtgtatatgagttcccattcctccatgtactcaacaacattcgttactttaagccagtctggtgggcacatgagggtactacactcttactttaatttgcttttttttctgattagtaattatgttgggaagcttttcatgtatacagtgggtctttggatatcttctgttggagagtgctccttcaagattttgcacattttttattgagttacctgtctttgccttaaggaattgtagaattcctttttatattttggatataagtctttgccagttataaacatttgaaaagtctcccactaaatgacttttcttgtcactcttaaaattatgccctttgatgaatgaagttctaattttagtataagatttatcaatcttttgcttcataattagtggattggtatgtatacatgtgtatgtgtgtcctcaaggtaataaaaatattctcgttttcctctaaaagttttttacctttaacatttacatccacaatctaccagtaattgatttttgtctatggtgtgagatttgaatcaagacaatttctacatagatatctcattattccaacaacatttattaaaaacactggccttcatccacttttctcctccaataccaattctttcataaagactccctctatgtgagaattatattactttgtctatttctctgcccttttaccaataataggcatactgtgtactgtagctttatgatgagtcttaatatccagtagttttagtcccccaaatttgatctttttcttcaagaatattctgtttgtccttgggcctttgcaatctttaagtttattttcctagccagggaaattgggaaaggaaaagaaataaagggtgtaaagattaaaaaggaagaagtgaaactattataatttgcagataagatacttatgtatgtagaaaaataaaaaagattctacagatgaatgattaaaattaataggtgaatttagaaaatctcaggatacaaagtcagaatgaaaaactacttcatgggtacaacgtaccttatttgggtgacgggtacactaaaagctaagaattaaccactacacagtgtacccatgtaacaaaattgcatttatacttcttaaatattataccacaaattgcctacctaagaacaatataatgaaaaatatttcagttttaaccttggtttaaaaattactatggaaacataattcccaatgactggaagtctggtgtcagtctaggaagtcctcataggttacttaatcctcagataatgccctttctgatttcaattaggcaattacagcccagagctgtgaagtctggggaatgttcttcattaagtcacttttctcagccctagctagtcttgtaatttctatttatttatttatttatttatttatttatttatctgagatggagtctcgctctgtcgcccaggctggagtgcagtggcacaatctcggctcactgcaagctctgcctcccgggttcacgccattctcctgcctcagcctcccgagtagctgggactacaggcacccgccaccacgcccggctaattttttttttattttcagtagagacggggtttcaccgtgttagccaggatggtctcgatctcctggcctcgtgatccgcccgcctcggccttccaaagtgcagggattacaggcgtgagccactgcgcccagcctagtcttgtaatttctttctagtctggaggaaagaaagcagacttctggagacagtaaggctatatttccatggcttatctcatttcttccagaatatttaaatttgatacaactattattaatatagctgtttcaatgtttatgaacatatgaaactagattttcaacaatatgatagaaaacaaagtagaagaaataatgtaggagtacttttggtgttgtacaatcaacagatttagatctttagtaaatctcagatttactatctcgaatttagaactttagacaaaattatttaaaaagttattatatgtaatataattgtatgttataatatttcagctttcaggttgttaaaatgtatatcttgaaaatattctggcatatggttgtcaggtaacattgctaggaagtcctacattttattctgagtttttgttcctctgactctgtgtatatctctgtgtgtgtttgtgtgtgtgtgtgtgtttgtgtgtcttaggtattgtttctttaataaaagaataacgatagtttttgcaactgatattttaaatgtccttcctttgcaaaatagttggcagtcacacttaaattcctccaattaaaagaaaaaatttctagttcataaaatctgttaagtccaataagtgttgctataagaaacccttttaacctatgtatatatcctgaaattctgctcctaaaagtcccttcaccctaaaaaatcctcacagcaaactggaagagcaactgaactataatacattttaaacggcattgcctcttgctcaaataacttgaaaattacttttttttttgtctcctccagcttttcttcagcatggtttctgaattttaatcaaaacataaaaatacaaaagaataaaaggaataacagaaaatctaatttggaataaaaacaaatgacaattggataagcctcagcatattctgggaaatgttaaaagcatcctttcaaataaattatttgccaaatttgaatacaatttacctacctgaaactgtttcattcaggtaaagtctattacaaaggtatacatgagattataggttaatgttttacacattacgacaagtagctcaagaggcaagatgattgtttgagaaaaggtaatttgaaagtactgaattctccgctattgggaaatgcatgtatttattatagtaagagtgaagcacacgggtaaggatctcacaacaataaatcctctgtcatctgtatgaggaaaatggtgagtacctccaggatctgagaagttattattaatagatggcacgatgaatgtaagcgtgcttctaattctgtaatttgaaagcatgcatatgtttctcgatgtaacacacacatttatttactcatagacaaagctgcagttatgttcacacacataacgtcttagggaaataagactgaaggaggtgagaagaaagagagtgtggaagaggtgaagaaagagatggagacaaggagacagagtgcacagtgatactgagaccaagagatggaggtttcaaaaggcctgcataaagatgacttggctgatgcacatagtgagaaaaagcaatgagctgattggaagactgcacagtacccttacagtcccgtagacagttccataaccaaagttaattgctttgatcctccaatgtttttgacatataaaagtatattcagtaaattaacttccctaaatctgaaatttaaagcttatgaaaagtcaaaacaaatgtttgaagactaatcaaaataaagtcctcagcatggtttgatttagaccattttgtactagcttaccaaaattctctattgagttaaataaggaatgtaactaactaaaactgggaacagagttaataaaatcatggctcacaaaaagccattttttttttattttggccagcaataaaatccttggctagcgtttctctgttagctataacaaaaacctagttgtaaataagaaataaaattttgagacagatgttagctgtaacatagaaatatactttccattaacaatctggcatgttgtatggtggttctactccaaaaggcaatgtatcttttaattatttattcattttttttgagatggagtcttgctctgtcgcctgggctggagtgcagtggtgcgatctccgctcactgcaacttccaactccccgttcaagcgattctcctgccttagcctcccgagtagctgggattacaggcatgcaccaccacaccaggctaatttttgtatttttaatagagacagggtttcaccatgttggccagactggtcttgaactcctgacctcaggtgattcacctgcctcagcctcacaaagtgctgggattacaggcatgagccactgtgcttggccggcaatgtatcttttaatgtaacttgataatattgtcctctgcctctgcagccttcccagacatattactaaaattaattcaattttagcaatcaaaactgtaaatgaacttagttattcagcaatcaatgaaatctaaatgaagagtcactgttatccaattcctcatgcattcccttaaaatctctttctctagaaaaagtctttagataaaggcagttcacaaatatatggcaaccctaacttataacttgattatcatgttatcacatccctatctggttcacataaattatctaacctttgtcaaattagaaaaatatttggattcacattttttaggctgaatttcatgaatactgtaatatacctattttgtattttataagcttagatagtaaaatcattcaggtaaatgactattctttaaaagatgtgttatgtttaataaagtttaatattaaaattcctaaaagttaattttaagttcactccagagttatggagctatgtcttcctctgtaagaaataatacaaaatgaatcctgactttgtagtgaaacaattccctcgttttattgtagaaatattttgggggtggtgactctgtgattgctttggaattaaagcaatctgctcattatctcatattggatatgaaagctgaaggcaagaataatgcaaagcacacatataattagtaggttatatacccagaagtaatcagttctgtaagacacacttcttcaatgtccaataagcagaaatgattagcagcaatgaaaaagaaatgtaaatgttttccattaacttcttttcctatttctggtagaaaaaccacaaataagtgattcattacaaacgtattggcaatggtaaaacaaagaaaaattgttaatgcaatcattaaatttatcttacaagtttctgtaattgtttaaaaacataaatggtggttattatacgccaaaacatctcttgtcattcattttaaatatttgtcaaaatcaatttaattctggaagtctatgtgagaaaagtcacaagccaactgctattgtaagtcgcaaacttcttagaagagctctttcattactaagtaaagtataccatgattgtatgatactggacatagagaaacaagatttgcctttcactctttgtaatttgacttgtttgtgcttttaagttactccaattattttctaactttcaacattattctgattaagtcctagctacagagtcttcaaaagacttttataagcctaactcttaaattgctgctttctttgttttagcaagcaccaaggaactaataaaacaagtttactcatgtcaaattttagattaaaaacagattgctccttttatgtgataacagagttgaagcaggatgaagtcacctcaattatcattgtccctgggttttattgtacactactcatttaagacaaataattacctaggcctcttagcttgcaagtgattcacacattataagtctgtaatgttctgcatttctgctctcttgctagtacaattaaagtttattgacagtaaatatagtaaattttaatttttgccatataaatacttagtgctatgttactgacagaaagatgatttcccaaaccttaggaaatacttatgcaatgttttatttaaatattaaaaataggaatattcactcctacattaacactagcatgttataatactaccatggtgttaggctctataataaccattagagaataatttggcatgaaaataaatcattaattttatttctctgaaataaaaaatacaactcaaaaagaattaggaaaaaacaaagacaatatattacattatatatattttatatatatataaatatataaatatatttaaatatattatataatataatatattatatatttatatatttatatatatataaatataatatatttatatatttatatatatataaatataatatatttatatattataaaatatataaatacattatatatatttatatatatattttatatatatatatatatatatatatatatattaaaaaaaagtagttttttttttttttgagacagagtctcactctgtcacccaggctggagtgcagtggtgtgattatggctcactgcagcctccaccttctgggctcaagcactctacctcagcctgatgagttgctgggaccacaaattcatgccatcagtccaggcgtgtttttttttttgttttttttttgtttttttttttttttttttacttttagcagagaagaggtttggctgtgttgcctaggctagtctcaaactcctgagctcaagtcatccgtcatcctcccacttcagcctctcgaagtgctaggattacagacacgagtcactacacccagcccaaaaacaatattgatggaacccaaacacaatttgaatattgccattaacaatataaagaaaaacctataaatattggctaaagactaacaatgaattgtttttataattttcttcatctctcacaggtgatacatgcacaatatgttcacacacgaagtcttgggttatctttaagaataaaaatactcattaaaaaattacagaaaatgtattactctagaatgggtgggatttgaggcttggaacaacaaggaagctacaactaaacaaacaactcagtggatgaaatgaatgtgtgtgatcagcaaacagcaaggaaatgaaaaaactaaaacagaggatttggaatgctgaccaatggggttataaaatgaaatgctaattttttcactactattaaagccagcaaatgatcttttaaaaaattttaaagcataaatgggtaaagtcatgtgaaataaaggacaatttcttttctttttctatattcagcattttaaattctttaaagttgtatccaagttaatataaaacatatttattcaaaaattttatttaaccttgctgttactaaaatatttaaagacacagataaaaggtagtgccatatctctcttaaaaatctcattcaagattctgattgcatgacatgtagaataatcattagatctagcaagtgtttattttcaagctagaactcaaattttccattttaatttttaacatatttatcggctaaagggataaaaacaataacaagtttacaataattgtatgatgataaaatcacagctaatagtttgttaaagccaaattaatgctataacatctgtttcttatcagcagaaaataagagtttttacactatatttttaattcagtagagaatatatgctttgttctcaatttttttcaagcattgtcttagatgagaaaaggcaattttccagagattcctgttcaaacataacttctacagaatatgttcataagtcaaaactcactagattaattcatggagacaacactgcataattgaaactcttgtcattgcaatcactgattaaaactattttcttggctatatttttgtgaaataaaaaaggaacttttagaataggtgaagaagacttctaaatatatagtaaagatactttgctcaaagaatttaaaatggaatgaactgcataaaactgatatatcagatcattattttacttagaaaaaagggaatttaatatggttctatctaaaaataaagtgtgagtaagataataccataaaaggaattgtgctgaagaaaaatagtgagaggtgaagccagttggacttcctgggtcgagtggggacttcgagaacttttctgtctagctataggatcgtaaatgcaccaatcagcgctctgtgtctaactaaaggattgtaaatgcaccaatcagcactctttaaaaatgcaccaatcagcactctgcgtctagctaaaggattgtaaatgcaccattcagcactctgtctagctaaaggattgtaaatgcaccaatcatcactctgtaaaaacgcaccaatcagcactctgtgtctagctaaaggattgtaaatgcacaaatcagcactctgtaaaaacaccccaatcagcactctgtgtctagctaaaggattgtaaacacaccaatcagcactctgcaaaaacgcaccaatcagtgctctgtgtctagctaaaggtttgtaaatgcaccaatcagcaatctgtaaaacgaaccaatcagctctctgtaaaatggaccaatcagcactctgtaaaatggaccaatcagcaggacatgagcagggacaaataagggaataaaagctggccaccccagccagaagcagcaacccactcaggtccccttccatgctgtggaagctttgttcttctgctcttcacaataaatcttgctattgctcactttttgtgtccgcactacctttatgagctgtaacacttaccacaggggtctgcggcttcattcctgaagtcagcgaaactaagaacccactgggaggaacaaactactccagacgtgccacctttaagagctgtaacactcactgtgaggatctgcagcttcactcctgaagtcagtgagaccaggaacccaccagaaggaagaaactccagacacatctgaacatctgaagtaacaaactccagacacaccatctttaagagctgtaacgctcactgtgaaggtccgtggcttcattcttgaagtcagcaagaccaagaacccaccggaaggaaaaaattccagacacagtgggatatgacatcctaactcaatatatgaacctataggggtctaacattcataggtttctgtgtattcagtggaaaaattgagaggattcatcattcaattatcttttctttcctcctttttcttgaccctctgcttcatagagagggcttggaggtaggatccagagtgagcctctgttagaagcattgagagagaagccagaaggtccagtcctgctggcagtagcaaggggccaagaccactaggcctgcctgtgttctcacaagccccactaccatctctagattttctcatcacccagtcttgaaaaatctgtgcctgccccttcagtagctttgccatttcttgattcctttcctctgtgggtgttctggcactggccctttttcccacctctccttcttttctgggatgctgctgctgttgctatctcctctatccttccatccttggcatctggcccttaatcctcagactgggtgggagcccatcccttgtcttttgggatttgcaaactcctaccctgaacccacatgaaagtgactgctttcctgcttctggggatctctttggcacttcccaggaactcctccacctggagcagtaactccaggctgcttcaggctgcatgcttgcacaaaagctggtggttcaggtcaagaaagtctgtaaactgccccagcaaaatgataccagggtctgaaaagctcaagatgctgaccttggcagaaaattgggatattattatttcgaacataaaatagcaatcctaaatgcttgatatttacgtaccaagagacttagaaataatcatacatacagtgaatccttttgaatctctgccattatgtaaagtgataaagattgattagaactggccaggtgtggtggctcacgcttgtaataccagcactttgggagttccaggcgggcagatcacttgaggtcaggagttcaagaccagcctgggcaacatggtaaaaccccgtcgctactaaaaatacaaaaattagctgagtgtggtggcaccctgtctctactaaaaatacaaaaattagctgagcgtggtggtgggtgcctgtaatcccatctacttgggagggtgaggcaggagaatcacttgaatcttggaagcagaggttgcattgagccaagattgagtcactgtactcctgcctgtcctggagagtgaaactctgtctaaaaaataaaaaataaataaataaaagattgactataatttcctagaagtggtccttcataaaaggggcttaaaattccttttttgggtgcttccttgcagacatctactaaaaagtctctagatcttccaatattttcacaaataaacttcattaaagtatatatctatacctatatatatctatatctataaagtatatatctatatgtatatatagatatatcataaagatttatctgttattgcttaggagattggaaaaaacctgtcctgaccataatattaaatagctctggaaaacgcataccatatttggttctttttaacttatctttggattggcatctctttaattacctcccaacttatttcttggagcagctaggcctaaatggatgtagtctatttaaaatagtcatgtgatattctgtgatattcctctgtttaggtaaaataagttgataattatatcttttatttttatttttttcttgagacggagtttcactcttgtttcccaggctggagtgcaatggcgtgaccttggctcactgcaacttctgcctcccaggttcaagtgattctctcgcctcagcctcccaagtagctgggattttctgtctacttgaatgtctgttgggaataactaactgttccatctccccaaacatactttttaatcagtttttcccatattaattaatagcaagatcagccatccatttgctcagaccaaagagtaagaagtcattcctatttctaacccaatataaccacaagtcgtgccagttctatctccaaaatagattatgaaatagacacattatttccagtaccattcatattatactacttaagaagaaaatgagagactcttaattctttaaagtgtaaaataaattaaacacacccctttgaagccctaaaattatatccttttgtaattagaattaaatatacacttatactgtgaccgataaaaactatcaggagaatatacacttatactgtgacctataaaaactatcaggagaacgagaccatcctggctaacacagtgaaaccctgtgtctactaaaaatacaaaaaattaacctggtgtggtggcaggtgcctgtagtcccagctactcgggaggctggggcaggagaatcgcctgtacccgggaggcggggcttgcagtgagccaagatcacgcccctgcagtccagcctgggcaacagagcgaggctccatctcaaaattaaaataaactaaaataaaacctatcttatgatcttgtctctgggttccactctgaacttatgtcctatcactctttctttgatttttattctttggatgttttcctattttgtaattatgactagttattcctgcctaagaatacctagaccatgcctgccttaaatgttttatagaatctagtatcaaaaatctaagctctacaatactatattattgtacaagtttatgcatgggccttcaaatgaattgtcagcaaggagaaatcgaagctaagtttcttgataatgcaacaattgctctactcagaatctgaaacacatagactgtgcattcctattgtcttataatcaagtacaattatataaatgaagattttaataaacattaaaaaacttaaccagtaaaacagcattagttgattctgtgactaacattaatcccactgtttataaaaagtattatctaagcttgtcttcctataaaaatcctcaattgtttttcaataaaggtgaatataaattttaaaatacgccaatagagctatgattacaaatacattgacctaaaattatctatgatttttattttgcttttcaagtgaaaaaaataaaaggaacaaacacataaaccaaaaaagggggacctcctctttcagctttagagtgctcccctccctctgtctctgtatgggggagcttcttccttctgtcttctcccttccttcttgccccttcttgcctattaaactctccattccttaaaaccaaaaaaaaaaaaaaaaaaaaaaaaaaagatcgtgttctttccagaactttcagtgtgatatgaggaataaaagtaatctgaactatcaaaaagtatgaaatgtataaaatggcaactaattccatacatttattacgtatttgtttgtttcgctcaatgcagatgaaggataagtcaatgtagttaatattttgtatctgctattcactttactttttcggctttgattcagctgtataaaaacaacagtccaggcagaaaattggcaaatggacctgaaactcacattctctccggtgaaatcatcttataatcatttgcaagaattgaaaatttctgcaaatatatagatctgcacaaagcaaaatttacaagtatgtaaacacacacatcatcccagatttaatgataaaataagaataaaataaatgcagaaaatcaaatagtaattttaaaatgtaagtttacaaacttcagtggcatgaatatcaaaaatggtaacactttacacataattgtaaaaatcacataaaacatgtagatatatgaatgtgtatactcttataaagctcttcatttctttatttctttaagagatggggtcttgctatattgcccatgctggccttgaactcctgggtgatcatcctgcctcaacctcctgagtagctgagactataggtgtgtatctccatgcctggctttgagtattttatttttatcaaatcagctattagactaaatctttgtggaacaacttaaaccgtatgtttattgttatatatgtaacaaatcttcatactagaatcatgtttttacagctgttgcactatgtatgttcaatccatccacagtaattaatctctatgactgaggactttaactgctttcctctgggaatcactagcattctttgctttccttttcaatgaaaagcatcttttacaatcatggcatctgctcaagaatgggataagatccatagtactttttgaagttccagattctactatgatatccaagactatatactgcagtgtttccagtacatagaactgcagttctctctctgattagtgttatctttgcagattttaagtcagatttcttagataggaaaaaacctggtatgtatagaggaaagttaaatatggtatttctacagaatgatgagtcatttctggaatgcaactgaaagttgatctggacaggaagatacacaggatctagagaatgggaggttttaacctcacagaaaatgtgtatttgaagcaataagaattaggaaattaatgaagttctgctatcctttaacaatgcttctctctttaggttttgtgaaatgaaatcattcttgttcccataagttgctattgccaaacatggttttatggctcactgccaggttcttcctatatgtctgataccctgaagtgaaatagaatggctcttataaaccttttaaactagatggcatagtgaagataagccatgtaaagtatgataattgtgaataatacagaattatctttgaaaaccaataaataacattcataagtgatcatttttgtgttattttgtttattctatgtgtcctctagctcaactgttgggttgttctttgatcaaaggaacccttattttattcctttttgcatttcccaagattctgatactctataccctgctgctctatgttgcatactataaaatatattgaaatgacttaataaagacttaaaaatgttatttagtgtcatggttcttgtctttctcactggatctctcaatatttttctgactcaatttttcattgatttctaaaataatgcctcaaattcgttactttcactatgtctaagtcccaattttccttacctctcaataaatctattgcaacagcctcctaaccatgatgcttgtcttgatttttttctaaacctcatttcaatttcataaacatcattatgttgctccctacataaaaatgttttatgacttaacattttctctaagttaaagtctaaatatcccagcacagcatataagcccctttggaatcttgtcccaacaattttttcacttgattccatgaactctatcatccagtcacaccgaatggcttcaatcctgccaagaacgaactctgtattatcctgatacacagcacagcataatgcttaagagcataggctctgaagccagatggcctgcagtgaaacatacctgtgtttttaacagttagcagacacaagtatggctaatatgattgttagtcctttctacaatcactgtcatctccctgagtctgcttaacgtgacatcctcctgctctaggacatgcctgtacatcactgtatgatttagcttaaatgtaatttcatctaacatgatatttccaaccttcccagttgctatcctgtaataatagttacatagttgatatagcattttatcacctagcagaattatggtctgtttatattatttctctatcactacaaaagtgagttattaggttgcataggccaacttgttattttagtaaccccggtacctagcctatttcctggcatataagaaagttttcagtaaatgtttattgaactaagttaggaaaaaaataatgcaaaaattaaattacattgcttaaaatataacattggacccccaaaattatcaggtccatcatgtgtctaagaaatattttcatattctgagtgaaattattgcatcttctctaatagagtggtatatatacaaattatattgatatttttaacatattattttcttcatgatttacaaactctcaacagaagtttcttctgaaaatagcaccacaaaaacctatttgattttacttttaaatttccatggatgcaaatgacttacctgggtggattgctggttataattaccttgagagctgctaaaagtcctaaaagtatttgtgacctagactgtcatatttagtaagacttcactgtcctccttgtgattctcccagtatccatcatcttccttttctttctccaattgtttccttcttcctttattgtctaccactctttttatagttgcccatacaactctaataggttttgtaaacttttaatttgaaaattgttccatttagcattccataaatttgggaagtaaaactcaatatagattattttaatgcatgtcattgtccctgccaattatctgtaaaatatatttttgtgttctcaagtacaagtggccataaaaaaagtacaattccttcataaaagtgacatcaagcttataaaatgtctttacattttcaatttaccttagttgtggaattgtattgaaatatactgtcctaatcattcatattctagacacttgttattaataggtatttatactaaaataagatttccattgttatgtcctattattttgaaacttagtcatatgccctttattgagatatctacatcgaaataagattattataagatatcatgctaagttactataagatcaaaattctaatctcaagcagtgatatgttctaatagaccataaatcactagcaccctttgtggtaatataacaaccttggcataaatataatgttatagtgcatgtgaagcacacaaatgagaggactaaaatacagttttccaggtaagaatacaactttcattctcaaagggactcctcaaacttggtaatttttattatatatatatgtatatatactctcagtgtctacttgtatgaatttcagagacatcagtgaaaatccccatctgtggacttgtgaaataaagacttttgggttttgatcaagaatgcctgatttctcattttcagtataagggaattcaatttgttcgttcattcaacaatcaattactaagtttctatcacgcagaaaatgtggcacaaggccctggcataaatttaaataagacctagaaattctaaaagtcaagcttagtgtgggaacacaattctaagtgtcacatcatcatgtgattagtgctatatttgaaggtgagtaatattttagtatcatcaggcaagaagtaaatatcttccattaataaatttaaactgtggaaaggcagattatcagggaacataacaccagaaaagaggataatacactgcatacagaggtagaagatgtgagtccaaaattttttaagctgccaaaagatatttgggcatgccgacagtcccaactacttgggtggccaaggccagaggatcacttgagcccaggagttccagtccactctgggcaacatagcaaaatctatttctaaaataaataaataaatacaattttgtgttaactgctatatattggggccattttttctggtagttaatcaagtaattttctctatgccaataaattaattgattagactccatctctctaccatgtgccttataaagggccttttccaaaagcagtgagcagtgctttggcattaaaaaaaaaaaaaaccctctagtcatgggtcattcagactttattgtgggacatttttagagcatggaggcacacctatgttcacgtactacatctatataaaatggtattccctagcagtaagtataggacaatatttcaaatcttatatcaaaagtgaataaagaaaatctaattgaagcaaaagctctttctctaagctgttttccatcataaaccaaaaatatatatttctattacaaatcacttttaaactctatctaaagaagttacattacagtgacagctacggctattagttattcaccttgcaatcagcactaaatctagtaaatatggattcaagagactatatgtgctcgctgtgatagaaatgtatggagagagagggaggagaagcaggaggaggaagacaggggaaacatctaaaggggaggaagttactaagagatgcagagggtacaggaagcatgtctccaaataaaaatcaccagattaaataagcacacattttagtattatgctttatgaagtcagacatacatttcaataattgcttttaatgattattcatgaatgaattattaattttctagaccaaaaatatcattccgtgcttgctaaataacatttgctcaaatgaaaaaatacatatataaaaaggctaaagcctttcacatcattagtactgctgtagagggttagtatttgatcttgttataattcatgctcagtttgttagaacatttccacatcacaaattacaacattcgggttcaaggatggatataaagtacacagagaaagtattgtaagagaattattttgcagtgagcctgataatagaattatgtgtgtacctatgtatggttttgagtggaagcctatgcaaatgtcagcaaaaggcgggggttcttttcaatttttcttgagaacaccaatttttctgacagtcttgtcctttttaagatttactgagttatatctataaaatcccctcagtttacagataaaatagatttccaaattatcacaaaatttattttttttatcttatttagtgaaaaataaattcagagtcatgctagaatatgttaaacatcaggtcagtatatttaaaggtcaatatggtatgataattgccccttcaaaaaataattattcaagtcaggttagaaataattgttgtgcatttattttccagttttcctattacaaatttacttttactgtaagtgatacaattttatcgtaagtaaaattgtattgttttactgtaagtaaaaggtacatttacttttattgtaagtgatattatatgtctgttaattcagtaggctttattggttttactgataaactacacaaggtggagggagaacaagatacactttagttataaacatacaatgtaaaatatttttggactagataactatatgaagcatacaatttttaaattaagaactcaaatccatcacattgtttctagttgtgctagaaaaagtgaaatcttaaaaagtgaaatctttagtgacttcctaatggtattccttaaaatatgatgggacagtgagaatgattcggtccaggaagaaggagtgagataagaaattctaaattgcagttggagtgccacgagtaagctaagcccttccatttcagcacagcagatttcatatctctcccatctctcagcatcacagagtcttagaactagaaggaccccagataatacctgaacctcccattgctgatgcatagatgacctcaacaacatgttaagcgtgtagtcatctacttttctaaaaacctgtggcaaagtcactcacctcttgcaatctcagagaagcctttttaaattttaaaaattatattaatgagatgacaatgcaaacttctctgtagtttctcttcataatacaaaaatgtacaaatgtagactacataagattaccaaaacttcactcctaacatgtagattatgaagattaccaaaatcccatgcctaagatattttcactatttacatacacctacatatttttttccccaaaagtagtgttgtatatgttctccaactggcaattttcactaactgtattctgaagaaaatctttcattttcattagaactagctaattccattgtgtaactgtacaacataaactgtataaatatatttttctttaatcatttatttgggggtgagattttggttgttgccaaattttcactatggacaattatgcaaaattcctcatacgtatatatttttttgtccagggtgttaagtcttctgtggcataggtttctggaagtaaaataattgtgtaaaacaatgtgttcttaaaaaaaataatagatatagatactctgccttcaaaaatgtattgactgtataactcatggtatatataaaaaggcttcaaaatcttcactctgattcttccaaagtcattaagatttttaatatatcaagtgaatgtgttaaaagctttgttaaatacagccagacatggtggtgtgcacctgtagtcccagctacttgggaggcttaggcgagagaatcacttgaggctgggagactgagtctgcaatgagccatgatcacatcactgcattccagtcaaaaaaagcaaacaaacaaaaacaaaacaaaaaaacctgctgctctcattttttttctcattttgctagttatatctatttacactgaagaataaagacaaaatagaatattttgatagcagcctctagttcctttatactcagccaataagagagctcctttaataatctgaatagagaactgtaatccatctttatttttcagctttgcatctaactttgttcttgtcttaccctatctactcttgatcatcagctattcttatttccagagttttttgtttacttttaaattaagtcttcatatttgcttgtgtaattatttaatgctaggtcttcaaataatgaattttaaaggactgggtgaaggtaatatctcctttgataaattaggtaaaatttaggatctgaccatgaatcttctctgtatctccactctcaacactcttgatctgcaaaatcccttcagggaccagtgctctctccatactagagtgataaccttatggcaggtggagttctttcctattgtgagtgtaaacttgactcttcactgctccttaatttcatgccatgccatacagcaacagagattcctcttcagcagtttagccatcttccattctgtagatgaggcatttgtttttcatttgaagtgaaagaagttcagctatgtccctttggtttcagaattacatttaaataaaaatataaatcacatttttcctgcacaaaacatttttgttaatgctaaaatatatcaaattgccaaaataatgttttacacaaaaggtttgtcaaagacacacaatatgtgcgctgtatttcttaccaaatgcccactctttaagctaaggcttgtattgtcatgcttcaaatagaaatgcaaaaaaaaaaaaaaaaaaaaaaaaacaaactcaaataaaatgcttttaatctaaggaacatgcagataacgtttttttttttccaaagcagacatatctgcatttctttggttgttggttattaatatttcattaattttcaagctactgcaaattccccttgagatatcattaataaaataccattcaaatcagcaagattatagtcaaaatagccaaactacagaggccatttaattacctagaaaatttaagagtgctgagcacttgctttaatttaaagaactgaataatccgatgctttgatgattacaaagagtctttagctttccctgttttgttggtaattttaattatttctcatactttccccacttagatgcattcctttatttgcccttttagaataataatgagcaaattttgaagaagaagaaacaagtacccaaatacagtcatgaactacacaatgtaatttcagtcaatgacagactgcacatatgatggtggtctcataagattttaatggatctgaaaaatgtttagtgtctagtgatgtcatagctgtagcaatgttgcagcacaattattatatttttaaaataagtttagtgtagcctaagtgcagtgtttataaagtatacagtagtgcaatgtcacaggccttcacattgactcatcatttactcattttcttatccagaacaaccaccagtccagcaaactccattcatggaaggtgtcctacacaagtgtagcatttttaatattttataccatattttctactgtaccttttctatgttcagatacacacatacattttgttacaattgcttacagtattcagtatggtagcatgctgcactggtttgtagtaacaggctagaccatatagcccagacgtgtaggaggctataccatttagatttgtgtaaatacactctatgatgttcacaggataatgaaatcacataacaacacattccccagaacatgtcctcaccattaagcaacacatgactgtacttctgaaataaattttaaaatagacaaatacacaggcactcagcagtcataagaaggctttctctcttcacttacttcagtgacacattcaatttttgatcaagaaaagtagtcaaaaaattaatagcatcacattttgccaaaatattgtatacacttagagaataccaattttgctgattctgagtgtttccttgcacacgtcagtaggtattttggatttatgtgtcaaagagactcttaattttactctaactctatctcacaaatggttatgcacctgatcacaccacatccacttaaagaatggcaagacagaggaaggagaagaattacactttcaccattatgcgatgtgtattcatactggagccttgtttatttcaaaattttaccagattatatagagcaattaaagtttattctttttagttaatattaatagatacttttccctcatgaatgtgttgttttctggataaatcatagagactgtgtgttcggtgagaaaaaccagttataaaagggtatatgtaatgattggattcatgtgaagttcaagaacacataaaatgtgtttatgtggatagaaattaaatactattaataatttctggctattgaggggacaggtattgactggtaagaggcatgagggaatcttctgcaggcaacgggaatactttgaatgtttaaatgtatatacatatataaaaattaagctttacactgaagatcgatccactttccttcatataaattgtaatcagtttttaaaatgtttttttatcatgccaaaacaaatattttaaaaacctaaatattaaacagtattaaatgaaaaaattaacaaagttttatatctattttcttctttctggtttcattgttcccgttcaaatactgctattccacatcttaactactgaaaagcctactgaggcaaaggctcataacttgttctttcttccttaattacggaacctctcctttctatatgcattagcctttctttagctaaatgtagtcataagtgaatgattttggacaataagacgtaagtggaggcagtgtgtacaactcttaggacgagtacatttaagaaaaggtatatgtattttatcccttcttgcttcttgtcagctggcattatgacgtggtggctgaagctcgagtagccttattggactatggcagaatttatgtgctgaggttggatgagcaattagacagaactgtggggtcataacattcaggaagccagatcagctctgaactcactacctccagattatgctttttttacttgagaaagaaatatatttttatttaagccacagttaatgtattgcctgttttgccattaatagctgagcctaatataaattgatttactttatataaacactgtttttctatcaactctttctcactataatctattattcaagcatactttcggggtttttctgagaacgtatctgattatgccgccttcctctttaaaatgtctttttttttttccatttcagggatattgctattagtccagacattaaaatatgtttgctactatacagtcatgttacaaaattgaaaaatctgattctgcatttttaaatgaaaacaatttgtataggaaataaatacctgaatatactcaccaaaatgtaactacttattattttgggtttaagaaataatagataatatttttatttacattgtatgtcttcaaatttactaaatttatgtcggtaacaatgcatcaggccaggcgaggtggttcatgcctgtaatcccagcactttgggaggccgaggcgggcgggtcacctgaggtcaggtgtttgagaccagcctggccaacatggcaaaacctcgtctctactaaaaatccaaaaattagcgtggcatggtggtgggtgcctgtaatcccagctattcaggaggctgaggaagcagaatatcttgaacccaggaggcagaggttgcagtgagcctagatcacgccactgccctccggcctgaggaacagagcgagacgccatctcaaaacaaacaaacaaacaacaacaaaaaacaatgtatcaccgtagaaattaaaacaactttttctaaacaaattaaaatcttccatcgaaatttatcttataatttaaaacagttctcattagagtcaggaatcagtaaaaaagttgccactctcattataaccattttccattgtcctttaggcctaaacaactaaagaaaaaaaatttaaataacaaaataactttttgaaagaaagagataactttgtcattagttgtggatgatatattgatattatggaaaatacaatagtattcattgaaaaagtaataaaaggtatttgattttagcatagtgatgaatttcataaaaatatgctgaaagcaaaagcattcttttatcacatcaaaagtctaattgttaaaattccattaataatacatgtaggtatttacagttttcaggataaatatcaaaataatcaagaaataatgaatattttaaacatggcatggagaaaattagttatccactttaggaaaaaaaattaagacaaattaagttttgtttttttttttttccttgagatggagtttccctcttgttgcccagactggagtgcagtggcgcaatctcagctcactgcaacctccgcctcctgggttcaagtgattctcctgcctcagcctcccgagtagctggcattacaggcaaattaaaattttaagtagaaaaaaacaaaaaacaaaaattgcattagagaaaaacacaggataattctataatttttgactagagaaagtcttttaaaattagcacaaatgataataacaagaaagactaacattcactgagttcttaacagatactctcctaggtgcttttacatgtgttgatttatgtgtgtcctctaaccctctaggagaaaggagctaatacatgaaaggcacacagacattaagtcatggttggtaaatgctggggctatcttaacccaagctatctggttgaagatgctgcattcttatctacattcttttcccctagaattcacacagaaaatcctagacaaaaatgactacttaatatcacaaatgtctgcataaaaaaaaaagacaacataaaacaggttagtgaaaacctgtttttcccaaatctagaaaaacatatttgcaacattaatgatagctaagagattaataagattatgagctcataattccataaggaaaattgatgaataccatatagaataacaggcaaaatatataaatagggagttcccattgaaagcaatgaacattaccaaataaaatgatgtttaacctcattgataatcaaatacaaatttaaataaatatatcctatgtcttcatctattacactagcaaatgtcaaaatggttgttattgccagtttggccagggtgtggcaacacaggcactctcatgtactatgttaggaggataaattaacaaaactttttgaaagataatataggatctgtacccaagattaatgtgtatgaatctttcttggtgagactgcccttttaagatttagcctaattaaataaaagggaaaatgtagctgacaatggaacagtgtagtagtcatacttataatagtaaaaaactagaagctagttaaatgtacatcagagagtttggttaagtgtattatagcacatttacacaaagaaatatcaatcatacaaaaggggagcatatgatattataagttccaatatgtgaagataatcttggataattggaaagagatatattctaggaagagaacaaaacatgcactgttttgggtaagagaatgaagtctgcattccagaagtatgaaagttatatatttaaactcaatatattattaatatatattaacaaaaataaatatataaataaagcataattattatttaacatatagtctcataagtactaatatgtgaaaataattttcacatattattgaaaactatatgctatatactccttggtatgtcctcatattttctgaaatacaaacttccttctcttacccaagacagtgttttgttttcttctgtctctagaatgtacctctttccaattctacctatcaaacattctttaacagtaggttttgctcaaaatgctacttacactacaaaatccttgtcttacgctagatcttctgtttttccattcattaaaaatatctattagggaatttaccactatgtggtacgcattatagtaatgtgtgtatatatcttccatctctgggaacctccaaatatttcaatgacagtgtctcctctatatttttatcctcctattatgtctatccctcatgcgcatacacagtagatgcctaataaatgttcacaccaaattgtttacttgactatacataaggggtcttcaaaaagtttgtgaaaaatgtgtatcatgaaaaaaactatgcacagatttcaaaaaacatttgcaccaaaataaacccatactaacatgttataacatgtctgaacaggatctagtctgaggccctaggaaccattaagacatccatttgaaaacagcctgtatcagagcaacatgaatcttgctaaaattgaagcaaaaatacacctcaaatttacggtgaaatcattgatgctttacaaaaagttcatggggaaaatgtcccaaagaaatgaacagtttacaaatgaatgttaagaatggacaagataatattgaagatgaaacctgcagtggcagaccaaccacatcaattttcaaggaaaatattcatcttgtttgtgccctaattgaagaggaccaacaatttaatggcacaagtaatatccaatgccacagacatctcaattagtggagcttactcagttttgactggaaaattaaagttaagcaaactttccactcaatgggtgccaagaccatggcactcagatcagctgcacacaagaccagagctttccatggaaattttaaacaaataggaccaagagcctaaagaatgtcttcgaagcattttaaaaagaagtgaaacatggcattaccgttacaatcctaaaaacaaagcacataaaagcaatggctaccaagaagtagaagtggaagtggtctcggccaaagcaaaagcagactggtcaagagcaaaggtcatggtgatacaggcggtagaaataaattatttaggcagatagtgagggcaaaagagtcatcggcagtttcccttttaacaaaaagcagtccaagaaattatttttttgctaacaaagagcagcctgaaatactgagccgcaaacatcgataagcaagcttgaagcttgcacgggggaatgctggcagctgcgccaatagagaaggactacctgagggccaggtatgtctgccatggaagctccatcttccctttttttgttagcacatgtatgacaagaaagaaatgggcaacatggagcagctcagtcagagaacctgcctgcataataaaagattggggtgggggtcgggggggctgagatttgtgccccatgcaaatgacgcaactggtctaaccagtttttcggaccctatgtagatcagataccgcccctccactagctcatctataaaacctcttgcatttcaccacgaaatcagcaactcatttttctgggacccctctctgtagcagagagctattctccttcttttgtctattaaacttccactgttaagctcactctttgtgtgtctgcgcccttgatatttgtagccatgagacaacgaaccttggatattatcccagacaacgaagcagcttcagtggcagtctttttggggggatgctcaaggcattttatttctcgactttctggaggaccaaagaaagataacatcggcttactattagagtgtttctgagaaagttaaccaaatctttagcagaaaaatatccagaaaaccttcacgggaaagtccttctgcaccacaacaacacccctgctcattccctttatcaaacaaggacaattttctgaaagttatgatgggaaatcattaggcatctagcttacaatcctgattcagctccttctcatttttacttgtttcctaatcttaaaaaaaataataaaaaaataagagtagtcattattctccagttaataatgtgaaagagactgcattgacatggttaagttcccaggaccctcggttctttagggctggactaaatggctggtatcattgtttataaatgtgtcttggatttgatggagcttatgctgagaatgaaagtttacattttttatttttatcttttaaatcaattttctgatgaacttttaaaagtcccctcatatatagagatagctcaatagataaatataataaatataaatatgactgcttgtcaattactaaaatatggtttctctatagtgaggtttgttctcatttctttgcaaaaatagataataaaattattcacataaaaacacgagaggcacagcaatgttctgaatatttaaattattttgaaataaatgataccttaatgctaacacagcaatattatcatcttactaaaaatgtatcattattaaaattttgtcaagctaataaggttgagaatctgaagttcttaaaattgtttaagtatagccacctggctccaggtcaggcttataattgctacactgtggtaccagttctaacaattgaagagactgacagaagacttggaatcaacatcaagttaatcttcatgtaatttatcttcacttcactcaatccatatctattacctatctccttgtatctgtgttgggttctaatatctactgatcagacactttctaccttctccctttactgggtatatacccaaaggatgataaatcatgctgctataaagacacatgcacacgtatgtttattgtggcattattcacaatagcaaagaccaactcagatgtccaacaatgatagaccagattaagaaaatgtggcacatatataccatggaatactatgcagccataaaaaatgctgagttaatgtcctttgtagggacatggatgaagctggaaaccatcattctcagcaaactatcgcaaggacaaaaaaccaaacaccgcgtgttctcactcctaggtgggaactgaacaatgagaacacatagacacaggaaggggaacatcacacaccgggccctgttgtggggtgggtggagcggggagggatagcattaggagatatacctaatgtaaatgacaagttaatgggtgcagcacaccaacatggcacatgtatacatatgtaacaaacctgcacgttgtgcacatgtaccctaaaacttaaagtataataaaaaataataataataaaaataaaattaaaacaaaatacattactcttggccagtcacggtggctcacacctgtaatcccagcactttgggaggccgaggcgtgaagattgcttgaggtcaggagttctagaccagcctggccaacacggttggtgaaagaaaccctgtctccactaaaaatacaaaaattatcctggcgttgtcgtgggcacctataatcccaggtacttgggaggcagaggctgaggcaagagaatcgcttgaacccaggaggtggaggttgtagtgaggcaagttcgtgccactgcactccagcctgggcgatagagcaagactcagtctcgaaaataaaaaataaaataaaatacgttactctttgaaaagttggaagattttgagaaataatttctttgtgccttgtatgcattatagaaaaactcaatggtgataattcagcctatttacataattctatccatgagggactgactcactccccggtgaggccactaattcaaattttatataatatgaaatagagaaaattacttctctattggaactaaaatatgtcttcttataaatgaacctaagttctggcttctgaaacagtacaatataaacataattgctccatgttagagactagcctattctaagtttctcagatccattttgctctattacgtttaaacacctgcatctaatagcaacacactctggatacatgattcctgttaccttcctgtttatctcttctgttttcattcttcttgtttcagcttatttctaagaccttaatccagttattttttcctactcaccaattcctcttctttctctagttttaatattgaaatagctaccctggactctgaaacatggcacgtctagttgtctctccaacatccagttctcctaccaaactttcctgaaaccctgactatgaaaatgtaccacggaaacggcagaaaagtaatgtcttacttttatttttccctctatcatcatatatgaattccctaggttttgttcttttgttcaagctaagttcctgaaccctaaatccacactgtcaacacagagccttctcctaaagggccatcctacccataaggaacccctagatgttaaaacatgtcacctaaccaaaattttctaaaggtgcccatttcccacatgtatcatatttatagcatttcattatcctctgtctgtgacacttgcttgtctagagcatcatctgaggtaacaacccccatctgtccaatttcatcaactcactcttgtgatagatattagcagctaatatctaaacatgttatagtgaagactggaattttccaattgggttaagttgaaaaaattaaccataacattgtatttcacttctttttttggctatgttgagcaaattccaaaaattctaaacataattataataaaattagagtcaacaatagtattactctattctctttttttctgaaaaataaaaatagatatttatgtctggaaacctgaaataaggaaaattgattctactttacaaatatcattgtgggtaatgggttggatatataatttttaaaatgtattgaattatctctaatattttttaaaatgattactgtatgtttggcttttttgttgaattgatatttaaaattaaaactttttcaaaggtaataaggccataaacatctcttcaatttcaatatggccataatcttccaaggaagccctaccacaaattataatttgttatgacaagtgtataaaaaatgaaactcatgttttataatagagagaggccaaaaggttaacatttcttctcctaggcctgaaagaaagtcaataaatgaatctctaaagctttacccagaaaagctggatctatagtgatagtaaagaaaatatattttgaaattgtaacctattaaagaaagaataaagaaaaagaataatggaagatctgtagagaaaatagagaaacaactgctataatttttttttttcttttttaagacaggctctcactctgtcacccaggctggagtatactggcatgatctcggctcactgcaacctcaatctcctgggttcaagcaattctcctatctcagcctgctgagtaactgggattagagtcacccactaccaccacaaccagctaattttctgtacttttagtagagacgcggtttcaccaggttgtccaggctggtcttgaactactgacctcaggtaatctgcccgccttggcctcccaaatgctgagattacagatgtgagccaccgtgcctggccgatttttttaatctaaaatgcatttcatcatcttctatcacccttattaagggaagcaatatcagtttaagaatgtttcttaatgaaattagtctttaagtttcatgttggtactttactatatgaaatataactctcagtatttagagaaagttaaaatcatagaccaagttatatgctagttgaaagaatctaacaatgtggagaattaaattctgttaataaattttctatacgtcaaatatttttaccaattcaaattatataaagcatagagagaaagaggtaaaaaaatgcttcaaattttattgcaaagagcaataagttctttttagatgatatcttcttgggcatatacagtttctgttttctctgtcttagatacactcatcacaggtatctgctgagttctctaacttgctttttattcagatcttaattcacattattaacctttagtcagattttccctgaccatcctatttaaaattgcaaactccatccaaccattaactaatcccctgttgacatttttcatagcttttatgcctatcttcccactaaagtgttccagaagaacataaatttggttcacttctgtttactactgtattctcatcagcaagaataatgcatggtacatggaaggcactcaaaaaatattcattgaaataaaaatgaaagaaggataaaacttaaaaaagtacttatatgtgaattctataatttctaactaaaaatttaagaatttcaggataaaaataaacatgtgcccactgactatataaagaggccaaaagaaatataaaacatatgggaaaagaaatagaggtcataaaaacaggaacgaaaatagaaggtatcttacaagtttcacatggcatcttggggacggctatgctgtaattatattttcttaggggcatgtaaacaaatgaaagaaatgccattaatcgtaaattgaagaggtctaaacttagcctgtactctttcttctcttatttccatgtcatctacacatgcagactgtcctattacttgtatgggctcaacatgctgccagtacctaaccttaagcctgctcaactcctgcacattgaaggcagttaaacttgtcactgactttagaactgatacacttgatgtgaggattcacagtgggttctctgaaagaatttcttcacttgttccttatcatttccaattccagtaccacttctctgcaccttcaaacttaaaagcaaatgtgggaggaaaagcattaagtcttcaactcattttttggactttttttcttattgtaactttccacattacttaattggctctggtaatatatgccaactctcattgttttattcagccctgtaataggtccactcccccaaatcaggctcctgtaccagttagaaatataccgcaatgaaaatgaagagctaatatgaaacatcctgaattagaattagtgaacagagttgaaagataacagaggattacacacacacacacacacacacacacaggtgagagaaacaacaggaaaaaaaaaacaagtagtgattagttaatgactcattttaaccctaaattctacattgaataattgtattttacatctgttagaatcaagatttcacacagttaacccagtccatggtgttcagtgcctaataatagctctaaaatgccatcctgatcatttcattcacctcctcaaaaattcaactagatcctaattacctcaagacaaaagttgtgtcatttatagttctctgtgatatcacatcactctaattcaccttttcaattatttttcctaatattactttctaaacaaatatacctaattatgtttcttcaagtgcctaatgcttttctccccaggttgttcatattcaggaacccagtaacttcataatattcctccagtgttgtttttctgtttaatcatgttattatcacacaaatttattgatcctgcaaagctatctacttgtagtacctaaacatacttaatatgtttattgtcggtctgcctctcctagaacataatatccaagagggtatggatttgaatctgttttgtttattaatatgcttcaaccacctggcacattattgctgaataaatgattttcaaatatcttctactttccaaatgaccctgaatcaattgtttcctctccattcccagtgtgtctgccttaaattaggctctcattaacattttcatagaccattataaccatcatataaataaattccattcctaatattcccccaggccaatgcatccttacattagcaatatcttctgaaatacaaatctgatcaggactttttccttttttgctaagaagctttattttatagtcttacatgaggctactttttcagtttcttctactgccactctaacaatgaaaacacttttctttgggctactctaccaaggaaaatgaacctttttatatttattagcatagaacacaggcttctgagatttcataaggaagaaaacaagctcatgattagtgaaaatatggtacattagcataaagctatttcaagcaatgactttaaacattatacttatcaaccattggataaacacattacatttccacttatgattatatatttcacaagaatgtatgtgtgtacacacacatatattcacaatggcataatatttgtcattattacatataatcaattttatttttgtttttattctattgtgtttcacttatgcaggtaaatattcatttcacgacaggggaggagccaagatggctgaataggaacagctccggtctacagctcccagcgtgagcgacgcagaagacgggtgatttctgcatttccatctgaggtaccgggtttctctcactagggagtgccagacagtgggcgcaggccagtgggtgcgcgcaccgtgcgcgagccgaagcagggcgaggcattgcctcacctgggaagcgcgaggggtcagggagttccctttccgagtcaaagaaaggggtgacggacgcacctggaaaatcgggtcactcccacccgaatattgcgcttttcagaccggcttaaaaaacggcgaaccatgagattatatcccacacctggctcggagggtcctacgcccacggagtctcactgattgctagcacagcagtctgagatcaaactgcaaggcagcagcgaggctgggggaggggcgcccgccattgcccaggcttgcttaggtaaacaaagcagccaggaagctcgaactgggtagagcccaccacagctcaagaaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacccgcagactgcctcctcaagtgggtccctgacccctgacccccgagcagcctaactgggaggcaccccccagccggggcacactgacacctcacacggcagggtattccaacagacctgcagctgagggtcctctctgttagaaggaaaactaacaaacagaaaggacatccacaccgaaaacccatctgtacatcaccatcatcaaagaccaaaagtagataaaaccacaaagatggggaaaaaacagaacagaaaaactggaaactctaaaatgcagagcgcctctcctcctccaaaggaacgcagctcctcaccagcaacggaacaaggaacaaagctggatggagaatgactttgacgagctgagagaagaaggcttcagacgatcaaattactccgagctacgggaggacattcaaaccaaaggcaaagaagttgaaaactttgaaaaaaatttagaagaatgtataactagaataaccaatacagagaagtgcttaaagcagctgatggagctgaaaaccaaggctcgagaactacgtgaagaatgcagaagcctcaggagccgatgcgatcaactggaagaaagggtatcagcaatgtaggtgaaatgaatgaaatgaagcgagaagggaaggttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaatgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatacttcacagacaagcaaatgctgagagattttgtcaccactaggcctgccctaaaagagctcctgaaggaagcgctaaacatggaaaggaacaactggtaccagccgctgcaaaatcatgccaaaatgtacagaccatcgagactaggaagaacctgcatcaactaatgagcaaaatcaccagctaacatcataatgactggatcaaattcacacataacaatattaactttaaatgtaaatggactaaattctccaattaaaagacacagactggcaaattggataaagagtcaagacccatcagtgtgctgtattcaggaaacccatctcacgtgcagagacacacataggctcaaaataaaaggatggaggaagatctaccaagcaaatgggaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactatcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaaaccgctcaactacgtggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcagggaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccactagcaagactaataaagaaaaaaagagagaagaatcaaatagacacaataaaaaatgataaacgggatatcaccaccgatcccacagaaatacaaactaccatcagagaatactacaaacacctctacacaaataaactagaaaatctagaagaaatggataaattcctcaacacatacactctcccaagactaaaccaggaagaagttgaatctctgaatagaccaataacaggagctgaaattgtggcaataatcgatagtttaccaaccaaaaagagtccaggaccagatggattcacagctgacttctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgataaacattgatgcaaaaatcctcaataaaatactggcaaaacgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactccaattcaacatagtgttggaagttctggccagggcaattaggcaggagaaggaaataaagggtattcaaaattaggaaaagaggaagtcaaattgtccctgtttgcagatgacgtgattgtatatctagaaaaccccattgtttcagcccaaaatctccttaagctgataagcaacttcagcaaagtctcaggatacaaaatcaatgtacaaaattcacaagcattcttatacaccaacaacagacaaacagagagccaaatcatgagtgaactcccattcacaattgcttcaaagaaaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccataaagctaccaagactttcctcacagaattggaaaaaactactttaaagttcatatggaaccaaaaaagagcccgcatcgccaagtcaatcctaagccaaaagaacaaagctggaggcatcacattacctgacttcaaactatactacaaggctacagtaaccaaaacagcatggtactggtactaaaacagagatatagatcaatggaacagaacagagccctcagaaataacaccgcatatctacaactatctgatctttgacaaacctgagaaaaacaagcaagggggaaaggattccctatttaataaatggtgctgggaaaactggctagccatatgtagaaagctgaaactggatcccttccttacactttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagcctaaattgacaaatgggatctaattaaactaaagagcttctgcacagcaaaagaagctaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaagaaacacatgaaaaaatgctcatcatcactggccatcagagaaatgcaaatcaaaaccacaatgagataacatctcacaccagttagaatggcaatcattaaaaagtcaggaaacaacaggtgctggagaggatgtggagaaataggaacactttgacactgttggtgggactgtaaactagttcaaccattgtggaagtcagtgtggcgattcctcagggatatagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcgtgtcctttgtagggacatggatgaaattggaaatcatcattctcagtaaactatcacaagaacaaaaaaccaaacacggcatattctcactcatagttgggaattgaacaatgagatcacatggacacaggaaggggaatatcacactctggggactgtggtggggtggggggaggggtgagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaaaattcatttcactaaactcatttcacaaatcactaatgagctgtcatgcacagtttgaaaaaatacgctaatagagtttgagtcttttggcatgactgaattataggatagggtgctgattgtcttattcaatgacaccaaactgttggtgattctgtggcagtcatagaaagctgaagtagtctatgtaatattaagagtgtaaatggtgctttaattttcaaaaaggaaggggaaaaggtgtatttgataaactacattacagggtaacgatctaagatggataatttaaggaatcatttgtgaacattgaggatgaagtagtaatcactaatatctaacatgatttatgttaaaattagtcaaatcaaattaacctcagttaatttgttgctaagcaagtaaatcaagactatgtagtacaattttgaaaggcataaggaaataaaatgctctcttattcctatgatagagataatgtggtatagtcattaaccctagttcccttttctgctagacatgcaactagacaaaatttctgtctcccttgcagttaggtgggaccatatgactatgttctatccaaatgaatgtgaactggaaatgatgtacactgctctcaaactcctttcttaggtaacctaggatccctctcaccttatgacaacacttagcaatggtccccttatcttttttgttgttgttgtgacagggtctctctccgtcacccaggcgggagagccagtggtacaatcatggctcacttcaatctcgaactcctgggctaaagtgatccttcagactcagcttcccaagtagctggtactacaggtgcataccactgtgtctggctaatttttaagtttttgaagagatggggttctcactttttttccttcagctggtctagaattcctggcctcaagccatcgtcccacctcagcctcccaaaatgcttggattacaggcaacagccaccatgcccagcctcctttatttcttgtattatcaattgctccccctctatggactctttagacaacagcatacaggtaaaatgtaacatctccctcattaatatatccagttctttaaccttacatacatctccaaatttttctctgtttctctgctcctttacaggaaaattccattatagaactgtctatacacactgttaacccttctgatccttcaattgtccctgaaatctatcgtaatctggcactttactcttgccataaaacagctcttgttagggtcacaaatgacattgacattgctgagtccataggatttttcttttttccagtgtcgtcatctctgatttctcatgaacagttgttcagtcttcactgcactggcttcgttccagtttcttggtctccttgttcccaggtctctagtcattcctttggtctcccttagtgttcccacctctcttccctactgttggtaggccccaaggtcagtcactggatccttcgtcttctctacctatacttcctacccaggtgttttcaccaagtttcatgcctttaaatacccagtgcacacagttgacaaaatatgtctagcccagacctttcactggaacattagacctatacattaaactgcttcctgaataattttgttagtctaaaagtcaccttaaatttaacaagtccaaaattaaactcctgattctctctctgaatcacagcttctgtaatcttttctatttggttattggcatttcatctctatttgttatttattcttctaggtgtaagcaaaacaacttggaatcatcattgactaacctctttcttccacattcatacttagtccatcatcagtaaatcttttccctgtaaagtagagcccaaattcaacaactttcaaagaaatttctactgctgtcatcctggtccaagatgtcctcctctctgatttttttattactatagtaggtttctaatggatttctttatttctaccttttcttcccaggagtctgtcatctccacagcagcataaaataatcttttttgcatttgtagtcttgagaaggttggtatcataacaatatgcaaaatgatccttttaaaatttgattgtcatttttaaaatgacaaatcatatcactttctgaatttcatataaatgtcattcaattaactttcaaaaatatgaaaaagactgtttaacatgccacattaggtcaaaagagctatgggttgagctgtttaaaattattttgaaaagctattttttaacatgaatgaacatgccactagtatttgttacaatttcatcattatttccaatcctatttatttggtcttgttaacaagagaatacttagtcaaatttttggctcggtcaaatctcttaatcttctagaatacaactttggggaagtgaatattaaattaaaaataatggcattcatcagcaatttatcattacatgccctgtaattattattaatattatacaaattattatataagtatagaatatattctatattataaaaacactatgtttaaagctcttatattatgaaaaatataagattgcactaataaaaatctaaagaaaaatatcataaaaatttttgaagtctgctttactatagtcttacatacatacacccacgcatgcaactgttttcatcaaaatggacatgaattcatgaaagtgtgctcttatttatctcatgtgaaagtactgtaaaaatgaatttcctagcttctgccagaagtttacagatacttagctgggtggaaataccaataaattaagcaatagtgttttacctttataatgatgcatatgaagggctcttttcatcttcctgtaagatcacaaagtataatttgcaaaaaaaaaaaaaaaatctgcctgacatatcctttgcaaatagaaaagtcaaaattgggaacatgaaagcagacgtgcaaaattagattcatatacccactttgtttcctgtgctggagcctctgaattagacccagcaggccttccctccttgaccctgcctcaaccaggaaaaaaataatgtgcagaatcttcctttggtggtctgacccaacccttcttaaagataccttttatctactttttttgttctttttttaaatggggaagattctgtttgcttttaattaattgttttgttttgttttttgcttttgtttttagacagggtgtcattctgtcacctaggctggagtgcagtggcataatcatagctgactgtaacctcaaactcctggcctcaagggatcttcccttctcagcctcccatctcagcctctcaagtagctgggactacaggcacacacaacagtgcccggttaatatttaaatttttttttaattatagagaaggggtctcactttgttgtttacactggtcttgaactcctgagttcaagggatcctcctgtcttggccttccacagtgctggggttacaagtatgagccatttcacccaggctgatttttttttctaataagcataataaactttgaaatgaatagatcatatcaacacattttaagagttagtcagtagctttcgaaagcctaaaaaagatattataatatttatttttattttccattagactaaatatgcctattttaaatgtgatactgccaattctctcttacaccaaatcttctagaggaaagtttttatctaagatagtttaatcattttgataaaacacagcacaaagagaatgcctaatgattgaattaaacatgttatttcattgatatttcttttatatttaatttgtgcctttagccataagaattaggaagttacctggagttcatttccacaaatgatattacagaggcataatagattttcttcaagtgtctatacattatgaatgtaaggttactatgtatctgacaaaagtaatttgtatagaagtaattctaaaaactatttgacgtctattcaaaaaccattttctgcacttaaagtgaaatgactgtagaaatttgctaacctttcatgacacagtgacttaaaaatccattaaatgtttttaaaaaatgcactgcttgactcttttgtaattctaagagcaaacagctatctgacattttcaggatcattaaattaaaaaatgataaggaaggaaaatcattaactaatttatatttctcttctaatgggaatagaattagtaattacttttgctgttgaaacctcctgtagtcagtcacttgtgtcccagtagcatgcctatcattcaaagtatgggacctacagaccttaagttacaaaagttcacagctgtatttatagaccagtattaaaacaagtggcatggaatcttcacactcaatcgtccaaactaccattctcaaatttccttctcctatgttgcacttactggttttctttttatagacttcaataatgttttgcccagtaccttacctattataacaataaatattttctaaattaacacatgagtcaatttgggcatttgaaaagaagagaagcaagacaaaaactcagatgttcaagactttcattcaacaaccgtgggattcttggaagttataataatcagccattacaactcaaagttttatctaatttataggaaaacttatgagcactcaaggaattaattccttcacatttcatctgatgtacttgttgaaatgactatagaattcatggtttaaaatgaagctatcttcatttcctctatctattttctctacggcattagtaaactaactgccatatgaaagtcacatttattttatttcagttctaaaatcatattttaaattcgggcaattcatctaccagtaacattttatatgacattatattttttctaataaaagttgaattgaagagcaagttaacagactgttacccctaaacagaaattacgaaaccaatcacaaagtaatttattaaatttttaaagtaatactttcttgtcaagcagacctgtaaaattagacagtactgttttatagtacttacatttgataaaaagtttgttcatgtctctagtgatatgttattgtgatttacaggttatagaataaattttcaagaggggccaagactagcattctagtttgcccatataattccttaatagaaaaagtaatggttctggtaacctgagcttgccactaatcatcacttatttttcttaatgatagattgctacttccctaagcatagtaatttgatatgttgaaagtggttactgttaagtttaatatattaatttgtcttgactggcagctaataaaatgctatattattgatgaaaaattaatatctaaaattggaataaacggaaaggcaaacttaaccaaacttataaactcagtattgtacttttaagtaagtttcttgagcacccctcctgttaaaactagagtgcagttttaatgccactcttccatcagtagacaaggtgtcttatgccaattcccacagaaggggctgctctgcacacagtaacccgaggcctcaactttccatcacaggcagtatgccaaatataaatacccaggagtgtcctgaactttaaagtgattcctaaatacgaggctcatttacgaagaacttcaaaaacattaagcggctcttgcattctcaattagaaattctcctcatactaacagggacttctgagcgtatcaacacagagaaagcagttgttcccatgtcttaaaatagcacagattgaacatttaacctttctgctgcccagtcagagtctaattactattttatgtttaaacacacacacacacacacacacacacaccattttgccttcctcataatagactagaacatagatgaaagtaaaacaaactcattgctctttaaaagtacaaacctagaaaaaaaaaggttcctgtttgcaggaatttgaaagaatgatgtcaaaccagtcaaactcaatttttctattgaaaagcgggtccttcaaagtaactctattttaagtaattacgctttagtaaagagtttgctgacttttttgattattcattatgagagataattttattttcaaatcctagtgttatatttagcaagttactaaggctctatacaggacatggactcaaggcacttagaataaatgtctccccaagacttgtcacatgtccactgtttataagtaacccagtttatttactagatactggcaatgcctcctttcagaaatgtaaacactcaattactgaattttaatcagaaggattattctacatagagtggcattttctattttcctgagcaatatttcccaggctatcatctcctctatttcaatatcatatattaggattcaagaccatcatatttaccccttccactatgaatggagtgaggcaaaacatgtttattaaaaatcagttaaatagctcagcttgattttacaaatattatatactataaaatgttttctattttgaaagaaatttgtatgttatttttctttcatttggacatgtaaataaatgatgatggtgaatgagagcataggcttctctcaaagagtggtaggatcatgttcttgatgccaaaaacccagaggatatgtcttaggtctgtttttgtgagccctgtaaccttgaataagtcacttagctattttgaaattcattttcttcacctgtaatggcatttgctctctttttaaatagaaattacattcaataaatgagcattttaatgtgatagatttaaaaaactgtctggtaagtagatgcatcagctccttctggaagcatgacaggtgcatggtgttacactgtgtgtgggcgctgatcctggcaggaatagtcagtgacctgctgtcagagcccacggagataacctgaaggagcgctccaaatgtccttctgcaagcattacccacctggggaaatttctcatccaatgactaccgaagggtaactctgccataactctgcttttcactgtggccacctcaccacttgcacatgtttatcccatctcaagatgttatctgtggtgtttttcaacatcatcatctcagagattaaggcatcgcatataacgggagtgtttattactatgcatacatctggcatgttaggacttgtcaaggaaaattgacagcctaatagcttttttcctatatttatcatccttgatattaaaactccagttaaaaatggcacttgatgaataaagaatgctgcacccatgagcattatttgtagagtcaaaaaaaatttgcttttacataaacattaatgtacttaatttacaatgtttttaaaaaattgcaactccttagacatggtgtgtaggtatagattcttgggtggctgtgttataaattatgtaccacttttatgttctgttatttgtcataatttttcttatgttttgagactcacaaaatagttttttttttagttagaaagctttccaaccttcctaattcatatacatggcaactccctcacttctctccagtgttgctttgctcatttgtatgattggtttaaatatgtgatctcttcattgtactatacatgcttctttgagcagggattaccccttgttctctgtgcctccacaaagactattttgcgaaaaaacaaataaaacaccaatcaatgacatttttattaaattataactaaatagaaaatgtttctaatgaaacggtataacggtattttaaggggagttttttctaacagtaaacacagaaataaaacaacaagcaagcatttttaatatattatagatattaacatctgtaatatataacagtggaaaaatttggttcctatttcacaccaactaatactgtacaaaatagttattggcagctaagaactaaattatagtgaagtgataaaaaataatttaaacacattattttaaactaaacatcttttctatgtatatgtaagagaaaaaagagctattgaaaagaaataaattttctagaatgagttttgattttttccttcttctttccttctgaattctttaaatatctgggcaaataaagtattgagaagcaaatttactggttaataaagtctcaaaattgagtaattttccttctatgtatatttttttcttaaaaattttgttttcatatccttctatatacttatcagactattttgaactataaaaaatcatagattatagagtcagatattttaatcagcattactggtaatgaaatggctagaaattaagagcaacacaaagcaaaaactatatttaaaaacaactcagaaagtaccattttactatttaatatataattacttttctttagaaaactaaaaatcttcactcagtaaaactaattatctctgtaatctcaatctatatgccattgtttcactgaaatatatcacaaattaattatgtcaaactttcttctgcaatgtctcatatatagctcttctattgcattttattctcccctctttcagctgatttaagtaacttaaaataagtctctttccctccacatttgccacaatgtttctttcttcaaatcatcagattgagtggcaaataaatgttattactcagttccaaaagtactgcttgaataggctctcagtaattaaccaatatgtgatgaattgagaagcatgaaaacaaactttgtatttacatcttaattttataatgttaaattaaatatcatattgaatgaagtatattttaatgtcctacagtttaactaaatttgatcagcttgacttaatccctggaaaatgatttttgggtgcaaggcaggcatggaaaagaaacatctaagcaaaatatgaaaatctaaatgaacaagttgcaacagaaatctgactttgaaagaaagaccaattcatgagagtaatatacatgaaattttaaattcaatgtatttctcatgaaattttggttggttttctaaatatccttcatctacttgagtaaacaatttaaattttgcacacatggtttctattgaaatgggtaatcaataaatatgttagtgactgtttttcaaaagagaaacccaacaagaaatgccaatatttaatccctttgtgggcatgaatttaacttgttgcctaaacaatatactgataaaaaaagaggtttgtattaaatgccgatttcactctgtagcattgattacacaattaaaaaagaaaaaaaaaagcacctttacttaaagctcaccttcttggttgcaagaatataccagattaacaagaaaagaaaagaaaagaaacacaactgctgatatatcctagggacatattcttatatatcttatttcattatatcaaacagattttaaattgctagaactcaaaactagctgaaagaacaaaattacaacacatcaaattattagctaaatatagtgctataagaagaatattctgaaaagaagattggctgtttaaagataaaggaacatcagggtcagccgctaatgtcaaaggcaaataaatactgttccaagtattgaagataatatgcactaatagtgggttttagctggattcagtctgatgcaggtgcatgtttagcagctgtgaaagcaacacactaacacacacattcacacataaacatgcacacagagcataatataaaccagctctcttaaaatgtagagaaccgaacactgcaaacaaaaacctcaaaaactaatgaactcatgtacattcttgaacagtagctctctatctccagaagatttttcaatttctaacaatccaagattttaaagcataaatggacccatattcaggctgaaactctaggagaaaaattctttctccaaaatgcttactaatggaactttagcaaattaccttaatatttttgtatctccattttctcattttataaaataccatacagtagaacttatctcaaagccatattactaggatgacatttaaacataatatatgtatataaaacacttagctcacacttagtgctaaataaatattaattattacattattactatcccacagttgattaatagtttcagtgaagaaataaaaagcaaaattataatttattttatcagaaatcttacttgaattcataaaagcatacttgtctactaattttacagttaatcactatatttattttattggtggtcactgaccaacagagaacaattaccttcactcactagtatataattagcatttatggaaagatgggtactattttaggttagacaggaattacgtgtggtaagttttgttgttgttgttgtttatggtcagcattagtaattgaaaagattctcacagatactgtaagaatcactgactcaggcaaatggctcacatagctgagagaatatccaaatcacattcaactttaatatatgttgttctttgtattagtctggcattgctgctgtaaaaaacagcacaaacttaccgcaaatttaatggctttaaacaacacacattcattgccttacaattctggagttcacaagtctgaaatgggtcttgctgggctaaaattaggatgctagcagggttagcagggttctggagggtccggagaacaatctgttcacttgccttttgcagcttctagagactgtctgcatttcttagctcatagtccccttccttccatctccaaagccttctcatgttgccatgactctgttctccccttctgcctctctcttccactattaaggaccctcaggattacactgggaccacccagatgatgcaggataacctttctattttaaggtcagctgattagcaaacaatttcatctgcaactttaattcccttttgccatgtaacctaacacaggttctggggattaggatgtgggtatcttgaggagccattattttgactaccatctacctctcaaatgataattttaaagccactactatgttcaatgcaatttaatgtttggaagtgttttaagtatctgtataaatacataaaaactatatatacctatgacatgaagagcagtaaagtaggaaggatcatatatatatatatatatatatatatatatatatacacacatatatgtgtgtgtatgtgtgtgtatatatgtgtgtgtatgtgtgtgcatgtgtgtgtatatatatatatatatatactattatgtatacaacacataggatgagagaaagtctctttgaaaaggtggcatttggaaaaacacttaaagaaggtgaaaaattgaaacagagtttatgggggacaatttcaagcagagagagcaaaaagttcaaaggcaccaaagaggtagggtgtttgtgcacttgagatgcggccaggaggccaggacagtatggctggaatgcagtgagaaagggagagaggggaaaagattaaagtgtgaagaacaacagaggtagcacacctacagccttgtgagttactcaacccagagagagatacattcgagaagtgtcacaatctgaaaagcagcatatggctgttgtgtacaaaatagactgttggaaggcaaggttggaggtaggaagaccagtttagaagctactctaataatccaggttagaaataaccatgattgtaccatagtggaagcattggatgtgcagagacatgtaggattctgcatatatttaatataaatggagtggcaacatttactgatgaaaataatttgaagtcataaataaaaaaggaaaataattctagacgacctgaagattttgtcatgagcaattgaggaacatagctcacattcacagaaatggaacgaactatagaggaagcatgtttagaagaaaaaatcaagagttccatttttgtacatgttaatattatagatagttatgggatacctgctgtcagagtacgatctaagtttaaaagaagaaagtataaatattgatatctatgatagatagatatcataaatatcttttatcaggttcagggatacatgtgcaggtttgttgtatggataaactcatgtcatggggctttgttgtacagattatttcatcacctaggtactaagcctagtacccaatatttattttttttctgatcctctccctcctcccaccctctaccctcaagtaggccacagtgtctgttattcccctctttgtgtccatgtgtcctcatcacttagctcccacttataaagtgagaacatggggtatttggttttctgttcctgcattagtttgctaaggataatggcatcttgtcttttaataaaaggcctcctgtgttgaagttgggcacatttcttagcttctcttgaagtttggcatgtctatgtgccttagttatggtcattggtataaagaggcagtggtgtgtaccagcgcttgattgtgccattaaaataatgatatttgtgttcttctgaccttttttccattccagccactaaatgtctaacataacagagttgtcctaccagctttgctcatctacatcagcgagattaactgatacatttcttaagtcaatatatcttggggtctctttttaacagaagcttagcttgtattttcactaaatataatatctaagaaaaatatattgacaaggcagctgaatactaaatgagtctgtgtttaagggagagttaaagaatagagaaaggcactgggaatcttcagcatctagatgatctctgaagccaggggactgaatgaactgctgatgtcaatttattttcttcagacagaaataaattttccccacctttatgggtccactccactatgatcaagtaggcactgaaaagcatggcttttgccttttttttttttcctttggttactgctgtatagacccacagtactagccagaatactagagaccatataagcctatcaaacccagagttgaaagtgattatttgtcttggaagaagatcaagtcattttattttaccattccttatcttactatgcagaggccagactctttttttctttctacttggatatttaggattacagttttggtgctgaatactatgagcttcactctatcacagtcacatactgaagaacccagaagtcagagatactttgtttggtcagactatacctatttaaaaaaaaataaagttgagggacttaggtagtaagttttgtctttctagaacccacaaaaccccacaactctccatagtgttataggtcatttcaattcacacaggtatacaattaatttggcactgataggtatttaagtttgggagtttaagctaaaaatcatttttggaagaattaaaaccttatgcaaaaagttatacagcatgttttatcttgcagagatttctttactttgcacacacgggctactgagacttcatactgaaactttatagcctaaatccatgtatctttgtttctaagagtacctttattggagcactggaaaaaaaaacatatttaggtatctccttcaaatacaaggtgaattactttatacagacaacacaagagaggggaggcattagagttcaccagtctggaagccaggacctaagctctgaaagtcccaatgggccctgagcggttaaggagagcttgggtgttgatgacaggtgtaaacattcagaagatcacagttacagtgacactttgtcttagaatttatgttctgcaattagttgattttcctgacattatctttctaaagtattgtatatttggaccacaacagggcacagaactggtccctttttcttctctgacaaaggaccctaggatgaagaacaattacgtagattttctctctactattatacttggggtttcaaatctattgaggaattttggctcataaaaccttacttaataaagtccttcaataatctactgtggaaaaaatcgtatataattaaataaaatcacagacatagcttattatatatcggtgagtgtataccaaatgtatatgaatacaatttattgagccatgattccgaacacccactgaatcaggttgttctcagatttgcccagcattttatgaaacctattattcttatttgacattactgcaatataacagaccatagtgacatttgattacattccgttttattattgctttgtagcaaattgttctcaccaataagtgataaaaatgcagaggcaattgtagtacaaacatgaagacatttattcctcttttgtgttgtaagatcatccagaagcatatgaacagcatagacttggcctttatttatctcatcttgaaataactgtatcacaaataaaaaattaatatatattataagctagataagagtacatttctaagctaataaaaaaatttaaaaattatatatgttataactggtttcttatatgtaacttaaagactgattgaaaaatgtaaaatattaactgatacataaaagctaatgtcccatgtaaattattagaatattataaacaagtaagctacataccctgaatattaatgttcatatatgcttagtctgttatgatagtattcaatgtctttatagtgtgaaatattctctgcaataaatatccataagctatttcaaagcataccttttccagcaccctttttgacaaatatttcctggcaacgaggaaataaaacaatgttggttggatttatgtattcaattgctttaatatttttatttttccataattatcattaggtcatgattatatctatttatatatggtcacgtgttacttaatacctggggtaagttctaagaaatgcattgtcaggcaattttgtcatcgtgtgaacatcgtaaagtacactgtatttacacaaacctagatggtatagcctattacacacttaggagaaatgatatagcctattgctcctagactataaatccgtacattatggtattgtacttaatactataaacaattataaagacaatggcaagtatttgtgtatctaatcatagaaaaagtacagtaaaatatggtataaaaggttacaagtggtacacctgtataaggcacttaccacgaatggagtttgcagttaattataatcttgagaccaccatggtatatgtaatgtgctgttgatgaaaatgttgttaggtggcacatgactgtatgtgtgtttgtgtgtatgtaggtttatgtgtgtgtgtacactcattacttttccatttaaatactcgatgtgaggagaagataactaagataaatgacaagaatgtctaattttatctactaattaatatactttccatagtctggacaatctttctgtataagttaagtttaataaatttttgttgttgttgttgtttgagacagagtcttgcttggtcacccaggctggagtgcagtggcgtgatctcggctcactgcaacctccgcctcccaggttcaagcaagtttcctgcctcagcctcccaagtagctgggactacaggcatgcaccaccatggccagctaattttcgtatttttagtagagacagggtttcaccatgttgcccaggttggtcttgaactgacctctggtgatccacccacctcagcctcccagagtgctgggattacaggcataaactaccatgcctggccaactttaataaatttaaattgttcatatttgcagatgattagcttatagtttaattctgatttcacattaagttaaaatagttttatctttctcactatgccataaaacataataatattgtctaattttcttgtagaggctggatatgagacctttcccaagatcacgtcctttctcttcctgtgttagtttgctaaggataatggcctccaccaaaggagctggaggccattatccttagcaaactaacacaggaacagaaaagcaaatactgcatgttcccacttataagtgggagataaataatgagaacacatagacacatagagaggaataatacacattggggtcttttgcagggtggagggtgggaagatggagagggtaaggaaaaataactgaaggacactaggcttaatacccaggtgatgagataatctgtacaacaaacccccatgggacaagtttacctatataacaaacggcatttgtacccctaaacttaaaagtttttaaaaaaccgttatattcatgcttttgtcattcttttaaattaatttcctattattcagacgttatcagcactagacccatgtaactaaaatgaatttaaaattattttataagggaacaataagtcaatattattacatctcttatccttcttaaagtaaactcctttattcaaaataatgtgactatattattttacattattcatacttgacaaaacagaacagtgctaaccatttcttggtaataaccatcatctctgcctggcaacatcacagcctgcagcatcaatgtttatgagaacaaaatacatttattttgttatagatttccaactagctgttttcactagtaaatgaactcctttatttatttaggtaaggaatatgtatagtttgctctctgtatttcacaaacattctataatgggtagtaagtcaaaaataagtattaatttgaagagcccgacagtcttttttaaaagttggcttaatttctctgatgcaaacatggacatcttcattctgctacttttcataacttttttgttttttgagacaggtccttgctctgtcacctagattagagtgtagtggcttgatcatagatcactgcatcctcaatcacctgggctccagtgatccttccactcatcttctagagtagctgagaccacaggtgcctgccaccatgcccagctacttgttaaatttttagtagagatggagtctccctaagttgcccaggctggtctccagctcctgggttcaagcaatccttccacctctgcctctcaaaatattaggattacaggagtgagccaccatgcccagcctacttttcacaatttagcgtatcaatattttattaaatattttgaatggcaatatttgttcaaatgacttgcagaagccaatgtaaaatcaacataagaaataatgtgatggagaaaatggacctaaatatggaatctaaaataatctcacagaaacagcgattggtggttacagagactgggggttggagaaaatggggagatgataatcaaaggttacaaatttcagttagacaggagaggttttattcttttcttttttttttttttgagttctgttgcacaatgtggtaaatataattagtagtagaatattttacatttcaaattggtaagacagtgacaaccaaaatgagtgattgaggcataagtttcaatcactgaggtttattaagccagctttagagtgcatctagggaaacacaccagccacagataaacctgtggctatttttctaaagaggtttttgggaggtttaatatgtatgcattccttaaagtggggagaaggtacgtaggaagacaggtaggtaggcagtaaggcaaatgggtacaaccctgtgaaattttagttagtgtccagtaaatctacattttacacaagatatagtgaatgttagaagagaaaaagggagtaaaggaggagccaattatgtgcacatctttaggcaggtgaagaaatgagtcttgtttttgttctgtacctggaagacaagcttccatttggaagaggatgttgcacaattcagcttcatggctttaatttggggggtcctgagattttttttttaccttccaagagtaaatttcaaatgttctcatcaaaaaatttaagcatttaacgtgaaggataggttaataacttgatttaatcataccatactgtattcttaagctataacatcactttgtacctcatacttttatacaattataaattgtcaacttacaataaaacaaaaaagagaaaaaaaactaggaaaacattttgaaatgaaaattcaacctctgactataactctcaggtttgtattgacaaaattgagatatactaatgaagataatcaaaatattttaccccaaaatatatctctttgacataatttgaaatggctgctacagggacaacagactgaggtggctctgcaaagccatcttttgtagagaaaatttgcatctgtggagaatttccattgatgtagccaggacttctctttctaggcatttctgagatctaggagaggttaactgatagcctgacacttttaaagacctgaaaagaaacatttaccatctattctctctgagagatgctacctgtgagggttcatctatatagcacagccacttttgacaggcaggactctttctttctccctatcatcacctgtcttgccactaaaatctgatttaccagcataaatcatttggccgtgctctgagccaacattctgtttataacctcaagatggtatataagcttctgtacctcataaggggcgtggttgtcattctgaaggctcccatctgtacaggttaaataaatgtgtatacctttctcctgttaatcaatctgcctcttgtcagtgatttttcagagaacctttagggggctaagggccttggtccccacaatattatctcatgaagctgttgtgaggaataaataagaaaatctatttacaataataaacatagaatgtggccttttgaggacaatttgtacatgctttaaaaatattaaaagcaataggccgggtgcagtggctcacacctgtaatccaagcactttgggaggctgaggcgggcggatcacactgaggtctggagttcgagatcagcctggccaaaatggtgaaacctcgtctcgactaaaactacaaaaattagccaggtgtgatggtgcgtgcctgtcatcccagctacataggaggctgaagcaggagaatcgctcgaactcgggaggtggaggttgcagtgagccaagaccatggcactgcactccagcctgggcgacagagcaagactctatttcaaaaaaatatatatatatatgtgtgtgtgtgtgtgtgtgtgtgtgtgtgtgtgtgtgtatgtgtgtatgtgtgtgtgtatgtgtatatatacatagagagagagagcaataaaatttggtatagtgtctatcacgtatgggcctttcttattatttgaaaaatgaaagaactgaatgctatgatttctattgactatgagtgtatcaattagaaaataaacaaaattaacaaatttttctttgtgattaaacatataaaattagaaaaattttaaattaggaatgaacacctcaaataaaacaatagaaaataggtaatttaacaagataagatgtcaaaaaggaaaacaaaaatcaaataagtggagaaaataaaggaaagtagtaaaaaagtcaaggacaagaaatagaatttgagagctgaatgacacaaaaggtcttggaatgacaaaaaaaaaaaaaaaaaacaaggagtctgggcaggccaagtttaaagatcaataagtaaacaagtattcaaaaagaaaataaacatgagcagtacacctgggagtgacccaagatagagatataagaaaagtgtgaaattgtatgttgggagaggggacttgaatgtggtacaagctttctatgcaaagactataacatatttttcttttttttttttcaaacaaacatcagcttctctttgctgtcacatgaattccctatgtccactggtaattgaagtaaatgaaaacctagaatcagagctacaacttatgttaggagttgtaagtttcaatctattgattcttctataaaatcaaagctagaaaacatccttgattattcacattgctcattttaaaattttgatttaaagattttcttttatggtgtttaataattcattaaacatttaccaaataactacaacacaagacaatgtccagagatggagataaatcaggcatattacctctctttgaggaggctttaaacaattaagtagagagataggtggaaaattacatgttataggtggaactataaatgcatgtataagagttaaacatatttttataagtggaaaaatacacataatcaaaattgcacataaatatactttaagagtaacatgcattttacctaaacaaatataagccaaataacatgataatttgaaagataaatttaatttcctaacatttaaatgtttcactcttttaagtatttattcttatcaatattattggttgatattattactatgtatattttatggaggggaaagcagaacagaggagtaagcaacttttcaggtctacagaatgttaatatgtacttgctttctgcttaaaatcccaatcctgtttcctggaatattgtctatctttatattcaaaatttccaagattttttgttagcaggcatgtgaaaaggttagggagaagcagagacaaagatttcaggtctgaaggcaaagtaatattagcgccctcttttattaagatgtacctgtccaactatgccaattttaatttgtttcagtactctggacttagtcccaaatagtaataattctttcttacaaatacttgaggttctaatattaccaccaagccctaagttcattgcttttgatatctgtatgaaggtggtgcttccctaccattccttggtagctaatgatttatttttccaactcaaattgcaccactttcccacagcaatcatttattcccttcaataacaatcttaattaaagtttcacatcaacatttcatcctgctttagattttaaatttgtttttaaatagcacatagaaggcaaactaacagagttcaaacattacatatatatatatatatatctccaatacaattattaattatttttaagacaactttctttcatgaaatccacatccattgaaatttactatttattttagttacatatgtttaaaactctatacaatgaccaatgattcttctttacctagcttaagtaatttgagagctgaatgacacaaaaggtcttggaatgacaaaaaaacaaggagtctgggcaggccaagtttaaagatcaataaggaaataagtattcaaaaagaaaataaacatgggcagtacacctgggagtgacccaagatagagatataagaaaaagataaaaaggggaaagcttttcccctccataaaatataaatagtaataatatatgtaagtaataataatgaaagtgatagtaatagcaacattaaatatccctgttatttttttgaaatcttctaagttccaggatttatgctaagtaatttaaaaatattaacattaattcttgatttctttgaaggtttttaaatcaaaagcctgaagaaattatacatacaacttttaatagtaaactaaatttatgttgtattatttgattctatgattctatgtattcaactatgcagatgtaatcgtgtttaagttaccattttatataattataaaaaattaaaaatatctagagtgcccatatctcaaacagtagaaataagccaagtttacgctattggatgaaattattattattattattatttattttgtttatttattttgagacagagtctcgctctgtcacccaggctggagtgtggtggtgcggtatcagctcactgcaacctctgtctcccgggttcaagtgattctccttcctcagcctcccgagtatctgggattacaggcacctgccaccacacccagctaatttttgtatttttagtggagacggggtttcaccatgttggctaggctggtctcgaactcctgacctcaggtgatctgtccgcctcggcctcccaaagcactgggattacgtgcataagccactgaaccatttctaagtagtgagattcatgttaatacttcatatttacctataaattttgtatcagtagaagaaaacaaatgcaagaagtgttagaatatgtgatagaaaattaataatcatggactggaaaaatacaagtaaaaaatattttcatccaacaacatggttaaaaatatgagggtctgatttaaattaaatattatcaacaggatgtggaactcttctctcacttattgcttgtatgtatgtgaatttgtgtagccattttgcagagtaatttgaaaatatctgttaaaatttaagattcttatgtaccataaatgtgcctaaggagacacatttaagaatgtttaataggaaagacataggaaatacatattttcttcttaagaatattgataatgtattcatattatggtatataaacatcacaaaatgtagactgctaagaggaatctggtagatctacatgtgctaacatttaaggattgccaagacctgtttatgaagatgaaatgaaaaatttacaggagacctacagatttgataccagtggttacaactagggagggacccaagggaggcaaggtggccacggctgatgtgaggattttaaagccaagatcctctgcaaatattctacggggaacaggtcaggctataagtgccataagacagagttaaaatgttctcagatggtttgctgctcatgagggcttcatacacgtgttctattttcatcctcctttggaaattagatttattggtaaaacataatttccatataactacttctctctgaaagcataaattgcttattccccatgctgtgtgctacagagatatggaaaaaaaaatgacgtattttcccggctcttagggagctacacagtggagatgggtacagggtggggagaaatactatctcatatagctgacatttagagagtgtgcaagcactgttagagattccctatattaacttatgcagtcattaccacaacagatgaagaaacaaaatatggagacattaagcagtttgttcaatgcccaacagtaaatgacaaaactgggatttgaacccaaagaagtctggtgccagaacctgcctttttaactacaatcctatacagcctcttaactataactctattaattatctatacagtatagtgctaaaaaatgctaaaagtgggtataggactggaataaagaaatttcactgcatgggatggtttgaagaccaggagccgtaataaagagagagaaaggaatcaaagctacttgagtcagattctggatgacatttgattgcactgatgggttttgcctgaactgagcattcactgaagggttttgaggagagctgtgttttgatctcacctgagttttacagaagttactatgctggtggtattaaccccttatatcgtagaggcaagaaattacagcttctccacttaagagtccactgggggaaccatgtaaaaaggaaaatgagactccaagctcttgtgagaatggagagaaaacatgaaatatgatttttaagggaccaacctgacagaactttgaaagtcaagatgaagccagtggctggattgaagatgattctagcttaatggaggatatcactcttcaaatagatgggaatacaaatggagctgatttagcacatgagaaagctctcagggatcaggtaagaagttaatttttctttttgtatttagtagttcctgtaaaagttctctttggaaaagtaattaatacctggtttacagaactgaaagtattacttatttcaaattttagtgaggaaatgggcaaggaactataaaatgtaaaatatttaaaacttttttttatgtctatacccttattccatccccctgtacactacaagtcagaaatttcttaggcattcagtttccattagaaactggtctgtaaccttctacgtgatgtttctcttagagtgaaaagacctttacctacactgtggtgcaccagagtttaaagttggagagttcaattatatgaaatttaactgtaccctgtagatttcgagagatacgttttaatatcagttggtaggatgtaataccacgtttgcggcagtagtccctctagtactattctccatatacttcctatgtaaacctagtaggagtgtatttccccacatctctgaagttagatttggccaatgccatttctagtgaaatgtgaaatagatatgtctgtcgcttccagggaaagccattaagagctggtgtacaatttacaaaatttattttcccctactctggacccagtgacattcacaatggtggagaatatttttgcctgcatccttgagaaaggacaaatgtggaacaaagcttccatctcattcttattactgttaaaaatataaaagaaatatagttttaagccactgagattttggtgatttttgtcaccaccacataatctagcctattctaactgatatactaactgctgtggtttttctccttaaacttgcccttgacaggtttttctggacaccgttattatcctttctccctcccccagcccatggaggtctatcttatttcccagttccttacaaatatcttattatcctaatcatgaataaacaagtaaaaatagctttaactggttctgtgaattatttcatctaagattcagctttttatggggcagtttccaaagtaattaaaatatttagcagtttgtcaacaatagaaactagtaaatccttcctcaaggtttccaagctccttccaaatggggaaaaaggttaaatttgggagaaagtggataaagtgttcttccatgcagacatctttacatgtgattttataaggctttatacactttatacaaaattaaatataaatagtcttccccaaatatagagtttataggatatcttacagggagaaatccaaaatcaaactaggaaaacaaatacaaaaatagtagtagtcacttaaataaaaattaaatccaatgaaagaatgaatggaagaaaaagcaaataaccctagtaaatgtgcatgaacacgcagagttcttatttaatcccatcaggtcttatggtatttatcctttggggctcatgaaatggaacagtttaaaatggtcactgaccacaggcaggattagcacatttttatatttgtaacccaaaacatttagtttttggattttatcaggcataatataaaagtgattagtgttatggcacctcagaagttagaagttgtttatgcatggtctgtgataaacagaccccagaaagtagctggaatagggccgaggcaggcaattcaatatgtagacatactttcatatgctgcaaggaaaaattctatgacctcttccaaatccattgatcgcaatcccagaaaataataactgttctgcaaaatcttcctataaaatacacaatatttaaacaaccactaatctttttgaattgtacagaaaactattccatctcacatatgacccctctccttgtatatgtgtgtatatttgcaacaaattacaactttgttttaagcttggttctaaattaatgtactgtggtaaaaaacaaaaatctggcaaaaactcccattgttttaaaaatgcaactgacataagcactgtcatgaaaaatgtcatttgatttagggtcaccttacaggcaagtaatcaataaattatgtagtcaaatatgtccatctctgaaacagcccttttggcttattgtgcgtctgagagcataatggatttgttactaaattcttaccttgtactacaggatttcgcctttaataaacatgcaagtctagcttatctttgctatatagttttattttcattactaaaattgaacctatgtatcatctttcttcctatgttacatgatagatctcagaggtgttaacaagagcttctactcatgcagtgaaatgctgaaaggtggtacttttactctgagctgtttattactcccaacatacagccaattatttttgtaatcaaagaattttaaaacctccaacattaacataaatgcattagtaggtcacatttcaaccttgacaagattactgcaagatgtgtttgccaatatactacacagaactccccatctgtatgtggtaagcccttttattcacttgaaaaacaaaaagccagtagctgatattaacaaactgttgatatttcttggagagctgtgacttttttttttttttttacagtgttctggctgtaattttgaactgacttaagtctatgagcttttatatgcctgcagaattatgttttcttttctatttgccaggtgatatgcaattagagagtcttgtttattatctcatagccatatccctttgaacaacagagtgtgttaaagtacagagtatagagctactgaaaatacatattttgaattatgtttattaatactggaatgttttatatttgacacactacaatctacacaaatgtatattttaagcacaaatatatataatattcagatataaatgtttttaagatgaccaataattttatctgtataacactggataaataacacttgatgccaaactttaaaaaaaaatcttgctgtatctttatgcatattcaatttcccaataaacactatcacttcttactacaaattactaagattggttcctttctttgtcataacaggcaaatctgtagattgagcttcagttgtaacagaaattgcttttattcaagctttcctttttccctctctttcttgtcattaacctttcttgctggctaacatgatcccctcattccatgaacataacagcttggagtgttggatctgagatgtaccagctatctgaagagtataagctgaatgtggggttaggataagacttgttttttgagcttaaaaaaaataggaaggatcaaaaccaaaaacaaagccaaagattactcaactgacgtgtaagtctaaaactcgagttagaaaaaccaacgtctctccatccagctatccattcaacaaatttgcatcatatcagtgaatgagagagagaaggtttctattctcttagacaaagattctagagagaagaactgaaagacagtaaacatgttttaacaatgacatcaaataggacaattttacatagagtgactggttgaaggcaggagagggagtgctgggttattttacataggattgtcagggaaagccctctggagtcacggcatagtttttgaactgacaagtaaatgatgagaaggaagtagtcatggaaaagagttggaagaagaaagaagagtcatggataatccgttaccttatttcacctattctaaggtgcacaccttttcatattttaatatccatgaaattaaggtacatgttattttaataattgctattagctggatggtagttgtgattttgtagtaactctcagcacgtacctgttatttccagcagcatgagggaataatatcaatgccttgacatttaagctaacaaaccattttaaggactatttgaggaataaataggagttgataggagtttgttttataaaaaacttagactaacatcatctacaagattaagaattcaccagcattaaccttgtagaatgtttgtcagcagtgtggaagaaagcccaagaactaagtgggtacgcccttttgataactgccctatcaccaatgctcttaacagcacagcaaatgcaaatggagaactgaaaagtgactaccagttacattataaatgtaaggaagttttaagaatagcttaaacagtctattttgctcattattttgtattttcatgtatgaacaagagtgacgtgaaaaattcctgtctaaatgattctaatatcaaaagtctctctgaatatgtaggaaaaaagtcctaagtaacaagaagaattacattatagtttatcaactttttttttctattttaacagttcataaaatactatcttaaaatggatggtgtcttagacaataagaaatcactgcactttccaaggcactgttaaatagtggtgaacaagggtcccaacctttactgagttttctttctagtgggaaataaaaataatataactgagtaaattaatacattgttaattgtacattgtgttaatttctaagaaaacaataataaaaacaattatgcacagtgcatacaactgcttacgaggaggtagaatgtgatggagaatctcatttatattatggggtggtgtggattgtcaaaaaaaccttgtcagaggatataacctttaaactaagactttgaagcaaggggagtcagtcatatgaaagttagtaggaaagtatttcacagggaaaaaagacatatgcaaggtatattctgtttagtatattctgggaatgaaagagtgtttagtatattctgggaatgaaaagatttgtgagattgtgaataaatgtataacaatagatgaagtggtttggaggtgagaaatgaggttcaggaatttagctttggagatgttaaaatagaatatatgtcagttattccacgtaaattataggtgtacatttggatttttgagtctgagattcataggagaattctgatataatactggggaacttttgcatatgaatgaagttggcacaatatttataggtctgctagaggaagacaagacggcaaagcagacttttaaaacatctgggaaggagagaagggaatttaaagaatgtagaattacgagaaggcaggagagaaaatctcgcaacaaaggataaataacttgttgacagatgatgggatataacttatccattggatgtgactacatggaagtcactgatattttttaaaaaagagtttggttaaacaatgttaagatgaaattgaatgaatatgggaaaatgatgaccaaatgtgcagatgaatttttcaagaagtttggttgtaaaacagtgaataggtatgggaaaagtaagagcaatgagacataaattgcttatactaggcaagacttagagcaattcatcttcatgagatggtgttggagattatgccttgtgctgccttgctgagtgcagaaaatgaaaaggttcaagtagaggggaaaaggttcaactggaggataagaagtggtgtacagagatgcatcctttcctcaatttccacaagtagatctggctttttagaggttgctcataatctaagttgtattgtattgtattgtattgtattgagatggaattttgctcttgttgctgagactagagtataatggcacaatctcggctcactgtaacctccacctcctgggttcaagtgattctcctgcctcagcctcccaagcagctgggattacaggcatgcaccatcacgccaagctaattttgtattttgagtagagacggggtttcaccatgttgatcaggctggtctcgaactcctggcctcacttgatcgactcacctcggcctcccaaagtgctgggattacaggtgtgagccaccatgcccagccataacctaaattttaaattgaatattgttccaattaggagaggttgtttcaagtttgccattctcatggaaaccccacactagatttctatgccatgactcataataggaaagacttgtccctattagtcctctaaagccctgtggcagctatggacatccaaaggctgttgctaggagtcccatagcacacactaaaacttaaaggatgacacttttgcaacctagtagttttccaggggttggcatgataacatggaatttcaagaatttttactcagaaaaggttatagtacattcatttggtatccagtaaaatttagatattaatactacctattgggtacaatgaacactatttgggtgatgggtgccctaaaagcccagacttcaccactaagcaacatatgggtgtatcacaactgtactcataccctatacatctataaaaataaaaaaaaataaaagcacataaaagataagttatttgaataatctgtataatatttttttcatcaagagtgttagatacacgtcaaatcgatcacataaatatagtaattggctatagattatgtttagagggtgaaacaaagataacagatctcattctacacagaataaaaaaggaaaatgaaaacatacaacattgtggacagcagccagggatgtgagcagaaataagttggtagtatttctttgttcacggtcacataggtaagagtcacgtatttataccaataaaaattgatgtacttaatatatagcttttttaatataaaggaagtgaatcaaaaatgatcttaaccaaggaagaaaaaggaccaaggattaaagacgtacgtttatccgcatccatccattttcctcttcaggctacttgtaccattattttcaaatctttgtatggatattttaggaaatactttttttccccttggaaatagtaaagtgtctgagctccagagggtggttaaagaagattgataagtaatgactgctgaataatagaacaatgaatgttgtgaagcatttccttttcatcacgtaatcaatgagtctccaagtcaaaagctttgcagttcagaaatactatagttggagacaatttgttctagacacaggaagaaaacaccagctagtaacagccatccacttaggagaaaaatactttttctttataagaactgccttgctcaaacaacattagtattagttgagactttaccaacagataaaacctagaaagaataatttagcatttttgtcaaagatataaacactaccaacttattcctgcttctatcatttttgaaggatgtaataaaatcatatttgaaacaaaaacaagactgcttttttttttttttttttttttttgagaggaagtcttgctctgtccccaggctggagtgcactggtgtgatcttggctcactgcaacctctgccttccgggttcaagcaattctcctgcctcagcctcccaagtagctgggattacaggcacccgccacacctggctaatttttttctgtatttttagtagagacagggttttgccatattgtccaggctgatctcaaactcctgaccttgtgatccgcccacctcggcctccgaaagtgctagataataggcatgagccaccacgcccagctgtaagactgctttttaaaactacggaaataaatatatgttgatatttagtattatctaagattatgaaacattttgttttaacaatatgtacaatatttcacaataaagaaagaaggattgtgtaggaaggcatttccatttcatactttttctctctttttttttactgttttgtgtctagagtgcaatttattttaattggaggaacagatcacataatattctgtatttaaccttaactctactcccttgccccaattaagtagaaccagataaaactgaaatgcagtagtaagaaatttcaagcttcacagcctgctgaaaaaggcaaaggcccaagaaaattgtgatcttttgcggaggaaaagacaaaaaacagctgaagggaggtggttgcgtcagttggctataactaggaatgtctcggagccacgttaagcgccagtcctgacatggctgagagcataactgtaatcagcaggagacacaaacacacgcattatttttctttctctcccccttttattagttaccttttcaatttgttctgactgcatcctcaggaagaagagaaaacagatactgatgagcactaattgtctccaccacgcctactttaaacatctgatttggcaagaatttaccccagtctctgatatttctttatgtctcaatacagtgtctgccacactttatcgtagtacttttacatatacttccattctacttgccctaattaaaacatattataattgaaaggagtggtaggttgaatggtacctgtgccaaggatggaattttatagacagcaacacattttatctcagtaactagcttaattcaatgtttttccataaaaattcttttcctaataacccatagaaactgcctaaagacttgctaagcagggaagtgtgattacacaactgctgttacaagtatctcaatgccactgaactcaccaaacccctaaaaatgaagaacttagaaaaactttgctttgtgtttagatcatctctatctatacttctctattttgaaacattttctccaaacccaatccagcttcatgcccagataactttatgcctttattttgctcaatggggccttcttatgtcatcatccagcctggttctcccctctttgaccagcataccagatatttcctaacttacttcctcagtgactgcttaactgttttatccactatctcctcaaaagctgtcctatcctcggttatacttagtcaatgtgatattaatctttgtcactgtgtactaatacataagacccgtcaaacattggaagtattactctagtgagaaaaatttcataagccaaacatgagaaagtcaaatgaatttctctatgagaacagaggctttaagctaaatggggtacaaaattttaatagagaagatctttgtttccatgatatgattgtaaatgactatacaaaggacctaaccaaattatatctcctaacataagcactgaaattattgataggtttaggttttagaagacataatggtggacagcaaggtgaagatagtgacttattggttaaaacatagtctgcataatttttaaagtaagttcctggccatagatattttgtcattaataaattaaaagaaatgactggttaatgtgaaaactttaatataatatggatatattctgtccagttacaaaaatatattttgcctaacttcattaattaaaagaattcaacgttacagtttttttaggacacaaaagtataacactaccaccaaagcaatgaaaaggatgtttgttttcattctagccttggaaacaatgagaaggtttcatctgctgccctatttatgtaaataatgagattctaaaataaacagaaaatcatcaggctccacattaacagaatgccttcaagcaaaaaagcatgacagccacatatgctttaaactttgggaaacacaaatgtagagtgaggaagataaaaccagtcaaacaatcaggttctacacttaactcgcaaaagtttttttttttaagtcatttttcccatatagagctcagtttattggctagttggttggttttcattatctagaagttaaggaagtttgtcccttccatctctaaaatattatacttacgaggaggttaaatattacttaattagcatagcaaatggcaaaaatacaacagtaaataaagtatacttttctataatttcctctcaaaaaacagcttaatctttctttataatacatacaggggtacatcagtgacacttatttttcacgtaattctaaggcaaccagacagagatgaaagagaaatttaagtaccatattttccatcctcctgaaattcaggaaaggtctgctttcagaaacaacaccatttaacgtaggtcacgcacctggaatattcacacaatcccaatagaagcaagaatgattcactaaggacagaagcagggcactgatgatttgttaactttcactgagacctttgcgtgagtgaacaaatcttgttaaatttcatgccctgaacttcatctgtatgtaggattatatttttgaatttcccccgagaataatcattgtaaccttttatcaagagtgggtttgttctcagcagaggcatcaacccacccccgtaacccactcaccgcagggaataaaacaaccattgtcctatggagaagccggcaacgtgaacaccagaggactgcacctgtttgttcactgttatcaaatgccaggctgggggctacccctggtaagagggctcggacttcttaaaccacagagcaacataaactctcctgtagaaatcttttgtgtgcaaacagaagtttagcagcatgctttcttcctgggaggaagaaagagcacgccttttaccatcgggccttcaagatacattcattctttgcaaactgtctgttatgaatactaagcttcccatgagtgtccagcttcagtttaaaaggaagcaatgaaagactcatgaaatgaaaacgatatgaatatagcatcaaaactatgtctgtcttgtgaagaagtaattacttgagtcacttatagaaagttgaagtgttcttgtcaggtttaaaatttcaaattagctttctatggcatattgaaaagatagttttgcagaatactttgtcctaatctaaagctccaaaaacaatgagctaggtgtaagtttggggtgacacaaagcctgatttcaacctttaatgagatgttaagagttcaagggagtgggctattttaattactcccatttagtaggaaaatatatatgtctcctaatagttttaaataattaaatacacacagccataccaataagcaaatgaaaatataccttcatgggtacatgtaatagctcttcacttcagtgccatcttttctttatcctgccctcagtacagtttgtgatctcaaattctggatatgcaatttcacaaatcctaactgctgactgtggcaggtatctccacagatacaaacatagaacttgactgtttatctttggaataagtgtgtgtgtgtgtgtgtgtgtgtgtgtgtgacagagagagagagagagagacagagagaatatgattgcatagttcatttgtaattactcttttactctttctcttggcagtatgtttcaaaagaaatatgtatgttttaaaacataaaaaataaaaagtaatcaaaaagaaaagaaaaccaaaagggtttcttgcaagacagaccctagagcaatttgaaaacatcaaataaaacccctccagcatgttctccccatgtgatgcctttgtacatacacttcagcctgtgggcacatttcccatgacacacaccatgtttcagtgccatgttgatagatataaacacatatggattactcatttgccattctgtctattgagttccatacggttttctgtaaaattaattttatataaaaataaattattgggagccaaatatcgtttctgaccatgaatagagaaatagaattataacaatttgagtgtgtttctctttggatgtgtcagtgacacacaatgtgcatggctatgcataatagttagatattatactcatatagacatataaatgcatctgtgtatgtgtctatacatatgcatctatacacatgtacatataaatatatgtatatagagaaaaacaacatgtgtatacacacatcctctttttctgttatatatttattggctattttgctatatctctctctggtcttcttatttgccttttgctcagttccaggtatgtgtcaatatttatttttctttaggaaactttgaaataggtatgacctgttgacatgtatggatttattattacaattattttacagaaaacagattttctatttttttaacatagttatgctttaaaaaataaaataaaatgacagagtaatgttttataaacaacttttctctaagtcacagaatttaaggacttgaagcaaggatatagacataattgttaaatatactttcatgcccagcaaacaagggagacatatagtcattatttgctttctattagaaaatccatggtcttgtatccaagcatatgaaaaccatttaaaaacttttacagtggttctaagcaatgtgagagtttaagctgtcaattaccttatttacggagtaaaagaatacaaacaaacatgaagtaagtctaaacacttgtgaaatgctactaagatacctttcttaaattttcatgtttggagtaaagattctaattttagaatgcaacccccaagcttcctgtggttaccgagtctgcaaaccaagtctattctgcaggtgtctcacatctccactgttttgacaacagttgcttcacttctttttaacacactgacagagacccagccgtgttatagcaattgagctactgaaaacactatcagcgatagcctaccctttctttagaagttcaagttttcaagcaaacagtaactgggtattttaattatttttaaaactcccagaaaatacctaataaattagatcttagccaattaaaataagttatcaaaatattcttaatgcaagttcatcaagtaggaggggtaaaaaatatatttggtactgtttctgcttatttagaactaattatgaaatatctaggcattcaaatcccattttattgtggaatggagatttaaaagggagcaatgattaatgactttcaaatacagtataaaagtaatctctggggaaacaaattcttagctgaattggtagctctactcagcagggacatttgaataattccaggggaactaagaaattaagaaatgaacaatgaataggattttcttggcaccactaggaagtcttgtgttaaaggcttggcaccactgttaagccttggcttaaacgcaatatttaaaatcaagtaaattggttgtgttgcccagttcactttccttttttccctccccaaaagtcatcaaaagtttttcctttctttgttttgctattatttagccttagcaggaaaacaaaataatttatttttaaaaatgaatctatctttaatgacacatagctaagaataaacacattttgttactattattatagcacgttgttatctctatgccagaaaataaatacacacagaacaatcaaaccctaatagaggtccctagatatgcacatagagttgcattttttaattaaatgcttgaacttcagttcccatgtgctcagaaagcaaaactacagcaccgttctctgctgaattggaaggggtaatgtcatgtcctcacttgttctaagcagaaaacttgaggactaagaaaatgtgactcacattttgccttagaacttttccaagaagataggtagtaggtaggtattatcaaataatgaaaggaaagaaagaaaaaaaaactaagaaaattattctttcgtaattgaaaactcagtgcaaaaggtattaggtgatttatctaaggtataagtggaatgagaatacgaatcttctggttgctagtgagcctagactactaaaatcaaccatatctgtcaatgaagaaccaataaagaacacgttttacatagatgtggcaaggattaaccaataaattaatattcttaaatattgttactctattgagaactgcataagaaaagtggacacaagaagggaactaacatatattgtgttctaaacactatgctaggcagtttgcatacattgtttgcatttcattcccattttcagatgaaaactgaggcacagcacataagtgattgtgactgtcctttctttgttgcagtgcgagtattaagtttcaaattgtcaggtttcaaaactcaggcttttttctacaacttcatgttgctagggctagacgagaatattttggaaatattgtttttataatctagaaatatgccttctcatctagaacacataggctgggtttgaattcaaataataaatcaaaattctcaggccaaatttaaatttctgcgttaagaatctttcaagcattttatctctgagctctgtttttatcactttgcccttccaaaaccatttctgactttatgcgtaagtcttagagtgttttttggatacaagagctacttaattttctgattgttttacattttttcatgggtaaagttctaatcagacaactataaatgacaataatcagagtaaaaaattatatacatttatggattgtcaactgtttgccctttgtatctcaataattttattattttttccaaaggacattccctatttcaccagctagttgatttaaatagtcatttgaaattataattagaaatattttagaaagaaaaccatttgaggggggagtgtccatcattctatgtttatctatacatgtgatatttagaaacacactcatggcttaaaagttcccatttctgttaatttgataattatatattaccattgatttcctctttaaaaatacaaaattttgtaattccaaaggaaaatgtttcaaagatgtctttggcattgaatgtttcttactaagtcatattttaatggattaaaatgtaaatgaactttaaagttacactaaatctctccctgatttaaattatattagacattaaaattaacatgaaaatggctccataaacactattgttttaaatatttttacattattttatatttaataatgaaccaaaagtaacagaagtcactgtgcatagtaatagtcttaaatacataaaacgattgaatagttacttaaattatgcactggtgatcttcaataaaatcacaaaggagttgataacctacattgtgacccctgatgtatttattttgcacaagtgatagttaggttctcgtaatttttaagaggcgcttgagccaagacactaattcttgattcacctcttttccctgagcaccataggactgcatttgaagcatgatacaattttaattacaaagatttatcattacgacatgcaatttctaagtacgtgaaatgacagtgtaatgcacagatgtgaagttcagccacacattcactatgtgaacaatggtatcaatgacacaggctgcttccttccattctatatttctacccatgctttataaaagatatatctataggtatgttaagtactgcttcattatcttctccatcctttccttgcaaaacatactgcccagtactctttgaacaagactatgaaattcatatcaaatttgataatctattgtagatatttgatgactttagattacaattcggttacacatgaattatggcatctatattgtttattttcttcccactgatcaatgaaaatgtatacctaaacatatatagattggcatatgttttctttaaatctttttgttaccttcctctttctagtatcttgaatcaaattatatttttggaataatatagttgaaaaaggactcgactaacagtaggacaagaaaaaccctcatcttaagtaaattatttattctctctgggactcagtttcgaaatgagagaggggttagacgatctttaaattctctcttaatatcgcatctacgatcctcttcaactttgcttttatagaagaatagattaagagatttttattgctctttatttccaaaatatgtgctaaatttaagtgtagtgtattctttgatgtctaagtctgaaatatacttgtttcaataaataaaatgtgagctcaaaataaaacaacataaaatgtgtttatcttaaggccatacacaaattctggaaataattagttagagggtttctaaacctaaaaggaattacatgcgtttcaataattttagagtctcctccatctttttatcaaaagtaaccccgaatatgttactattcttcacaaagggaattgagtctaataattattaaaactaaaatatatattttataaaactctgctgtaaatatgtacaaaaccaaatgtagtttagggaggcaaaaatcacttactgtagctatagaagaaaggaagtcataaatattttatttaaaatatatagatcaacttagcctgtccatttatacttggatatttcaaaatggtatatatttataccagttgccaactagggagtaattttagttagtattctggtccttaaataaaaaattcaaaaagtggagtggctataatgtatgaataaaattaactataaaatcacccttctaatatcttcctttaataagataaaatatgattttcatgaaatcagtaattagagtcatctcatagacttgagatctttttcgagcctgccatttttctcatattgattttccttccttccacctcatccacaaaaaattctctaaaaaataaatactagagtaataagatttatagaagacatcaccccatgagtaacaaaataaaacacgcttcaaatataactaattgtctttttttgtcttctagtgttaataaagaaaaggctatgaagtccgtgcccaattagggcatttcaatccactctgttattatactttattattttagttccctgtgtctgtagaaataagcttaagtagcctgatagcatacttttcaatgtaagaaataatttaatcgaattatacaatctgtatctcttttagaatcatttcatttcctaagtaaaaaatctacactaagcaaagtctcattcagctaaaaaaaaaaaaaaactgccttgaagaggtgacacctggaccacatgaataattttatgcatcccctgctcattcacacatagcagaggatgacaaaagtttagtgtcatgtgatcccctttcttctcagaatccctatagcattgtgataaaaagaaaatcagcagttatactacctagcttcaaatctgaactctataaattattgtatgccctccttgtggtatattacttaatatttttaagtccagtttacttatcttcaaaatagaaagaatcatagtaacctacagtgatggttaactttagacgtcaccttgactggattaagaaatacccggaaacctggtaaagctttattttagagcatgtctatgaaggtgtttcagaggagatgagtttgtgagtctgagtagagttaagtaggtaagatatgctctcaatgcgggtgggcaacagccaatcttctggggaccaagaggaacaaaaacagaggaaaggtgaatacattcatctgaagccagtacacactctttctctcttgcgggacaccaatttcaggctccctggtctttggactgcaggacttagaacagtggctccctgcaccctaaggcctttgatcccagactgagaggtacaccattagcttctctggttctgaggccttcaaacttgaaggccaggtcaccagcctccgaggtgctgagccaggtcaccagcatccgagggtcttcagcttataggcagcctgttgtggaacttctcagcctccataattgcatcaaccaattgtcctaatgaatccttctcaaatagctattatcgttatctgtatctatatcctattggttctgtctttctggagacccctaactaatacacctactaatcgtggttattgcaaggatgaagagagatcatatttgcaaaccacttctacatagtaaatacttattaattatggttgttattattgttattattaacaatagtatctctatcctgggctgtactatgccataaagatactttgctttctacatttattatcctaaaaaggcaagtcatcaaaaccaaaggcacaaagcctaaatgaattctagttatatgaataattttttaaaactagtagaatttattattgtgttcttatttgtataccagcagatatataatcctacccagtatcatcctattcaacattaaagcagaaagttcagagaattcagggcaccatcaaaatcaaaatgacatacttatttaccagaatatttgccagaatattctgagaccgccacttaaaaaaaaaagaccaaattaaaacttgaagtccttctatttcatagtaaattgaaaatcaaaaataccctttttatatcagcttttttcaacactactaataatataaaatcaaacctttgattttcaccacagagaaaatgaaactgagtaaattgaatgctcttagaaggaagaaaaaagttatggatcaccatttttcacttttttcttataaatattcttcaaaattgttatagtcattatgattcgataacctaaataattttacatggcttacaataaaattatagctagaagatatgaaatatgttatacagacggatcataaaatattaaggaagaggggaaaatagtaagagagctagaataacttgcacttctggtaaagaagacagatcctctttccatgctgatgtataataacaatcttcagatctatttgacatattattaagagaacaaagtttaagaaaaactcccaaaataagtattttttctgcctttgaactatatttccatctcttttccccgtagaagtgataaatcaactagatctcaaaagaaaacaaaaacaatcattaaaatttcctggttagtaacatttattatgccaaaaagtgttgggccatgcaaattctcatttatctatttcctgatagatacagataaatggaaaattctattcatcatttacaaaacattgaccatttttattgtaacctattttatatgcttccacagtacacagtttcaccattacaatagctatgttataattctagaaaagtaataagaggtatattgaacttctagcctatttgaatgtactgtattgtattaattctaaaacacatacagttttggatctaatatctttaaaatcctggttccttgtacaatcttttacatttatgttggtgcttttactttttctctttttagaaagtgtggactacaaacaaaaacaacagtttgtttcctacaattgatgatggcttaaatttgttgaaatatggcagatagctatttgagaaaacattttataaaagggtttttcgtgttaccttgttattaaataaatgctataatttttttaaaaaaacttttaacatgaactggggagtcctaaagataatcggcagtgtctattctagaaataattcttaacagatttttcagaataataataattatcttctattaacacttacttctttcagtgaaaccattaaagaaatagactttttctattagtccattctcacattgctgcgaagataccacccaagattgggtaatttataaagataagagatttaattgactcacagttcagcatggctggggaggcctcatgaaactcacaatcatgggagaaggggaagcaaacacatccttcttcacaggccagaaggaaggagaatgaatgagtgcccagagaagggggaagccccttataaaaccatcagctcttgtgagaactaactcactatcatgagaacaggaaggggaaaaccaaccccatgattcaattatctccacctggtccctcctataacacatggggattacgggaactacaaattcaagatgagattttggtgggaacacagccaaaccatatctctttgagacccatttctaatttcaacagatacttatactgtggaaactaaaggtgaaagtaaaaaatttcatttttaaagtgtcatttatctgaccaacagaaaacccaagtcatagcagcttaaaacatatttagaagcaatgcatgccatccagaaccctgctgactcaaatataaaatatggttaaggcccaaatcaaaaatgacacattctgtattctacaatttgatgatataagcctaatatgctttcaataattataaaaatacactgtgtctatttttttaccaaaatcaaacttctcctcaaaaaataatcacatttatttccagaactgcatttaatgttcaatatgtacttgataatttaacttttataatcatcttacaactgagcatccttgttatgttcatttgaagataaggaaactgaggcttagaaagttgaatcatttgcctcagaatagaatttgactcagggagcccagattctgagcctgtcttgtgattctccacgttattgtgcttgtaagtccttgcctgctggattggatttagtaaaagtctggtccctttagtgctgcactgtccaatatgattgccattagccaaatatggctgtttaaattaaaattaattaaaattagataaaaataaaaattcctatcttcattcacagcagtcttgttcagagggctcattggccacatctggctactggctcctctgttgtgtggcacatattgaatattgctatcatcccaataaagttctattggacagtgcagcttttgagaagaatagacatgcttgactataaaaataataataataattggcttcacatggcagacggagggtaaatatttgtcagaaatatagtatttactgagagaagacaagcatgtagagataatttagaatagctcatatctcagcacaatgacttgaatgtacaagtagaacaaaacaaagctaataaatatttgaattgacattactttccaaaagaatcctaaacttttaccagtaaaattaagtctattaataaatgtttgtgcattacagataagagtttagcaagcaagcttgatttttaaaaagccatagctgaatgacagtggctataggatgagtaatagatttttaaaaaatcaaattcagtatttacaatattgttgtattgcacgtttgcttgtattttattgtcaacttaccattcatgatatattcaagtattatataatgatcaaaacaaattctttctaaaatacagccttaagacctattgctcaagtttggattgtttacttttttcagccaatttaatggttcactgacaatagttttgcctgaagaaattgtcttaaacaatttttgggagtgacatatgaagaacgggtaaatagatctagattccagcacaaggttcacctgattagccacaagaccttaggcctggtttccttagatgtaaaattataataaagatatctgccaggtcagcattacagggctgtgtctgaaacagatttttttttttttgaaaggaactgaaagcagtttgcaaggtgcaaacttccataacatatgggatattacaattatcatgcctttggtaaacgctggaagagaacaacatgtagcctcatttctgaactctgactgagggtgttaggttctgccaagcttgaggctgcctcctctaactaaacttgatgatgtatttacatattctaaaaaattactatagacatctgtcaaaaatagcatgcactcttcattccctctaaaatatagatttggtggccgggcatggtggctcacacctgtaaacccagcacttcggaaggccgaggcgggcggatcacgaggtcaggagatcgagaccatcctggctaacatggtgaaatcccatctctaatagaaatatacaaaattaactggacatggtggggggcgcctgtagtcccagctacttgggaggttgaggcaggagaatggcatgaacccgggaggtggagcttgcagtgagctgagattgtgccactacactccagcctgggccacagagcaagactccgtctcaaaaaaaaaggaaaaaaaaaatatatatatatatgtatatagatagatagatagatagatagagatagatatagatttggtttattcttaaatattattcctactgtttccagtcctctgccatgaaatcagaaagtgcaacaatccagtgattctagccccagcattgttgtgcctcccttggtaactgggaatggatgcagagaatttttcaatactttgcagttcagggtctgaaagccagatgaagctaatgtcctggggtaagggtggagaggtgggtattgatatatttactgttttcctcagagcaaaacgatggagccattgttgtattaaaactaatcaatttctagtactacatttgggactctgaggagcaaaaatgttcctctttttctaaacaccaaagcaaacaagcatgcttcctcaatagatgagctttaagcaagggggtttgtctcccttatacatttttttccttaggatatataagcttcctctcttagggaagggagaagacagattttactgtatcttaagaaaaagtaagaatgatcacaaaggtttaaggttccaagtagggaagtttcctgagaaattccataatgctaggcttcccctaatattttctaaaggatgctctagggattaaatagaatgttcttcaaagagtgaggcatctttaagattcctgaaggggtcataaattaagggagctgaattatatgccctgagcagatcatcttgccagtcatgactgaaaacatgtgagcagaggagaaaggatgattctattccctgaacgcccaaccccaccacttattttggcttatttctcctcagatttctctccttattatctctgattcttggtacagcaggaggagaaattctcatttccccttcattcagttctataaatccactcatcagttctctaacgaatcagttgtctgagaataagtcccagcaaaatttgctgaaatggccattataatctctgatcccttaattataacatttcctcttttcgaatatatgtttctatcgactggtattaatacattattggagttctcctttttctagtcaatacacagtctgacatgacaagcaaacaatactctttaaaacactgatgagagtatcatttccagaaattgtggacctgatctaaaaatggactcttccgaagaatgtgccactcttttcactgattctctctgactcacttaagcttcactatagattagttttgatctaatcattttccaagtaatttacccttaagctaagagtactcttagatttttttttttttttggcggcaaatatcacaatatgctgaatagatcttctaatgtaaatgtttgtagtacttttgttaaacattctgtttaacaacaatccctgaactagcctggttgaacccactcaaatattaccaagacctttcacagggtagttgaagaatgcttagcaactcttgtgtaagaaaaagaactcagaatgaatatgtctcttgtgtaggtcaagacaaatgtcagggccaataaaggatgaaacatgatgatggagatttgaaatgaagggctggggcaacaggtgcttggcatgaaacactgaaagacaggagagaagtgctgtgaggtagcaaagacagcactcttcctgagagtagacaaaggccagcctcaggcttctcatcaccagagaaacagatcttaagcacaaagtagttagaagacacactgaaatttggaacacttttttttttttttttttgtctaaacaggtcacacccaaagccccaaggaaacaacaggaatctatccgaatacgcagaaacaaatacaatagttttctcaatgtggtaaaacaaaggaaaactataaacaaaacagatacaaggaaagaacactaagatttctaaacacccccaatgtgaaagatgctttaattgacaagttccctgctttctttctttaatgctcattacaacactatgaggcagaattttcttcacagttttcaagataaagaatctgagtctcagagagacacccagactgtaggtggtaggccaggtctttgcacagagattttttctgatttcacaatttcatatcactctatgacatatattgagtcaatgacaggtgacttgtccttttcgatattaggttatttatttgaccataactgaataatgccaaagaggcttgagagacttaaatgtgaaaaggtactacattacttggatgtactacttaaattaataacttatgcatatttgaaggcagacattcaagtgtaatgttcagatatcacatctttcaaattttacaacatttacatgttgtagtttctggatgaagcattttatttatttatttatttatttatttatttatttatttattttgggacagggtccctctgtgccatccaggctggagtgcagtggcatgatcatagctcactgcagcctcgaccttccaggctcaagagatcctcctgcttcagcttcctgagcagctgggaccgcaggcatgtgccatcaagccttctattctatttttcatctaccagaatccagcaaacttcatatattattttcattactattgagggcttctaggtataacttcggtattctactttttgttttaaatttttgtttgtccatacctcagataataatcaaatcaagatgatccagtacacagttaacaaaacaattacaatgtccgtaaaatatcaaataaagactaaaacatatgaatatgttggtctgaaaatatatagcgtattcagctaatttttggaaaacaccagttgtatttctgtatcatcccaaatatcgccttctctaaagatattctcataatttataaagtgaaaattcaaatatctaaggtgaaatgtagtgtgataaatataggtatatgtgtattaaattcgtacctaggttatcattgcatatcaagatgaaaccacatttatctattttatatggatatacataaaatagatatgaacttaagcatttatctctccatttaagatataaacaaaatagataagaacttaagtatttatcttcccatttgggatataaatagatataaacttaagtatttatgaaagattcctttatatctacaatataatatatagattaaattgtatcacattaccaaccattagtaacagatgaggtgattttataaattatagaagggagaaaataatagtgggttttatggcccatataattccttttagggtttggccagactagtgactaaacaagtagaagcttatagaattaattaagattgtatatatactattaaatgtcgatttgaataggaatgtttggttaaaaaagaggtgattaaaaaaagtcagcaggacatcctcatcaagagtgattaataagaaccacagccatgtgcaagtgaccttaacggaagacatgatgtcccctgtccagctatggacttctctgatgcagtagggaccttcccaatggcctcaagatagagatgattatatgactgaagggatgcactgatggaagtataacctctccactggcaagaagaaagtaaggcagtgttaacaggacacctagagcatgccaatgtaagttcctcactcctttatagattgtgtggcctatttttagtctaggcacctgcctctttccccctctacttatcatctaccctgtgcataatgagaaatgtgagaagcagcagtaaaacaagtttttctatttggccagaaaaataggtttaaatccatttattgtctcagtcacaaccaacatgaaagtatgtaaataagatctgcagtaattttttaggccatgcagcaacttttggtgaacattaagctagttagtaataatttttaatgtgcgaattaatctgtatatgtctaagtgacatccaaccattagctagtgtataatgacagtcttcatgttaactaatatctcttttacacaaagtttgcagaaagctaatgtgctgttctgaacacacactattctaatatcaaacagtgaaaaagatttaagtagaaacgcaaaccatatatatatatatacacatggttacactatatatatatatatacatggttacactatatatatatacacactatatatgtacactatacatatacactatatatatacactatatatatatactatatatatatatatatatatactatatatatatatacacacacacacaaaaaaaaagaacacttaaagtcttcatctcaaaactcttggttacaacactctgtacacttcccatccccataattgttactggttatttaccctgtcgaaagtacttaaaaataaaattttgcttaagaagaaaattcatcacgaattattattgtctttttaatggtttatcattatacaaagttgatgtttggcaaaatgattatagaaaaactttattcccagcatcttccttatctttaagtcattttatacccaagtttctatccaggatcccagtgtattattttcattttcacccgaacatgcagtgtatttcttgtcatgaaagcaaaaccttatctgttcctttcccatcccttcctttctctctgcaagatgacagatgaataaaaattatttgcagcaaataagtgtgaagaattcaactggatattgtgctaccatttcttggtaacataccattaattagagtagatcttctcaaattgtagtaatcatcaacatcactagagggatacttaacacacaagttgctgggccccacccccagagtttctcattcagtaggtttcaggtgaggcccaaggatttgcatttctaagttcctggatgatgctcatggtgatggtccattaagaatggagttaaaaatgtaatacagtatggtagattaggcagtgaggtatccgactaatcagcagatttgctgtctcccctcattttataccaggtataaaaaattaaggccagtccagtagctctgcacttaatagaatataaaaatgttgttttaaaaactcttgctttgtataacacaaaagcaagcaatataaaacaaatatttttccgaagcacaaaaacaatcttacctgaacttaattacggcacttatttgttgctttaatcgggttacctagaacatttagccttttaagattttgccatagagaaaattttatcccatattcttccatgtgaactgttaggtgtcttctatcatttcttgcatattcttgcacacaaacacaatcatgcatacatgtaacttctgattcttacaattggagtaacactatcaaccagaatacctaaagttcaatgaccctagactgtttcccttacagaataattttggcacataacaaccacctaataaataaaatatctgaaaaatgttcatattagcctaaatttctaccattttgttgcactttcttcaattcatactcaaaaaaattaataacttttgaatgagtatgtatttttctaaacaatcaactcattctcttaatcacttattaattatccatttgtactatggcaaaagaaaatctcacagcttctaggcaaagtgaataataatattcttgaaataatagtgttatattttggtatgcacaagttaaacaactgtcacaatcttaagtaatacaagttatgcacttactcggtatgaagtatgtttaaatgtggcataattttgattgattaaataattctgctctaataatttagtagtactggtattaaatgtgaaaataaataagggaactatttaaagactaattctctatgtggaaagatttctcaaacagcacatcttatggaataataacaagattccagtattatacaaaagtttgaaagaaatttattcatttttttctttactataatcagagggaaatcatgatgaaaacacaatgcttcctatgcaggttttaactggatcatattacagtatttttagattcctaatttcaatcgttcaattgttctctacacatttcatttccaaaattctttctcctatcattatttctatataagtagcaatttagtaaaaaaactccattcttcagtaagaaaactatctttgaaagaaataaaagtgaaaatgttgatgaaggaatctataaattctgaacaatttgcattcaccattatttcatcaactctatagcaatcatgtccaaaataaataacacaatcagtattcctttcttcacccaaaatatcccaattttatttcatatgtctggttaactataaagctatgtctaacttaaaactagaaatttaatatccacttcaaatataagaaacaaatgatttcaatattctgacaacattcatcttgctttttgttatattctaaggacatatctctaaactgcttaatttttcaatgtcaataattattaccacttattgtactcaaagtacatataaaaccactacaggtttggatgcaaaatatatagattattttaatttatagtaaattaaaagtgtaaactcctttatcctacagttaggtactaattatttactaattagctctctttttttttttttttttttttttttttttgagatggagtttcgctgttgttgcccagggtagagagcaatggtgcgatctcaataagcagctcattttgattacaggtatacatgaagtaaaattcatgaagtaaaattcattataccaaaaagcctcccacagaactttcatgcaccctgagctatgtgaactgaaaagtaacagtgggatagcaagaaccagcttacaaaataaattcctatcgagtgtttttcacagaaggatgataattttaggttgcttacatcatatatttccaatcttaatgagaaaaacctactctgatgatctgatgttattgaagtattctgagaaagaattgctgatgggatttagtgagctactgaataagagaaatcaaaactgtataaattagatatattttctaaaaataaggtgattgtgcagaaaactaaagattcatggaaatagatataacagcttggatattactaagcgctaatgatagttatctcattattgcaaggatttgatgatatggtccactgttcacctgaaaccaccaaacacagcatgtttcatatctcagttttcagtcacagagcatttccagagtttactcctgttcagctgagatacagtattatggtatccttcacactaaacttacaaaatctataaagaaaagcaagggcatcacagggcatcattgcttataaaacaaataaatcactgatatttaaatgccttagagtgttcctcaatgtaacaaatatgacagtaaccctacatatacaattgccttatattgataatgaaagcatatttgccattttggatatattccttacctgtcaagttctttaatccaagttcttgaagtccaaagtttccatcttttctgtagtttaaaaatattgccaaggcatatcgatcctcataaagttttgtcccacgaataatgcgtaaattctccagaggcaggtaacgaaactgattaagagccactaacacgtagcctgtgacttctcgaacagactgaaaagacacaaacagttgcctgtgttataaaacgaatttgtcactctgtatatgtagcaatttagattaaaatgagttattaaactctaattttcagtttttagtttaatacattattttccatatcatattctaaagaattggcttcataataaaagatcacaaagggttagaatctcatttgaagtataagttgtgtttcttttaaacagttatgaatgtgcttatactaaaatgatggattttgtttatgggaccttcttcatacctgagatttgaatatagttaaaggaataaaggtcttgcttatcaacagactacaataagttaaggacacacaaccatcagtcaaactttaaataaaaaagcatattggtgagcctaagtaaaacaaagccatgttagtttgtaaattgtaggataggtttaaaatggctctattggtgtttggtgctatatttatcaaataacaattgccctgtacatctctagggaacacaaacataaaaaacatgtattaaaaactaattgttgtggccgggcatggtggctcatgcctgtaatcccagcacttctggaggctgaggcgagtggatcatgaggtcaagagatcgagaccattctggccaacatggtgaaaccccatctctactaaaaatacaaaaaattagctgggtgtggtggcaggtgcctgtagtcccagctacttgggaggctgaggcaggagaatcacttgaacccaggaggcggaggctgcagtgagccaagattgcaccactgtactctagcctggcgacagagtgagactctgtctcacaaaaaaaaaaaaaaaaaaaaaaaaaaacctaattgttgtctataaattcattccaaccacatttttaatttttactgcccactgtttaaatttagttgtctataataagttaattatttgagggtttgtgagacattttaaagcaaaacagtgtcatgaagaaagtctgagtttcatctaaatattttttcaataaaatgatgataaatagttgtcagaatttaaaaaaaactaaaaatgataaaaaaaatactcaagtatttggtattattttaataccaatttcatgttattctaactaacccttttcatttcagatgctccaaggctgtttttggtacttccccccaccctgtctattctcactcccttggtgatcttattcagtttcaaagttggtgatctccaaacatttatctctatactttccccaaactccagatttatacccaactgtttactcaacatccttacttggatgtctagtatgcttttcagatacacctatcaatggctgaactcttttcttcctccacccctctggcagccttcctcatctcagttcaggttattccatcttttctgactttcaggccaaaatttcagtcatctttgactctcctctgacaccccaagtgtgatccatactatttgttctacgttcagaatgatcagaaactcaactacctcttacgtcatccatggctcccacctgagccatcatcattcctcatctaggttattgcaataggtctccttgagtctattcctgatccctatggtgtattctcaattcaggctagccaagatattttaaagacataaatcaaattacaacacttcagtgcttaaaactctgaaacatctcctaagtcactcagagtaacagacaaaatacttttactgatgtatcaaaatctttatgccattcagtgcaataaccactagtcatatgtgacctgagcaactgaagtgtagctggcataaatttagatgtgctgtaagtacaaaatacactctggattttgaagattatatgatgaaatgataacatttgagataaattaagttaaataaaatgtattattaaagttaatatcagttgtttctttttatcttcttattgtggcaaaacattttcaattacattttatggctcttattataattctgttggaactgcagtgtatgatctagtcatcagttctctttcacatgaaaagtatagttctaccttaaattgtgcattatacccttaaaaacctgagtttcctttcatcttgttatcttcttggcaaactccctcactaccttcaagtttttgctcaaatatcaccttctcagttgaggccaaccctgataaacctgttgaacactgtagcccctacacttttacctgcttcaattctcatattttcccattacttcttaccttctactacactatatcattcatacatttatcagatttagtattcgtaacctgtctctttttcccagaatatagccctataagttcaagcactttggtttgttaacttgtgtgtctcatgtgaccaggagagtggcagtaagaaaccaacaagtatcactccggcccttctctggccacacccttcaccactgtacaatgcctgtggagtgaagaaaaaggcccatttagattctgcactctccccttccagaccctgtgatcccagaattccctttgcaaataaccccaagtctttacccagaaactgtaatgtcatcttccccagttccatccccagagagcagattgtgccaccaatgtgcatacatttaggaaggaataggtggtccaggtgtcaatgtctgatgggaaactgtacagatcctggacatgtaggctagagtgttcaaaaacttgcatgtaagacctctcacaatacaggatagaagtgggtggaagagaggctatagactggagccacttctctccatgccaacatattcctgaggactccaaaagttctaacattgtacctggccatccaggttgttataaagatatatctgtcaaaatgggaaaatataacattttatttagtaatctctagttggtttataataaaaaataaaatatgtgagcctctattcagactctttccccccagtcacacaattcttaggaataagcatgctacaaataatcaatagaagagtagaatcctaatggagcaaaagtggagaggaataggaaagggatatatggaattactcatatctggcatcaaattgggaactctaagccactatgagtattcctaagacagtgagtgtcttggggtgaagggataaatgcctaggacaatagaaaagaggggtgaaactcagcagtgatatgcattgttcgtacacagcaatttgtttaaaattgcaccgcgtggaaaagtctagctctagggctctgtaattcctccttcaaacactgttctaatggttgagctgttacctctttgaatgcccttatctacctctttgagctcttaaagagagattatacatacattctgacatcatatggtctaaaaagtaaaattcattcattattaaaaagttttctttaaacttgaatacaataattatttagtgattagatcacaatgataaatgtgttgatggagggtgtattatgactcttttgcctacaacatatgataagatccatcattccaaaacaaacttatcattagcttccatcccactcaggaagtgactcttcttatcaaaaagtgtaaaatgtcattggtttatctcaagatggagaaacacatttataatgtcaacagagaaaacacagatgaagcatattcaggtaaaagaagaagtttatttgtaaaagagtaacattaatagtaatttttcagtgtcacttggcatggcatttggatcacatattaccacaagctgcaaataatctgcaaataataagtgctctagaatgtgtgataggtatgaaccaagaaaaatgctgaacacataaagaaggaccaactaatgcagaagaggatgctccaagtgctcttatttactagaaaaagtaaaatataactaagaaaatctttgtatttgcatattactaaatatatttatatttgaattaattgtgttgtaatatttacatacttctcatttcagggtgtgtattacattattctcagacacatgtgtcttgtcttcatggaaggtcagattaaaagcaatagctactcccttgtaaagattctagaactggagggatttgctgttataactgaggttctagtgtccaaaataagtctctgtcattattcattctgtttattaccctctgttcttgcaaaatagtatgcaaaaactaagcattagcctaacaaatatccttttcttatgtgaactctggacatcattccatgttaatgctgagaatgcatgtctaagccattttgaacaaggccacccataagttggtccatagtaaattattttatgataatgatagtgaagatcctatttatcttaattgttacgtccctttctctgacccagaaaaataatgtaaataatagaaaaaaaatcatagcaaatctctcaacccaagatgtgttgctctaatcttttatatgtagagggacacatggaactgaagcattttaaaaagagttacaggagataaatataaaattcttatatctaaaagaaacacatcatgccttattttggtctctgtattctggtattcatagtcacattctctcaggtattcctatagtctttctgtgaacaaatatcttgaaacatctcaaaaggaaactccagtgcagatcatgagccatgtgtactgactacaaataaaaacaattacaggaaacaagttaataatggtaggagtgcttaatgatgaaaaagagtaaataacgtggtttgagatgatattggcagatctggataaaaagtgaagagatatctaaaagcgtaaattatatgttataatgtctgataaggccacacaaccatgtcagttatccattgttcctctcctttcagccatcagaaagaatctcagtagcacaacattttccactgttttagaaaattttgagagaataaaaacaacttttaaacatatggacttatctatgggaaagtataacggtaggaaatgtgggcttgtctgccaggcaaagttggactccaaacctagcctttgtgcttactagctttgtggctttcatcaggttgcttaacctcatttagcctcagtttcttcatctttaagaaagagataccaatatttctattataaaaccgtaataggggttagaagatataagaaacctgtctggcaaatagtaagtatttaacagatgctaagtattacaaatattatctctgataatagccaggcagatgaactgcctgcagacaatctgagcagaaaaaaaaaaattataatatcattacataagaactgttgcttttaatctctctgttatgtaacctttggtacatttatatcttgcttatgcaatttgcaatttattcctaaatttcagaaatggttccttatactttatgtgtgtatattatggccctaaatatagactctggcgctgaacatttaataatggctgtggaatggaatggaatcgaaaagtggaaagcaatgcttaaggtctttttagatatcgttttccaaggaaaataattttatgaacttgccactaatacaaaacattgtttgaacaaaacaattatgaattatgtccaaggaccacagtagtaaacagaaattataacaatgccctaggggagggatagcattaggagaaatacctaatgtaggtgacgggttgatgggtacagcaaaccaccatggcacatgtatacctatgtaacaaaactgcacgttctgcatatgtaccccagaacttaaagtataatttaaaaaagtaaataaaacaaaataaaatctaatttctgagttactggcgatgtctttgatattaaataaaggtttttctccaaaaaaaaaaaaaaaaaaaaaagaagaagaagaatgccctagcaaagacaaaatcctgactctggttctggctcagtaacagtttagttctaggaagtcatcccattttgtcaaccaaagagtgaatatgctcctaaagatatatcttcctcctcatggtgtaagcttccgctcagtaaaactgattgatttccattgtcaatgtaggtttctacagttgctttgttcaagtagtaaatacaatcggatattattaaagccttgaatgcttcaaaactcttctagcccaagggacaatttgttttgcttatgacatttgatgatagaaatcaaaagataatggaaaacaaaaaaataatttcccataccatattagcaataagtccaggaaaaaaatcatgattttttaaaaatgacaacaaattttataagcatttctcctgcataatattctagagacaatgtgaaatctgcagttataaacctggaattttcaatggatgtccctcaatcaaagattagatgggacggtattggctcactgggttatccttttacctctagatcatttcagaaaaatcagtcttcactatttttacatttatgcttcattccacaactcttttaatagctattaatttttctgtatttgatataaatccctaattcttttcttcttagttgactttttaaaaaatttgatccttaatagaaatgaagactagttccttaaatgtttcttcatttaccttaagattaaagtgattacagtaacacacaattcctaaatatttaataagtgtttagaatgattttatgcacattaaaagcaattacatgttcctagctaagtatgtaaaactcttattcctagattttttcctactaaaattattcatcaaatccatgtttattacttatttttctttaaaattagcatctctttgaaaatatacctatccatttttgttaaaaccttctgtaatcagtcaaaaagatccaaattcttaacttctactccagtgtcttaagaactcatacacaattagatattatccacaaaaatgctaatacatttcatcaggtaagaatcaacaaatataatgctgattacttaaggtcaatagactaagtcaaataaacctgtagtatcacagagaagagtagggaacagagaactatggtggtaagagggggggtaatagaaagtcccttctgctggtaatgactgcagaatttatgtgttctctgacggtgacaaatgtagtagcaaattgtagcctctccatcagtaaagctttccattaaatttccctaggcaattaatttctgtccctgcccttcacagcatgtctgagaatatctaaagcagaaaacattcttaactatgacatagcatgaaaaagtttaccagaataaaagtacattaataaccacagagcaaacattacacatccctgctgcttgtagagatagtatgtttgctttggaattctgcgttcatttttcccattgtttttaaaactctaaggattgtgccaccctggcaaggagggactcaaagtctcatttaattagatttgaaaaaaaagtaagtaatgtgaaatgtcatatactgactggagtagagtggaattcatactacttacatactgcgtgaaataatactcaagaggtaggaaacctggtaagatcatcccaacaaactgctaactttcagccatttccagctagtctcttgggtgctagtgttgctatgagttctactttctaagaatctgcaggccatttcactcatcactggccgcttagccagctctcaacccatgacttcttagcagtgaacacctttagttccattgagaagaggactccttagctcacctccctagaattaaccatattttttttgtcctttatattttcctgagctggctggagggttaatagtcccccttcagatctctacattcccaattgattcttcatctcctgaccttatcaagactgtattcctgtatcatagacttattacactagagttaggtttgtaaaattaaattaaattggcccaaagttgtctctgtaccttgagtttctatacagcaaactgtgacctaattagtatataaacaaactgcaaactaacttaagagtatattctcataacaagtagctgaatctcagccaatcatagcagccaggcctcagtcaatcacaggctaccaactgatcacactatgtccaaataagacaaatgccacgctgtaacaatttaaactgtttctgcataatacttacttgtccatctataaattctgcctgttcacattgctgggtaggaatccctgaactactcctgatctgagtgctgcccaattcatgaacattctttttttaaataaactctgctaaatttaatttgtctaaagtttttcttttaacagattacacaaactaagttggaagctttggtagattcatttacataataacacaaactttcaattgtaagtatacatatttcaaaaaattcataagttgaagattctatcatctctaaagtgtgtgtgtgtgtgtgtgtgtgtgtgtgtgtgtatttgttttctacatatttatacaggtaggcttatattttgaagcttgtatttcaaatagacattttaataatctttaataactatttaaaatataatactgagttcaatttttttcctatcagataaacacattaagctccaatgacttggggaattgacttttaactgaaattagatacaacgcataaatgcaaaaatagtaagaatgtttggaaacctttgaattaaactttgtttagatatagatagagctgaagtaaaaagaaattattagttttcggcactttcgtacaactgaagctatacctgaatcaaagcgtcgtaatgtttattaacattgtccatatgatgatgagtattctccacagagagccaaactggttaggacgatgcagcctagtgattaaatttgggttctgtagtctcacaatcttagtttgactcctgtctccatcacttattgaccttgcgcaaattattcaatattacgttcctcttctgcacaacaggaaaaattcctgctaaatgctcaaaagttgaatcaacaaaagataatcaatttcatcatattataattagtgcaattatgccaaaatatttgtaaatattttgtataagtttaggaatggtaaacaatatataagcaaaaacatttaatattaaaattaattaaacaattggtactacatagctcataaagatatagcttcagtcagattatctattgttggctaaatatgaccactccctaaaataaatttattcatgtatatatttgtttgtttatgagacagattcttgctctgttgcccaggctggagcgcagtggtgtgatcacagctcactgcagtcttgaactctgggttcaagagatcctcccacctcagattcctgtgtctaggactacagctacacaacaccacaccaacctaattttttttccagtagagatgggggtctcattatgttgctgtggctggttttgaactcctcgcctcaagcaatactcctgcctttgcctcccaaagtgctaggatgacagatgtgagccactgtgcccagccaaacccccataatgtatacgctgaagtcctaacccatactacctcagaatgggactgtatttggagatagggtttttaaagaggtaattaggctaaattgaggttattaagtcgggccctaatccaatataaccagtgtttttcaaagaagaaaagatgagggcacagacatgacaagaaaaaagaccatgagaaaacacagagagaagttggtcatctacaagccaaggagagagatctcagaagaaaccaacgctacagagcccttgatctcatacttccagctccagaattgtgagaaaataaatatctgttgtttaagccacccagtctgtggtactttgttatggcattcctagcaaactaaaacactgcctaagttcacatcctagcttttagcagtattatgttgggtacattatttaacctttctgtgcctcaggatctttatctgtaaaatggggatgttaaggtctccaaatcctaggattattttgagaagtgtatctctatgacttgcttaacagaaggtctggctcatagctatcactcagtattagtttctattgtttttctgaatccagaactccttttcaatatgttccctgtgttgcacagcatatataaaactgtatttttctatttctaaaggaataactacacatcaccaaagtttagatgagaaaactgcttgctagcatttcaatgtacaattaagagtgacagtttcatgtctgaggtcttttataaatgtgatgttttcccattcaaaatttaacgaaagaaaatgggcctctatgaaattatggctgacaacagctgcctctgttgaaaagcatatgggaaataccctttgaggatgcaaaagttagaggtgactgattctgtgactagtctgttgttatttttaaatgaaaagcatgagcaatctcagaaataagagagccaaagtatcaggcctggatttgacaagcctgccaagacacacttcaatatctgtctaaatatttggccataaaaaacacaaagcacagccttaattaatttataaaaaaacaaatatttgctttagtcatctcctctagtgacaacaaggtctgatgttacttatgatgctcttaatattaaattcaaacatacgcaataggcattctatggacatctgtggatacaatcaggactacaaatataacaaaaattgaggccatggacttgtagacaagaaatttaaatgtttttcttatttaagtatccttatgcaagtcacaactttctaagtagctatttactatttcaaatagtacaaattttcaaataattacattaacttctattaattagtgttttctgtgtgtgaggcattcttatgtcttctgtcacctactggtgaaatcactctgactattacctctgttttataaatgaagtaactgcagtgaaataacttgcccaaagtcatatagacaaaaagtgatggaggaaatattaaaacaacaacaagatcgctcttattcccaagatcaaaatcccaatccctttgaagtattttttcaaaaagtggtaccaattacttccttggttaaagtactatccacggcaaaatggtctaaaattttgatttaagaataacattctctttctaaggtttatttatgagaaaaatattagctaagaaagagtaatttctcaaaagtaactgcagcatgcttcagatatttataactgcaaaatctgctttaaaaggtactttaagtatcctaaaagtctcaaaatcagcattctcttaggtgccttctcttaggtgccttctcttagatgctatctgaccttttcaaacatacatagaatcaaatgagattctgttcataaattaataatgcaaatataaccaaacaatcctaacgtaaatgtatttttaaatttgcacttgacttttcttcctcaaaaaagtctttaagtctctatgctttcaccctcattcatccatccatccatccacccacccatacatctattcatccttccagccaattatctattctacaaatgtttattgtccccctctatttgagaaacattgttcaagttgctggagacacagtggtgagcaaaatagacatggttcttaatcttacggtggttacttcctttatcatctccaatcttcgtctaatgacaagattgccactaagaaaatgatggcttgccaagaaagatttacaataacttgcaagtgaatgcctgtatctttgtttctttaagagtaaaccatttgttttaaaattttatgcattgaacatctaatcttattataaagctacctcattttctggtcatacattggcaccttccattttggaaaaaaaaatgcatttttcttttgacataattgttacttagagaggcactttgtgcctatgtttgtgtgtttgtcttcaggactttcaagtaaacaacttaattatgaaacatttttctctatgtttcccctctataggaattttacagagaagcaatcattatagtaccttctaaggctgcatatagattacttgcaaggtataaaatatattgattttaaatatcttcttaaaatatcacctttttgcctattttggtgtcattcattcagcaatctgtacttgtagtatattcaaagctattccttgctctggggacatggagatgtataaaacatgacctggccccttagtagtttacaaccactgtgaaagacaaacatggaaaggagcaaaggaataacacgtttaagatgcaacgatggaaccatgattaagattctgaatattagaaagtaatgaagaccataatgggggtatcgacagcaccctgtgtgtacacaggggtgaagtggatacatttgcctgaggaatattggagaaggaagttgtaggaacagacaattgcctaagttctgaaaggttgttaagtgttccacagggatttagcacctagattgtggtcttaaattatagttttacacaaagagaaaccaggaattcttggagaaatttcatattctaggtatgggacaagaaatagataagatgagcctgaaacatcttatcatagcagatagtgaggaagctatcaaaaactactaagttcatgtcaaaagggctcaagaaccaattggaagagacccttcctggccaatgatgaggtaacttaaatttcaaaaataattacaactgattataatccataaaatacatataaacctacgagttcataataatattcaatgacataaatttctcatctttggacaataatagaggaccaattcacttttttgaaaatgtatgtaaaagaaaataagcattcatccttttcctttatgagttgtaacaccaggtaacgaaataacagatgaaaggtagtgccttagtctgttcggtcttctatagcaatttaccacagactgggtgattcataaatgccagaaatttgttactcacaattttggaggctgggaagtccaatatcaaggtgtcagcaaattgagtgtcttgtgaggacccactccttgaggccagtgtcttgctatgttttcacacagcagaaggggcaagggatctctctaggttcttttttatagagtcattaattccattcatgaggagtctactcttatgacttaatcatctcccaaaggccccacctccaaataccatcatattggggattagatatcagtctgcatcaggcactatgtcttgtaaggtgttccaacgaataagtgaaaataattttaaaatagtatgaaccaattttgattcattaattgtaataaatgtgtaccataataatgtaaggtgttaataataataggtgaaactgagcataagctatataataatgctgtattttcttcacaatttttctgtgaacctaaaacttccctaaaaataatatttatttttaaaaattggagcattgccactctgaaagtctttatgaattaatggttctagatattcagcatcattggctagtaattgcaaatgatatcacaataatagagaaaaaaatgatgggagacagttctgcattgttcctgcattggtgtgtaccagcttttcttcagacttatttttttttccaagaatgtttgtatagtaagcagcattggaatagtaagacagtttctccttccagggtggagggcagatttgttagcagccctttttataaaaatggagtttcataagctcagagttctgcaactgtgacacaaatctcttttgatacagtatcgacctgtttgtactttccaatcacttccatgggacttgcctcaggggcaatgggaacccatgtaaacatgaagctcatgctgactgctgtgccattgagtcttgtgtcttcttctaacacaagtgacagactaacttgttagcttgcaaacactctaaaatctcagacatttgacattcttgacaacaacaagatattacgtgcctcccactgaatgaacacaccaccacctatggtttcatcaaagagactgaatgtaagtattataaagtctctggatccagctgccatttgttggaagtacaaaagacagagaaacatggtgaatttgatcatgaatatgcaattaacaaaacctagccttcagaaaattctacagaaaaatgtcccaggtgtttgaataggtaaattataagaagagggaaaaaaggaggaggaggaacttatgtcacatgtcttaaaggaaatttggaaaaaatactttaaaagcaagttatagtgtccagggatgcatacttgggtgataaaactataaagacatacaagaaagcaatttctatacaagtaagaatggtggttacttttggggagaaaagcatttgagattgggatagggcacatagtggggtttctggggtgggtagcaaagctctatttcttgatgtagattgacagttacaaaggagtatgccttttccaaactacttaagctatgtattcattttgtgaagttttcaatatttgtataatgtttgcttatatgtttgcttatgaaagtataaaaataagccatcaagtggaaaaaataagaaaagacataaaaatgtcccttgccttttcacatctctccaattgatatatgaaatcagaaaccaaacaatttcatatgcatagtgttccttgctatcaaattctctctattcatatgcaggaactgaatatgttagtaagaaacatttgcacaatttaggcagagagaataatatgtctaatgtcaaagtgtcttgagagagcctagtgttgttcacaggtctaagactgctgaatggaaaatgagtcagggaggagagggacttgattggaaaaagttaatgtaggagtctataattttacaccaggcaatggggaattagtggcactgtatacagagaatttaggctttgatttattttgtagaattatgttcttagttgcagggtaaaaatggagtaggttggtgagaagctggtggagagagaaaagttagaaacttgttgccaggcaagagatgcggaaggcagtgaatacaaattagatggctctaagatccaagccatctttttgaggtggaatacaaaaatacttcatgacttactggatgtgggaattgaggaagaacaagcaacaagaaatgactgaggtttttagcttgggagacttggttgatggcgctttaaaaaaaccagtataaggaacaagtctgtggaattttcccaagtactatatgaactttcggttatctgatgttaaactaacaccttcttttttacaaattcttttaaatgacattaatatctgtatatctgttaaatatggatagcaggtacatgtacctaatatgtttttctgtgtgcttaatatgtttttaatcttcaaataaattatgttagcacctgtgatttcatatatcttgatgggtgtcaggttataatattgttcacataggtccaaaacagtggttctcaactggggtgttttgctttccagaagacatctggcaatgtctggagatatttgtggttgtcatctttggtgaggggtggagggtgatactggcatctagtgggtagacatctgggttgctggtagacatcatacatgcaccagacagccctttcttcccacctcccacacccaccactaggcaaagaataatcaagtccaaaatgtcaaggttgattgacttattaatttgaggcaactgtttaattttatagcttgtagagttgccttagtggttttctaaaagtaataaaaacagtgcctgctagtataccatcaatacaatccataaaatatgtatacattatgaggaaaatttaaattaatattcttgtattaatatatatttttctaacctgaatttattattgcacatattactggatggacagtggatggatagataaataaatatctatttataagggtaaataggcctctctccctctctttcctcttttctctttctctctgtttctctctccattgtaacctaattttgcagtagcaaaattttctatgttgatttgattttttttcattcactgtttaaaagcttgcctaatacaacttggggatattaaggctaagttgttctatttataagcaaatttataaacaaacaaagtcagtcatttcctttataggcataattcttctttaatctctgagaaagtatcttttgtttgaaagaaaggttatgttttatagtctccaacctgtacccagtaaccaaactattttaaacataaaaaataacaatgtctcacagggaggaacaaatgaaaaaatgaatagtctctttgcaacttgttacaggtacagtagacaaatgcttgtgatgaactctttagttattgtattccctgaaaggaaactggacaaagacacatggtatttctctctcctgagtcaacttcatcacctttctcttgggaagggatttatcaatcatactagacttcagcagtggttaacaacattggattacactcccagcggtgaggtactaggttcatggtatgctcattaacacaagtgacatcaatatcccctcctcttctggagaatgaatggggatattgacttctcattccaatcctcttcatcaacatcatcacagcactggtattttatatgcatactgcagtttacaaagccatttcatataaatatcacatttaacctccaatcaccattttctgaagcaatttgctaactttcaacagatgttttttcggaattacgttaaactagaaaatgtattgtggttttaagttcatgaactacaagaatattcaaaaggaactgatgttaataaaaataatgacataggtgacatttcatttaacactcttgaatttcactacggaataaactttcacctctcttgtctagaacttgttctcttaatcctccattaatttccttaagcaggttccagtactaaaatctgatataatctctactagctgacacacagaaataaaacttaaaaaataattcatgctaaggtctatttagctgacacagttacctcaaatccctgttagaaagtgttagtgtacaaaaagatagataaaacaaattaggtcatggggattaagattctacaggacatttttctactactcaaataaatttctgctactgtaattgaaaacactagaaatactatttttttactatcattattaccactcttagaacattacttttatgaatacctactatataggtggcactgtgctcactgttcttttttacttagaatataaaatttaatgttattatttccatgttaccttttaaaaaatgcctaatttgatttgttcaactataggacagttcctccacacagactattacctatacggcacaaacacaaggcctttgttgatacatgattacctaatttgtataactaattgcctctgcaataccatgaaataatgtgttgacagcgtcgtatcatgaaaagaggaaaaaataagaaggacagcatgtgaaagagctttgtgcttcaagggtaatactgaaaatattatgctttttgatattagaccaatattctcagtatgttactgaaaaatatcttctacagaacttaggaaatgtgtaaaagtaaatattcatttgataaatggaaatagtttaaatcactgacaataattttaataaaacatgaatgtaaaagatcaatataatctatattcattttttaaattatcataaacatataaatatgccatcttcataaaagatttgcctgatatagtcacatttgaataaatgctctagtgttgaaagatgcttgcctaagtaacatctccactttcttctattttacttcaaagaccggagtacaagtaaaccaactaaaattaaccaagttgttatatacacaatttttttatgtgctaaggtaattcaaagcagaaaatgaaagtagttgatactatttccagaggaaactagaaaaataaaataaaataaaatagtaaaacagaatttgagattctgaataattgatctaacattgacttgaaaagaaaatccttctcacagaacatattttataattaagaaggccattgatttctatatatttctataaacttaaagttatataatgctttacctttatttatatatgaaagccataaaatacacttgtactaaaagaggaaagggcaaagcatatttatctttatcacatttgagaaatgtatgtcaatttttaaaaatatttcaatatggttgggcacagagaatcatgcctgtaatcccagcactttgggaggccagggcaggaggcttgcttcaggccatgaattcaagaccagcgtgggtaactcagggagaccctctctctacaaaaaaatgtcaaaatttagccggacattgtggcacatgcctgtggtcccagctacccaggaagctgaggtggaaggactgcatgagcccaagagattaagactgcagtgagccgttttcacgccattgcactccagcttgggcaacagagtgagaccctgtcttaaaaaaagaaaaaagaatttcaatattattattattattattttttgagacggagtctagctctgttgcccaggttagagtgcagtggcacgatcttggctcactgcaacttctacctcccaggttcaagtgattctcctgcctcagcctcctgaagagctgggattgcaggcacccgccaccacacccagctaatttttgtatttttagtagagacggggtttcactgtgttggccaggctggtctcaaactcctgacctcatgatccgcctgccttggcctcccaaagggctgggattacaagcgtgagccactgcacccggacttaaatttgtttaaaccctaaaatgaaaaagattaactatctctcttagcaacaggaagctaaatgatttttctaatgttagaaaacactctactttatactggtgtttatataccattacatgtttatttttaagtctatatattttaagtattatattaatctttttgaaaatgctacttggaaaaccaataccctgtagttctctagaggcagtatagcctttagaacacattttactcaatttcctctgaactttattacattattatagaaaagacagatcaaatgaatgcccatggagataaggtaaattttagtgtcattactacccaagttgtgtataattttatctacttcacacaataggtcaggagcttcaggtgagagaatatgtatctcttttttataatggcaatgtcctctacagtgcctaacgttatactttatatataatgtggtaattattaaatatttattaaattgcattaaatgggctgaagatcccatttataatcctgaacctcttacacttagcgtacttaaatgacaaatgcctgaatgtttttttctgagtgaattctacacagaaacaattgctcaaaatcttacctttgttgaatttgttcaaaatagaatactccattccctcatttcctcattcagtaagtatttaacgaatgcttgctaagtgccaggtttgggctatatttggggaatatctaaatgaataaaaccaaaaatctctctaaaaccttgatatgtaatagggaactgcaattagtatttaagaggctttacttaagatagaaaatgttatgtaaatttcatggaaaatggtaaaaataaacaattttgagaatttttaggtgacatatttcagcaaattatgatgcaatcagagaaaacttaggtattttcatttccaatcttttaattatcattggtaagtgtggtggataaaatgaagagttactcaagaattagcaacatcttaaaacttacgagaaatggccccaagaatgatgactttaataaaaatccaacagtaaacaacaccctgtgaaaggaccaaaattagattcactaataaagaattacatagaatatatatgcaggttattttgaagattataataaccatacaatgcaatggtatcaagcatcaatgtgaagggtcaagaggaacctaagttggcataatctagaattcagttatattgttttttcattgaattataacatataatcttattaatttattcattagttaaaattctgcaggtaatcattacacatagtatatattattttatatcctttttgaacagtatgccaagttaacagtacttaagttaatcatttagaatacgattatgtcttttctctgtggggatgttaactgtataaaacaaggtagaatctagcaaagtatcaaacaatttttattgaaactgcatttagactacatagatatatttagtaacattaattacatttttaagattcatatcttctatgtagaatattcatattaacttacatactaaagtaatgtaataaacttttcaaactactttaaaaagccattttcttgggcttttcccttcaaactgaacattctttcacttttttcatctcacaaacttgtgattccaaactctttaggcatcattggtttttcagatgtacagcacaagcttcaataaaaacaccctcaagttttaaccatgaatggtttaggggcatagttcatgaaaatcatttttcttgttctggatagtgaagcaaatgaagcatcatttcaagaattgcttggccagtttccaaatattctacaatgagaaatattaagagcatatgttttaatgcagatttcagctgtgaccaaataggacatgattaagataaaggcatttttaatgaatcaaagcagaatatgaaatacataaaacagagattgtctcagactacttcaccctatcagtttcttattgctttaacaactattatttaatccaattgttgcagatatattttatttattgctctgttctctttttattcatatgtactgaaaattgcaaagcataaactgaaaatgaccattggcttggataaagtcataaagtcataagggaattctatgtttccagatcacaatacctattaaagtaagtaaaatgagtcacttcttacattatgcattttcttcttttttatttcagccatatttttattggggacgggttacatttatgtaccagtgcataagtagacaatgatgcttggtgactatatcctttttattttctaccctctcttctcctgcccttgctctcttcaatttgcaaaaggaatatcattacaacccattgaaggacctattcaaattgaacccaaattcaaattagtaatgtacattttctgaaaaatgaaagaatttaagattaagttttacttttttgccacattagttacataacaaatagagaataagcattaaaaaccacaggacacaaaattcttgaatcaaaacagagatgcagagaagctttatatctaagtcatactgaaggtagaaagtaaaataaacatgagcatttttaaagtgtataaaagcataccccctttaggaaagcagtgacaaaagttaagacaactgcaaatgacaccagtaactccaataaaggaaaaaaagagacattatatgccgagttggatgcacagaagggtctgagcaatgttaggaaaacaggatccattcagagttgaatagacatatctctttgctgaaaaaacgttccaagttcttcaatgagaaaagcctgaaacactgtacataatctatggtttatcatatgtaataatatttatgctaattgtatagtgaactacatatacatactttttttcttacaagaatggattaggtctttctccacataatttatgctttaccgtatttataaagttgagagttgcagaagctctttaagtgtggttgaagatgaacatctgaattgaatactaaagcagttcttaccctattacccagcatggctttaaggctgggaagggtgctctttatgcacagtttaagggcattgcttaattagacttctctctggataagtttcaaattttttatttgcattttaaaaaaccataaaataggtatttctgtggggtcagtggtaatattcccattgtcattttttactgtgtttatttgaattttctctttttctctttattagtctagctagtggtctatttattaatttttttcaaaaaaacagctcctggattcattgattttatgaatgtttttcatgtctctctcctccagttcagttctgatgctggttatttcttgtcttctgctagctttgggatttctttgctcttggttctctaattcttttagttgtgatattatgttgttataataacttcagatctttctaactttttgatgtggtcatttagtgctacaaatttccctcttaacacttccttagctgtgtcccagacattgtgggacatggtatctttgttctcattagtttcaaaaacttcttgaattctgcataattttattgtttatcatgtcattcaggagcaggttattcaatttccacataattgtataattttgagtgaatttcttagtctaaatttcaaatttgattgtgctgtggtacaagagactgtcatgatttcagttcttttgcatttactgaggagtgttttacttttgattgtgtaatcaattttagagtaattgccatgtggcaatgagaagaatgtatattctgttgttttgtggtggagagttctatagatatctatcaggcccattcaattaagtgctaagttcaggtcctgaatatcttaattttctgtcttgatgatctaatattgtcagtgaggtgttaaagtctcccactattattgtgtgggaatgtaagtctcttcaaaggtctctaaacttgctttatgaatctaggtgctcctgtgtgggaagtatatagatttacaatagttagatcttcttgctgaattgaattttttaccactatgtaatgaccttctttgtctttttttgatctttgttggtttgaagtctgttttggtaaaaattagaattgcaacccctgccttttttctgttttccatttgcctggaagattttcttccatccctttattttgagcctatgtgtgtcatagcatgtgagatgggtctcttagaggcagcataccaatgggtcttggttccttatccagattgccattctgtgtcatttaattggggcatttagcctatttacatttaaggttactattgatatgtgtggatttgctcttgtcatcatgtttagctggttattgtgcagacttgtttatgtggttgctttacagcatcactggtctgtgtacttcagtgtgtttctgtagtggctactaacaacctttccttttcatattcagtgcttccttgaggagctcttgcaaggcaggtctggtggtaacaaattccctcagcatttgcttgtctgaaaaggatcttatttctcttttgcttatgaagcttagtttggtcatatatgaaattctgggttataatttcttttatttaagaatgctgaatgttggctcctaatctcttctggcatagagaattccagctgagagctctgcagttagtctgactggcttcccttggtagttgatgtggcctttctctatgctcataaactagaaaatctagagaaatggatgaattcctggactctcccaaaactgaaccaggaagaaactgaatccatgaacagaccaataatgagttcttaaattgaggcagtaataaatatcctacaagcaaaacaagcccaggaccagatggattcacagctgaattctactagaggtataaagaagagctggtaccattcctactgaaactattccaaaaaattgagaaggacctcctccctaactcattctatgagaccagtatcatcctgataccaaaatctggcagagacacacgcaaaaaagaaaacttcaggtcaatatttttgatgttcattcaaaaatcctcaatgaaatactagcaaactaaatctagcagaacatcaaaaagcttatccattatgatcaagtaggcttcatttccaggaaacaaggttggttaaatatatgcaagtaaataaatgtgattcatcacataaacagaactaaaggcaaaaattacatgattattaatatctcaatagaagcaatagctggaagcattccccttgaaattgtcacaagacaaggataccctctctcactcctcctatttaatacaatatcgaaagttctagccagggcaatcaggcaagagaaataaataaacaaatagaaagagaggaagtcaaactacccctgtttgtggataacatgattctatatctagaaaaccccatagtctcagcccaaaggcttcttaagctgacaacttcagcaaagtctcaggatataaaatcaatgtgaaaaaattattagcattcctatacaccaacaacagtcaagctaagaacaaaatcaaggaagaaactataatgccacataaagaataaaatacctatgaatacagctgactaggtaggtggaagagatctacaaggaaaactacaaacccctgctcaaagaagtcagagatgacacaaacaaatagaaaaacattccatgctcatggataggaagaatcaatatcattaaaatggtcatactgcccaaagcaatttatagactcaatgctattcctattcaactaccattgacattcttcacagaattagagaaaactattttaaaatgcatgtggaaccaaataagacctgcatagccaaggcaatcctaagcaaaaagaacaaagctggaggcatcatgctacctgacttcaaagtatagtacaaggctacagtaaccaacacagcaaggtaccggtgaaaaagcagacacatagacaaatagagaacagaatagagaacccagaaaaaagaccacactcctgcaactatctgatattcaacaaaggtgacagaaacaagcaatggagaaatgactcctgattcaataaatggtagtgggataactggccagccatatgtagaagactgaaactgaacccattccttatgccacatacacaaatttattcaagatggactaaagatttaaatgtaaaacttgaaactatgaaaaccctggaagacaacctaggcaataccatttaggacacagacacaggcaaagatttcatgatgaaggcacccacagcaattgcaactaaagcaaaacattgctaaatgggatataattaaactaaagagtttctgcacagcaaaagaaactatcaacagagtaaacctacaaaatgggagaaacaacctaaaaaatgggagaaaattttgcaaactctatatctgacaaaggtctaatgtccagtatctataaggaacataagcaaattgacaagaaaaagaaaacaaacgaccccacaaaaaaaagtgggcaaaagacatgaacagacacttttcaaaagaagacatatgtgtggccaacaatcatatgaaaaaagctaaccatcactaattactagagaaattcctttttttcttttttgaaatggagtctcgctcttccacccaggctggagtgcagtggcgggatctcagctcactgcaagctccgcctcccaggttcatgccattctcctgcctcagcctcccgagtagctgggactacaggtgcccgccaccacacctggctaattttttgtatttttagtagagacggggtttcaccatgttagtcaggatggtctcattctcctgacttcatgatccacttgcctcagcctcccaaagtgctgggattaaaggcatgagccaccgtgcccagccgggaaattaaaaactaaaaccacaatgatatatcatctcataccagtcataatggctattattaaaaagtcaaaaaaataacagatgctggtgaggttgtggagaaaaaagaatacttatacactgttggtgtgaatgtaaaccagttcagccattgtggaagacagtgtggcaattcctcgaagacctaaaaacagaaataccattcaacccagcaatcccatgactgggtatatacccaaaggaatataaatcattctactataatagcacatgcatgtgtatgttcattacagcattatgcacaatagcaaagacatggattcaacctaaatgcccatcaataatagactggataaaaaaaatgtgggacatgtacaccatggaaactatatagccataaaaaagaataaagtcatgtcctttacagggacatgaattaagctggaagctatcatcctcagcaaactaacacaagaacagaaaaccaaacaccacatgttctcactcataagtgagaggtgaacaatgagaacacatggacacagagaggcgaacaacacacactggagcctttcagagggtggacggtgggaggagggagagaatcaggaaaaacaaccagtgagtactaggattaatacctgaatgatgaaataatctgtacaacaaacttccatgacaaaagtttacctatgtaacaacctgcacttgtactcctgaacttaaaagctttttttttaaatcataaaatttgagcttttattgtcagtgtctctttatcttcataattccagtgcttaagatagttttagagtaatggtaaaaactccatgcacatgtaaaggaagcaagaaagaaagaagggaaggatggaagaagggaggaggtgacatggaagaataaaagaaaagagcatggtggaataaccctgagctccttcctaaaaccctcagttgtggttcaaattgtgtcaattagccatataacctgggtaaattatccaaaccttcttagtctttcatctctaaagtggaggaagtcttggagtccacagcatctccaagactccttccagttttaactctactgtaagaaatctttattggccaggagcaatggctcacacctctactccatatactttgggaggctgaggtgggagcatctctggagccctggaggcagaggctgcagtgagccaaggtctaagattgttccactgcagtcccacatgggtgacaaagtgaaacactgtctcaaaaaagaagaaaagaaatttttctcatcatagaaaaatatccatagtagtttaatgtttgctcatctaaataatattttaatcatgcagaatataaatattcaatcactgttgaaatacatgcattcatgggatccctcataagaaactaatataaccagatttaatttttaaaaaatattcttcataatgctcattaaacttgaatcaagaaatattatatccatcacttttttttttgagacagagccttgctctgtcactcaggctggactgcagtggcacaatcgcagcccactgcagcctcaaagtcctggctcaagtgatcatcccacctcagtctcctgagtagctgggactacaagtacactaacatacctgcctaatttttgtatctttttgtagatatgagcttttgccttgttgctcaagacaatcttgaactcctgggctcaagggagctatccgcctccaccgcccaaagtactaggattacagccatgagccaccaccgtggctcccccacgcttaaataactggcattaaggaaaaacaattatactatcataacctattctagtgttgtccaatcaatcctgacctgattgattcaaaggtacaaaattgttaagtgtagctttacattgttaaagctacagtttaataattattgctccacagtttgaattttggagctatagctttctttcttcaaagaacaacttcacttggaaagacatatggttaaaagaagagttagatgacagacctttcagaaggacaatttataagtaaactacaagtttacactcggcgaacttagttcatattgtttcaaattatatattttgaagggtaagctgatttgctactaaggaggatattctttggcaatttatcaatattagaatgtcttacctgagaatttatgcctcattactttcattcatttacgtcttgtatacaatttttcaatatgtcattagtaacagaattcacaggaaaaacatcttataaatgccaatgaatttattatcagtacacatgccaatctccaaaaaaagccagtgtttgggattttaaaatacattattttcaaccaaaacattccctcaagaagaagcaactggtcaattattctttactaatattattctatttaaatgttatcctaacattattttctgtacttaaccagggatgtttaacaatattttatttaaataattcttgtataacatattcttaataatgcaaaccattatagttcatttcattcttactatgttgcactaatctgtggaaatgggcagagaagttttattttcttctattgttgaaattaaagttaactcatgggaggtttacacatttacataatatgttctttgcatcagttattccactggaattttatatccaagctgaatcaattataatagataaatctgtaataaagtataactctaaaccagaatttcatcacccattctctggggaatgaggaaagatacctgaggccaaatttacttaattgttcagtgataaagactgtgtttaatcacagactgcttcaaatgaattcccgatagttttaattaattagcttcatttcttgttcattcacagaattgaaaatattttacattatcttatcttagcttaaaagtcaccacttattttattgtgtttttttcttaagttgcatgatatcatagagttcctacaactgggaatggaaggtgaatcaagatctatagaggttactcagaaatgagtgagccattcacagcttcactgctatgaaatttaatcaaaatcaaattaaaacaattaaatctgcttcaatgatatatatgattcatgccctgctatttgctcttttctataactataaaatatatatatttatttttcatcttgtcaatgatatcaaatatcatttacattataaaaatcagttgtacaaaaaatcatatccaaaataaaaccagttttagccaacaagtccgaggcaacatctacaatggctaagctaaaaagaatttaaactcagggcaagcatctaaaaataaattatgtatatatgacttacacgttgcaagaaaagagaataaacagactgaaggagtaagaaaatatcagtttctatctgtgtgatcttagaaagttgcttaattccactgtaaaataaagatgttaaatagtgcctatacatataaaaatgttaatgacatctttatgtaaatatgatttaagatggtatgattgtcaatacaatcaagaagaaagggaagaagatgcaggaagaggtatattccttacaaaacccagctgagatagaaatgacatcctatgtctcttcccctatggttaataaactgataagtgccagtgggcatactgcctgacacaggaggcaacttttctgaggtggatagagaaattgagccttcataacatgatttgcaccctcaacacagagttaagttggaagtctttcccttaaacttccagctataagaatatgtccctttttggcttgaaaaagaacatgagactgtcagaaagaaagatgatgaagtagtcttgtgtattacatatattaggtttgtaacttttagccaagtcctttgctaaaacaaatctattattttttgtttgtttgttttgacaactttcccaattctttgccgtaacttctcagagtgccttttttccctcttggcactttctcttttaggccttactttgttaagatattgactttaaaaaaaaaaaaaaaaagtaacttggctgggtccggtggctcatacctgtaatcctagcgctttgggagcccaaggcggtgagtcacctgaggtcagtagctcgagaccagcctggccaaaatggtgaaaccccatctctactaaaaatacaaaaaattagctgggcgtggtggaccagctaattttttaaatagctgtaatcccagctaccctggaggctgaggcaggagaatcgcgtgaacctgggaggcggaggttgcactgagccattgcaaccagccatgccattgcactccagcccgggcaacagagcgaaactccgtctcaaaaaaaaaaaaaaagcaacttgaaaagagtactcagttagaggttataagagcaaagaaggaaaatatattcatatttaaattatttaggctatttcaaacatgcctatccatcacacccacaatgcaaacatttctaaaaacagtaaatattcatcttgctgcatcctagatgtataataattctcttcacctattttacttaataattctaaattgagaagtgtagtaggcattttgtacagtgacatttagtctttatggtccctgggcaccagaatacataaatttccctcactatgaaagagactgcagaattgctccctgggcatttcctagcctctctggcagttgggtaagtgcagggcaattgaacatgggtgaaagtgacttgtgtcacttttcctatttgggatcctctctataatttccctagcaaacagccaaacacagacaactccaaggaccttagggaaggtggagccagaaagtgaaaggagtctgagtctgtctgtctgtctgtctgtctgtctgtctgtctatctatctatctatctatctatctatctatctatctatctaatttaatgagacagggtttcactcttaagcccaggctagagtgcagaggcttgatcatcactcactgtagcttctaagctgaagggatcctcccaaccttagtctcccaagtagctaggactacaggcatgtgccactatacccagctaaattgtctgagtctttaaatgactatcttctgatcaagaatatctattttagactttatatggttaagaaacactgtgtaaaggcattcaatttttagtgttgaactgttaaagcacttactgttgtttgtcctaagtaccatactcaattcctcctctggtgacctgaggatatgtcaccatcataaattggtgaacatcaaggtgttctctaactacaccaaagagccatccatcatcttgtaccagcccagtctaaagtagttaaatattacaacattttagacatcaatctgatttttaaatagtgtttttttcctgtaattcaacttctagtatcagaaaatcatctaatacttctcttgaaagtccatagatatatggaaaaagtgaaacaaaacattaagacaagaatggatttctagttcttagaaaaatgagtgtttcagaatttcaaggattttcatgacagtagcaacgtagatgctcatatcaccaactccctcttccttaacactaccacggaaacacaatagaccaaaacaaacaaacaaaaaccatctctccacagtatatgaatatcgcctaggaataacatgagttatgtttatacaaaggggaattttgggaattactagttatacattcaagacagattttagaaaactgaagtggctatctaaaatgattatcttaaaaaattggcaagaaattgtcacatttgctcaggcaaaaatgagcaaattgcctatagcaatttgtatatcaagtttatgtattttcatttgttttttaaccacattatctcttgaggtataatataaggttaacagctttagtaactactaaaaagaatgattcttcaactctctttcctatgcttgtctactctttagttctacttttgacaaaattatgcttctggtaatccttaaacttaattttaaagaaaagtatttattttcaataggtatttcttcttttacatttttctttctcctgggccactttaatcaggtgttgatagccaagagagtagaagtacaagttagttgtttgaaaagtatttagccttccctgccataatacacattatactgttttattaggttcagtgaaatgtttaatcatttgttcaccttttaaattgaagtttatccttccatgaacacatgctccataaaagaagagaccttgtttatctgtttacctctgattcttactatctggatcaatccctaactcaataatgttcattaattggaatattagatgatttatacatctatgcccattatgaactcaccacatagttactgaacctccattttcttttcaaattacagacatcaaatcaattctgttttgcaattttctttaatatatgtcttcaaatatagaagagttgctaacatgctgagagtgagattcctcaacgtgacatttaatcgcaaccttattttgaagacactaagatataatgaggtcattttaaaacataagtaaatttgtatagacctattatttggaaagagtattctgtctcttgaataaaaatagaattgaggcttagttttgaaaagaaaaagacatatgactaacttgtatgctgatcaatggaattagtacaaagtggagtattaagaaatacacttgtgcaaaagaaatgtgtcaaactaagaattaacattctagaaaattgccaagaacttttgagagattcttgaaagccctgactttcagtgcatcaatataagcagttgagtagaccgaagagatggtaacataaatggttaaaaaatttttcatgagattcatactctgaatgaatcttttcttgtcaaactatgatatttaatcaacatgatttgcattacctcatgtgtttacttttacaggcccctgggagataatttctgttctaaaggctgtttgtttgttttaaataatgtaagtacagtcatcccttagtatttagtgaaaagatttttgagcatgcctccctgatatgtgtacctgttgttatttgtacattttatagatgctctatttcaccagatatagcaagacacctccttagattcagtattgtatatcttaaacattcccagaaaaaaatacatacatctttattttatagatgctttgtttgaaaatgttatgcagattttgaaggtcacatgtgattactagctcatgtctcaggacacattgtacagttaggtcaaagttcataattaaatatagtataaggaaatccatatttcatatggccttcttaatcatttgaattttcgcccctttcttgtcagatttgagtagatcatcactgctttttaaccttggagtacagtgaaagaacagcagggagcagccgtgtcatctcgataccgctccccaccatctgtattataatttctcttcaatccaatgctttcttaaagaatgttcttaaacttcctatcttgtgaatgttcatttagttaaaattaacaatattatctacagaaaccacttaaccaggaatgcaacctgtgatactcagcaatatgctgaaagcaaaccaataagtgagagaggacgctgttgtctatcctctgcacaatggggttcccactcttccctaagagcaccacgtgctagcagtttcatctggtacactggacctgcgcacagactaaataagaccatcaatgaggaaagcttacttcattttctattatcttcgattaaaaggtatatacagagcaaaattctaaccgatgaccttgtagtgaagagcactttgggaactgctgtgttacattctaataaattctaaaaatccaaacctacttaaaactctttagtggctggtttttgcctgtaggtttaggtgtaaattcttttgtatggcattcaaggccatttggaatctgtctctggcctctaccttaaatgtatgctatgctgcaatgacactgaacttgtttcattttcctgaaatgcatcatgcctctgtggtttgttcctgcccattcctcagtatgaaatggcctcccttacatcctgatgtgcttttgaaaccctcacatcacttctagcaatttttccctgtggacacttttgtacataccaaagcagaactaatcattttatcttttgctaccactgtggccgtttctgaagcctactacagaactcataaatatttgcatttgcctctgaaatccacatgagtatgtgcacatgagctctctcagattttgatgcctgaatttctactttgtaacacagtagctgtttgatacctctcactgaatggataaaaatagctcttttatctgctcagtgagaaatgcaccaaatttcataaattcagctggttagtaagttttataccatattttggaataaattagtgtataagataaacttcaatatatgcttactattgatataatttttaaaatactattatttatcattattatattttaaaatgcagcagcaatattgataaaaacaataaataaatataaaccttcaaggaagattttaataaatttataaatatatattgagcttcttcaatatagctttatagagattcatgagaaaagagacagtccctgtcctcctataatttttcagactaaaggatagtacaagcagtaatcaagcaattacaacttagtaacaatcagtgttactaaaacgatgtcctggaatataccaaaggaagttctaagtgagtcagtgtttcctagaggctgccttgagaaagtgatcttttaaacagagacctgtagaaaacaaaaaaacaaaaagtacaggaagaaatgttccacaaaaaggggataacaagtgttaaagctctgagaacaaggagagaaaaaaatgtttgggagtcaaattccagaatggatggagtacagacaaagaggatattaccagatgaggaggatggagagctagagcaagaccgcacagccttgcaagccactgtcagtaaaaattgtgaaagactttggacaaaaggaatactgggagtcctttcaatagaatgcagtgtgttgttcctagaggagccttcaggttatccgattctatagggctctgaccctttatccttggccaggctgttttgccacttcatagaggtccaagttaatccatggtgaacaaatggaggtgcaaatgattcctatttataaaaattaaaatgaattttttcagtaataatattagtcatataaaaagatgattataaatgttacatttttgctctttgcaatacagttttttatcattaaaatttcatttcagcattccttattgtctatgtatgtctatcctttacaatggttcaatggttgtagcatcttacattacaaaacatttttgactttttaaaaatgttatatattgacgtgagtcatgacttttaccattttgccaattctcctttataccatatcatggaatctcaattttatctcaggagcaaggggaagtaattgaagggtgttgaacaaggaatgaaatggttggttgtaaaggtagaggatagtttggaaggtggaaagaatttatgtgagaagacaagttagaaagctgtattagaaagccaaatgagatggcagtggcatggatggaggcagaggcagtggggttagaaagaaatggagtgatttaagagatgttaaagaaggaaaggaaaccctggtattgttgttagataaaggagagggaagaatgaaggctggttgactctcacatttccagaatgataaattggggagatggtagttcaaattactgaaaggcaagcagatttggtgagaagcaaaactgtattttcaataagatcattgtatagctatagagtttattcaatcagtatcccagtgacatttgtttaatgctagatcattttgtcatgcatttgtaaagtactcccatgatttatccagcacacacaactgagaataaaagcatatcctgaagataaatcaaaacagaatcatttgtactacctatcaatctataaagtgactgattccacagcatgtcatatttagaaataaaagaaaacactgacatttggtttaaagtgttagaattgtagtttaattaaacttgtaaacccaagcatttagagatggtagtcatttctagtcaactaacagcttcattgactttcaagtatttgaaagaattaagaatagagatctgctacaaaactgaatattgtggaagttatcaataacattccttatattaatgataatgtataaaaatgtctaaaatcctatttcctattatgacagaataatgatctattattgatctataatatacattattatagtaaatgtcatggttcattcaggttgctataacaattatcttagaatggataatctataaacaagagaaatgcactgctcatagttttgtaggctggaaaatctaagataaaatccaagagtcaagaaaatccaaatccaagatcaaggtgccagcagattcagtggctgcttgagggcttgctttcttcatcaaagatggtacggatggtgccttcttgccatgtcctcacatggtggaagggtaatgagagccctttcatatgtcttttataggagcacttatgccattcaaagagtagagccctcatgacttaatcacttcccaaaggccccactttttaatattatcataccaggaattaggttctaatgtatgaatcttcaggggacactcagactatagcagtgaaataattaaaataactaaaaatgaaaaaagtatctttataatagcatattatgctctgaaaattgcataatttacagtattataataagccattttcaaaggtacagcaaaagtttggaaattccttcaaagtaacactaatctaaaccctgtaccttaggctgtcatgtgtacatgtgcccgtgtctttaattagattatgaattgctgaaggcagaaattcaggtttgtactcaacattgtgtcctcaatgcctagtatgctgatggaataaagaaggtatctaataaatgctaaccaaaaaaaaatgaagaataatgtatagctatttctatcttattagaataaaacaactttcagccatgttcaaaagtttagcatataacattttttctttttttttagatggagttttgctggagtacaatggcacgaccttggctcactgcaacctccgcctcccaggttcaagcaattctcctgtctcagcctcccaagtagctggaattacaggtgcccaccgccatgcccagctaattttttatttatttatttttttagtggagacggggtttcaccatgttgcccaggctggtatcaaactcctgacctccggtgatccacccacctcggcccacggcgcctggcctggcatataacacttagagtgttattgttttcatggtaaatgtaacataattatattttgaaaagctaagaaaaattgtatgcataatccaagcatgctaacatactcactgacaaacatttcggttttggcaacaagactcttaccactgtcggaaacctatttaagatgttaatccagaatatttaattgtaaaaagtacccagatttgcacactggcaatgatattgatagttttctgaatgtgatagactgaagagggaagtaaagaaagaaggaagggagtaagagaggaagggaaggaatgaaaaaataatctattggaaaaaaagtctttttctttactcttaatttactatcgaatcattagatttttcggtatttgtaatacttctgttaagtacagtaaattcaagcataaacatgggaatatgcctaagattgctttctagaacaactccagcagaacagcttcaaagcctcattgaccaaattgaccatcagtaaaagggttcataagtggcaaatacagaactcattacagatgtgagtagaagaaattattaagtactaaaaacatctaaatgccaagtcagcgaagtcactgcaccagttccataaaactagtgtctcttatgtattagaaggatgaaaggggaaaatataatttaatttaaattattataaaataatttattattttggatatttttcaaaaaatatccaaatgtaaacaaaaatttatttaaaaatactcaaataattccaaatcttatgggcagtcatactaaaaatcttgcttaagagaaaattgaaaatactactaaagctctaaagtcatcacattttaaaatgttgtatcgaagggatctttgaaataatcttgtctgtactggtttgaatactgttcccaaaatttcatgtccacccaggacctcagactgtgaccttatttggaaatagcagatctaatttgttaagatcaggtagtactgaattagggtgggcctccatccagtgatttaggttttcataagaaaagaaaacagatctgcagagacaaacacatatggccatgtgaagatggaggcagaggctgagtggtgggtctacaagtcaaagaaatcccaggactgccagcaatcacagaagtcaggagaaagacctggaacagattctttctcagagtatcaacaaggaaccaatcctgcatgactccttgatgttggacttccagtcttcagaactgagagaaaagaaatttctatggtttaaagctactcgatttgtggcactttgtgaagacagccctaggaaatgaatatactatccaatcattttttgtgtgtgtagaagaggaaaatgagatcttgagaggataaatgatttactcaagatcatatagctaattattgttagaactcgtattagaatctgttgtccatgaggcagtttttactaagtttatgatttattagactcatggcaactgagattatattgaactaaaagcacacgtgagaggaagccttacatcaaaattgatttcctttcacattcaagttaaataattttaatttcacacttgagagttagcatagcctattggttcaagaacctgggctctagggccagatttcctagccttggaattctttactgtaattttctctgtggcataacaggtacactcaatgcatagattgttgttaggattcaattaggtaacacttgcaagcatctagaatagtgcatggcatacggtgaaggttatatgatttggggctgtttaattgctgaaaatttttactaattacatctaaatatttaaaataactgactctgggtgaagtaaagtttatttaatatttacaaagactctggtggaattaagaacaagtgatacttcatattcaaacagatgttttaacaaagattccaagaatatactaataatatataaagtatgaaaacacaaaatataaatattaatgtaagatactagttccagtcataaatgtaaagaaatctatcacacagtgggtgcagtggctcacacgtgtaatcccaaaactttgggaggccgaggtggctggatcacctgaggtcagaagttgaaggctgacctagccaacatagcaaaacctggtctctactaaacacacaaaaattagccaggcttggtggcagatgcctgtagtcccagcttcttgggaggctgaggcaggagaatcacttgaacccaggaggtagaggttgcagtgagccgagatcgtgccactatactccagcctgggtgacagagggagactccatctcaagaaaagacaaaaaaaaaaaaaagaaagaaatctatcacccatgattattttattttatttatcaaaaattatgttgctaaatgtttcagtaaataaattgaggtcttttaaaaacaatggaaattacaactggattcagattaactcaatgttcaggttaaacgaatcttaaagaaaaaaaggaagggaacataggagagagaaatttaatgaaggaagggaggagggtgtaagaaaaggaaggaaagaagaggaatctattgcaatcaaaatcaattgtgatgaaggctggtttcctaattttttacatttttcctacctaattttatttacacatttttattttctaaggctaaagaaagtgagactggaacaggcaaaaaaaatgcaattgtttctcatttatttccaatactcacaatgtataattacaaagtatattgccaatcacttaaacattctaatgcctcaaataatgtataaggtattcagccaaaactaacctttgaaattaaagaaaaacattgtaagaggaagtttttaatatcttgtccatttaaaggaagttttacttaaagtaatttatacagttcagaactcgccactaaagttcaacatttctaagagctatacctttctgtgacttcatttttctcaagtgacattacaaatttctggtatttataacttttaaaatgtacttgttagggaaaataacaattaagttatttttaatgttctttgcaaattttaattaggacttttttattatcaggcttgattaaggaaataatttattagagcagaaaaaggttttagagagcaaatgtttatactattaattaatgtcagttagctatgtgcttacaataaatttttaattttcagacctattgttattaaaggcacggtggtttaagagtgagttccaaataacaaagagtacttaagttcaagttcacaccgcttactagttttataatcttgggcagttggattctctccaagcctcatccccttatccataaaagcaggaatacaaatcctagctacctcaaagtgctgtaaagggtaaaatgatataagaaacattagcagcagtacagtgtctgttatatagtaagtgtttagtaaagaatacttactgataacatataagcaatttctttccatttgtgacagttattttgatgccaaatattagaggctagatatgctttacctttgcccacatctaggctctctctgagctactgattcaagtttctaaattattctttacaattgaagatgggaataagacaggtgtcaaacattttaattcactccagtgagcccagttaatgttacatcatctacccaagcaaaagactatgctcttctctctttcatttgcttctcattctattttccctttccctcttcatccacttctctttaaatgtaactattaaagctacttttatcaatctttgcatgttttccaaccccaaggtcattggagcttaagttttcctgataatcttttttaagggatctaagtctcttttgcttatgtgctcctacgatcatgcataaaattgttctggcttatttgcaatctatttttttctaaaatgaaaccccatgaatgaattttaacagcatttctcttctttaacagaaactctaagatggtattgtcattttttccaaggttcttttttgttctatagtcccatttatgttttatttttggaatagaactatgtccttaacaaaagtcctctagattctttctctgttttttgaatgacaacaattagaagaaggtaagacaaatatttaccagatgacctactttgattataatgagtttctaaaaagatgttaacattgttgaagtccctataaatctttactgtgtcttcttgcaaaaaagaaacagccaggtcctcaatcttgccaagtattttataaaatattccctagcaaagcatttgttattttctccttcttgactttttctacttgcttcaatggaaaaattttcccaaaatccaatacattgatcatttgaattttacaactatcaagattttagacaactgctgcccaacactgttatttaagattcatcctatgtttcaataattataattgtttctctataatattcttaaaataaattttattcatataatatttcttctgtttaatcaatttaaaatagtaaaggtaaaaatcctttttcttgtcccctttttcaattatgctatgcattgaaactcttttaccaagaccaccatcttatttcaagtatgcactattagtagggaccaaaaattaggatcacccagtaggtgatttgctatgatattaggcatattgatgatcctggaagggatgcaatctaatcatattccattcaatgaataaatatgagtttttatgaataaaaaatgagtcttcagtgaatgttgttaatagcactatataaaaagaacacagcattcactttcctaactccacccatgtcttacttgaatgccttcctcaggaacacagctctcattcatcctattaatatgaatttggtgtataaaattagagcaaaatggaatcattcatcccttagcttgcattcactaccaaatttataatacaaattaccaacatcaataacagtaatatccacaagcaaaaataatccctgtaaataagtataactaagttaggaatgaaaaaaaaaatagacagaatattgatataaatgctcattaaccccttcctgaattatttaaaaagtaaaagagatgatttatcagatcatttcctatcatgaattaaacaatttctaggcatttgaatagatgtctactgaggaaatgtgaaagtggatttttgtgtaggtgacgaattataaaacacgatagaaatctgtattgcattattataataaaaaagccattaaaatatctggggggattaagatagttaggtctgtaggagttactgccacttcaatgtacttgtgtatattgtaggcatcccacttattttttcatacagcactataaatgttccttgaaagctatcttaacattcagattatttgaaataactgtacatttgtcacaaaatccaacaagaatattgtgagtgcttactatgtgcatatcattgcaccacatttgaaggaaataaccaaaataaaaataaaaataaataaataaataaataaataaataaataaggaccattcaggcagttcccaatttagaacaattcaacttctagcaagtcgttaaatttaaaatagctggttacacccatgttttttgaagctaacaaataaatttagaacaagccccttgatttgcttcttggatgctcaagtgaaaagttcagcctggaacatgcaaatggtatcctcgaccagcatctcttgaggatgttggatgttgcaaaatttagaagacaaaacgtaagaagtaactaataaaaatgagacagtgactcaacaggagtgccagattagatgctaccaagtttagatttcttatgtgactggaacattttcataacattatactaaaaatattttaaatagaaaatattattttcataattatacaattcttcaaacgacaaaattcatctaacatacaaattttagcatacataatttttaaatagttttaaaaaattagtatatataaaatatactatggtcaatatccaacagtaattcaaaaacaagccattaaaattcaattctagtgatgtctatagctgacatagtagggcttttgttgtggatttcatattaatatattcaaccaatatctattctattgaatgcctctgttgtgtctattccagacaatgttccagaactgaagacacaagagtgaacaaaatattatagacaaaaaacaaataaacaattaaaatatataatattgcagatgatgattaatgctgtggatacaaattaagcaaataaaattacaaaccaattacctgtatttgtactgtatttgaccaatgactaaagcttttacatttaaatacataaatatgatgagggacctacaaaacaaaacgaagcaacaaaaaaagagatactgtcatctagcaatattcttaaaggtaagaatgcaaaataataggagtagctttcatataaatattagaacaatgcatttcaatattctctataaacgtgtttttctggaataaagagttttattgtcccaggaaaggagatatatacttgatatttttttccaagataatagacttagaaggtaaatccaggggagaacgactattgtaaaaatgtttaattacacttggcctacctaggatagaaaagatcatttagttgctcatttaggcttatcccattgtttgaataggaatgagactaagataaatgaacggaaaggaagttggaaaaaggaaaaatcagagacattgaagagaagcattttcacatgtgcctggcgtctggatttctcccctaagtcttcggctgagttggtgtctgttttcagtagaagtacaatggggtgacacagtaaaacttaagttcacaggctatgttgaggcacagcagattatttgataaagttaagggagggaggggacaggacaatgtgaagcagagtcttagcaaattaaaaggataagagaagtatagctagactttcccacattttcctgtcgtcttctgaaccctccaaactgttccaacctctgcctgttacccagttccaaaatcgcttccacattttcaggtatcttttcagcaacatcctactctactggtaccgattcactgtatccagtttataaaccaactaatgtcttttcatcaaaacacaccagagactgggaagaaaaagaggtttaattggacttacagttccacatggcttaggaggccccagaatcatggcaggaggtgaaaggcacttcttacatggcagcagcaagagtaaatgaggaggaaacaaaagcagaaacccctgataaacccatcagatctcatgagacttattcactgtcacaagaatagcatgggaaagactgccccccatgattcaaatgtgggtccctcccacaacatgtgggaattctggaagacacaattcaagttgagatttgaatggagacacagccaaaccatatcagagagggaagtgagggaagaagagagggagatgagagacagtgagagagagagagagagagagagaaaaaaaaaaaaaacatgagtttgtcaggggcagaaatcaatgataaatatcttctaaatagccttagcttaagactagaatctgctcaagcattcctatggacccagactctccactcttcaggtgagacagaaagaaaattgtggacaccgcatgtacctctttactcggataccaggaaatcatttgagtttccctcaccccatgccccatacaccagtgtgttgcagaggaggagaaacttgaagatatgggctccaaagacaaagtcttatctgacatagttgtttggctttattccaatttaactaacaacaaaaaaggcgaaataatttttagccttatatattacctaaaacccagtgggtgggagtttaaaaggaaaagaacagtaataacccaatcaactacctgtcctctgctcagtcatgtgtcagtgagtaaatctgatagcccacaacatctttgcatgctggcgagccagcagttttgagagaaacccatatcatctctgttatgcactgagttgttttccctcagaatcttatattggaaccagtaccttatattgaagactctggcaccttagaatgtaactgtatacggagataggatctttaaggaggtaattacggttaaatgaaatcctaggggtgagaccctaacccaaggggattgatgtctttacaagaagaggaagaaacacttgagattcatgctcacagcggaaaagccatgtgaagacacgacgagagggcagccatctgccagccaaggagagacgcctcaggagacacctactctgtgggtaccttgctcttggacagccagcctctagaacttcgagaaaataaacttctgctgtttaagccactcagggtgtgctattttgttactgcctagctaactgaggcaatccaataatctgatttacaaagaagaaaagataggaagaaggatgacaacgttatcaccccagatttctttaagagacttccccaaattgctattttttttttcatcctagataagatatatttttctaatgtactaaagaaaattaaaaaaaaacagggatagtaaagaactccaagcatactataatttttaaatattggtatgacatttttgcccccggttatctattacaggcagaattatactgggaacaattagatttgattaaaatatttaagatcatttctgcttttaaaaaaaagaaacttaaaaaaaaaacctagtagattccagtgagaaacaaaagtacttgcatatcagtgtttcttagaaaaaaagaattagattcagtgtgctacaggataaaaaagataaaacttacttttttataattatatgtttaataattataaacatttttatatgttttataattattagtgtcttttcccatatattattttatgtattagtaagtaataaagtcatcaaaaggggcatacatatgtacattattttaatgtttatgttttggacactcactgctttaatttttatatagtcaaatctatctatatctatatgtctatctatctacctatcatctatctatctgtctatcacaagcaggttctcagtctgtcactgagactgcaatgtagtggcatgatcatggttcactgcagcctcaaactcctgggctcaagcagtcctcctacctcattctcctgagtacctaggatgacagacacatgccaccacactcagctaattaaaaaaaaaaaattgtagagacacagttttgctatgttgccaagtctggcctcaaactcctgacttcaagctctcctcccccattggcctcccaaagcattaggatcacaggcatgaaccaccatgcctggctcaacgtaactattataacttacattatgtccatttttagaaatgttttatcatctaaaaatacttaaatatttatctagattttttccagtatgtatagtttgattttttatatttaccttctcaatctatttggagttgttgtttttttactttatagtgtaaagcatacatttacatttttatccaaacaatagttttattccagacaatatttctgaacaactatatagaattcatcagtttagacatgcatatcttctagacgtgagttgtacctatcaatcctctttaactcaaagcacagtccaaagaaggagccgtagatatcacattgaagggaaaaagaatttacctgagagagcaacagcaaaaacagcacaattaacagagaaggcattctcagggaatagatggaaattattttgcaaaaacacactccctaatgcttcatgcagttgtgcacaagaacctgaacatctaaaattatagagcctaggatcaactgaacttcaagctattaaggcctgacattctgggaattctctgatgtgggtgttattaaactctctcatggatcaccgccatcattccaacagagagcagcatgcaacatggaacacaacaaaaaaccctgagtggggaggatgcccagagtcacgtctcttagacacatctgccaagaggattcattaatttcttattttctaggcacttaatgtcagatcagaacaaaatattttgtaacagctttattcaataatgtttaaaatataatttttgtttcactgtttaatttctcagttcatttttctgtgctctatgaaaaaccctgagttaaaataactgtcctggctaatttgaaaaatacatttaatattttagttagaggaactctaattgatgattgcaatagttcttatgtgtaaattcgtttaaagtttctcaacggcttttcattcattggatttaaatccaagttcctcaacattgtttttaaggaccttgccttttttaaaatacatagaggtggtgtctatgctgaccaggctggtcacaaactcctggcctcaagcgatcctcccatctcagcctccgaaagtgctgggattacaggtatgagccactgtgcccagccatggcccttgattttttatccttctatattctctctcaaattatgcaaaaatactgaattcctaataattattcaatgtgtcgtgcttttcataggctcttgcgcattactgcttgtatctcaggtacaacatctaatgcccctgacttctccacaccatcttaagtccctccttacacacccagttccttcaggtctcagttgtaatgtgacttcacccagcaaagctttccagctgctgaggctggaataagagatcctttttatattgtgtattcccatattctatctatgatagcacatatatacactagggatttaatggatactgttgaattaattagccattttgaaggaagctaaaaaagtgttcaacatccagagtggtcagcttaggtcaatcggcctagaatgatgccttaaggtattcttgtttggggctataatatgctgtacaccaggtataacatgatctttgccttgcagtcctaaaggatatgttcattctacagaaagcatccattttaaactttgaagactgttaaggtttaggtagatattaattagtatcattatttcttctcaatattctaaaattaatttcaaaatagtcttaccatatagatttttttatagaattttgtcatttgtcatgcaagactccatatcttttcataaaattaaaaatttggtttattttttttttcagatggcagaaacctgaaatcaagtttaaacattatccttgttttattattcattagtctttagtaactattgatactagaacatgtttctgtgttgggcaatattcaaaatttaacaaaaattttgaatttccatcctattttaagaatgaaagctgatagagtatttataataagaagttaccttttttgctggttatgactataagggagatattaccataacataatcaaccagggaaatcccattagaaattaaaagcaggttaaaatctcattaaggttttccccaagctatgagcatacttgcccaattaaaaaaattaaaaatattttagattgtaagttttaaaagatgctttctagatactgtaatgttctatgtgcaaaccttgattactcaggccttcggtttgttccctggctttgctgcatgagttgtttacatccatatccaaagaattcttcacaagtttggttcactcatcagtaaatcctattttggtgccaatgagtaagagaaacatctccctgggaccacctttatggtcatacacgtttaattttaatcagtcactacatgaaacaaatattttgctaaaaccaaggtggactttggatgccagaaaagaccaaaagagattttaactgcttttgttgctgacaattactcttggttaaggacaaaccatcacgatgaggactaaaggtttgtgatacctctctggactgcttttaactgcgaagtgaaggataacagcagaaatagaaacagaaggtctgcaactttcactatgaccaactgaggaaacaagatgaagagagcattggtcaatgtatctagtgtcttgcatttaaaccccgtttgccggattaactgcaaatgtagatgagtgtctttgtcctaatatctatcaaaaagataatagtctataattccttccttttcaaaccttccagaattcataggaagcatcaggaacgtggattcattccattttataaaaatttcctcaacttctattatgtttcctctcttaaacattctctaaaccctctagtaactttcacttgttaaaaaaaaaatacttctgaactatttactgaagcaagaaacctatccaaatactgtaataaaatgttgatgttgtaaacacattaaattaagggaaaactatgtacctaaaataaatgataaattcaacaccttaaatgtttataaataatatcaaataatcattgaaagatattatgccatttgtataggatttataacttcagtcataattatatgtttatttaatgttaattcatcaataattttcccaatctcagtctctcacatacacacttaaattaggtgccacagcttaaatagattccctctttcccgctccctctccccttcttcccctctgtcctttactgaagaccaatgtaacttaatgcaattactgagccacagaaaaaaccatgttgactgcattacttatattgtcttgtttattccttagaataaggtaacactgataaataatatattaatcattccacttccacttcaaaatctaaatgtaatgaattatttcatatagcctatcaatcatgagattatttttatacacacacacatcacacacacacacacacacacacaaatgcctgagtttaggtagaatgcaatacgtgaagctgaaaagtactgagaaattacagataaggtttctattagaaatcatcccacaacaggccctggtgtgtgatgttcccaggggagggatagcattaggagatatacctaacgttaaatgatgagttaatgggtgcagcataccaacatggcacatgtatacatatgtaactaacctgcacattgtgcacatgtaccctaaaacttaaagtataataataaaaaaaatgaaaccaccaagaaacagaatataacaaatgaaatattctgactccctgcttatctgtcttgtttccagtccctcatttctttgatctttatagtagtgaaatggttctagtctttaatcaactgttgaatttttttacagggaaaatctattgagtgtgatgtgttatgttttgtgctaagagctttatgtacattatcttacttggtccttatcacagatctttctgagataaacacaattattaactcaatcttattgttaagtacactaaaattcagacccaggtatatctgactccaaatgttaaataaactacttaactcatactgccaaaaaaaaaaaaaaaaaagaaataatccctccttgacctgaaatcagcgtatactttgtaagtaaatttccctttttgttttaaatgtaagacagcattttgttttcttgctcaaggtatgaaatgataatagttctttaaggtgagatctctgcaacaaatgtcaatggccaacctcatagctctttgtaaacaaatcagaagtttacttgtgtaatttctttgaaaaaatttcacaaccatgataccctagggatgatttcagtgattaggtgagatataattatattacttattatactgtgatgcattacagaatatttttactatacactggaaagcattagaagtcactactatgattacctttatgtcaatttttctttactcaataagaaacaaaataacaacaatgctagtatcattcaagttaatgtttaatcatttaacaaaaaagtttcatcatattccatgttttaaaatatttttattattttatttcttagaatatttttattttaatcaaactagaacatgtctctcaataaaggcataactagatttttgaggaatatttaataactgatagtttacacttttctgacctataacagactttaataaataggaaaattagttttcccaaattagtcttcccaaataactctatgtctcttgcttatctgactgccttaattaacatggcagaatatattagtaattgattttgtgataaaataaataattataattaattggttttaaaatcattagcatcaatcaattttttgccagttctcatatttgcatttttagaattcatgctcttggggcatgatataaaacacagtagtgtgaattcccttgactaaataggtatacagaattccctcatttttctcatttttgcaggggtatcctgaataaatcttaaaacattctgaatagttcagactctggagctatgtttaatttcagttagctacagatgccttgaactaagaatgacattaacacattattgaaaattaattaactaaacataaaagaatcaaatgaatggaaataaattattgtaaaatcggcatgggcacaaaagttctcagtgtttactgctttgtaattaatcatgctcattcataaactaaattaattgtagctacaaatgggacatcttgcttgaatttcttttacctctgtctataatttttgtgtgtgttgaagattgatttcctttttttcaatttgctaatattttaggtttaaaaccatcttacctattcattttactgtagaatatttccttaccaagtttagtttgatggtcagcaataggtcaatcaatgattcatttctgtctctttctaaaaaaaagtcttttaattttagaccagtggttattatgattatataaaataaaatatgttataatggtgtctctagtcacggtataatagtaggtaacagaacatttgagggattcggtaattcctttctaaagtatattgtcacagtttctaatctttttgacattgtctgaaaaggaagattttataacctcactttgtaaaattaataaaggtattaacactaccatttagtttcatgtttttcacatcaataagcaggaatgtatcaaatatatattattttgatattcatcaatattgcctctgacaacttttgaatgctaagactaatcctcagataatacagcccaagagttattacatttaccctgaatttccgtggccagatacataacattgacttggagaaatgaggaattagaaatcacacagtttttcctatatcagatggagattactaaagtttagaaatgtgtttgcaatattaattggatgctacttcagcagatttcttatactgatagttaagaaaactggtttggtggtgaaaacaatgtaagaaagccagatggaggttttaaggaaaagaaggtgaagttctatatcccctcatttagtaatcatttaccctctgttttatggcaaataactgcgttagaattgaaactaattatgaattaggagcctataagaaaaataaagtaaatattacaaggaaatttagctagggacgtgaaaaattctcctatagctgaaatttaaatggacttaaataccaagttaagaacaattcataaaaccctaacaatattgttaagaaggtcagaaaaaatgtctaccaaaatctataattagatagaatcatgtatatattttaattggatattatagataatatatttagttacatgaatctacaaggagataaacttcatgcagtattatctcaggacattacaaagagcagaaaatttacatttggtctatgtgtaaagaaaaaaaataaattatatccaacactgaaaacctattcacatttaagaaagagagaacattttgacatctctcatttttatattttatatctcagtggaaaataaatgttacaaacacttagaactcttgaggctggcatatttgtttttctaatatgaaatatggtttcccaacatgtaaattttgttttaaatatgccctaaatattggattatttttaacaggttttgaatattaatttaaacttgtatatttacactactagacttaaagagttattagcatgtttccttcagcaacagtagtttcaggcttttatttaaatttctaaatatgggcagtggttgctgaagttattgcttcatttcataccaataggcaatacccttaaacttcttaattccttaaagtttagctatgtagttttattgcccagtgtgtccttagattactatatctttcctaagtaattagactcctgtattttcttcctttgagtctattgattttatagggtgttatacttgctccaggagaataatatttattttctgtggccattaatcaatgtcacttgtgctaaaaggctatgcgaggatttctgcctaatagccaaggaaactatatttattggttgggaaaaccttagctacagctactaaactgccattagtggaatccttaacagctcattaccacagttagatgtgctgtgtacagcatagcttgaatgagaaccacactttttaagaaaagtcttttgtttattctgctctgacagatctcagtccagcagaatcaactccaaagtgatggcaagaaaaagaactgtgaaaagatgaaatagcatctcttttcttgatatgaaggaaacattatgaggcatttaaaataatatgtacaaattgctttatccccaaattatcaatatcttatgaggcaatagcctctctacagccagtctcagaaagaaatttgcacgtataatgtttcaataaagaagtaaacaagataaatttagcttcatattaatagcgtgaccattaaattacacaaacttggtagtattgagaattttccacttataattttggcgtacatttatgtatccgtttttaaataaatgcacatatttgaatgttactgaacagatgctggtaaaatgaaacttacatgaccaagaataatgtatcaagatggcagactgagctcaatgttcactttcccacttccagctcccattatatgaccaaaaaatgatgctaagattaataagtaaatccaagataagactgatattggcaaagcaaaatataccaaaagtttccagagactagatggaatcagctctagtgagagaccataagaagccagaacctaaaacacatgcagaagaggggtttcagaggtggcagttgttcagggtatctaaaagatggatcagctgatacaagatacagaagttagtacaagaaatttcttcagggagattaattgcactgtatttggagccagttacagccttatgattataactctattcccagacctattctcttgtggtgggcagaggacaacaggcaagcttgtcatgagacaaaaatgaaacccagatgtaaagcatagcaaaaataaattctaaaaataaaataaacaggtaaaagggccacgttttgaaggaaaagcaacccttataatacaggcaacaaacaaacagtactaacatcaaaagaaactgatgatgatacaaatagaagaaagtttaaaataaacacagtaaataatattgaggagagtcaagagaattttgcatttccataaagcaatatgaatttgttatgaataaatatagaagtcttagacgtttgaaaaatgaatgtcagctgggcggggtggctcacgcctgtaatcccagcactttgggaggccgaggcgggcggatcacttgaggtcaggagtttgacctcagcctggccaatatggtgaaaccctgtctttactaaaagtaaaaaaatattagctgggcatagtggtgggaacctgtaattccagactcgggaggctgtggcaggagaattgcttgaacccgggaggcggagagtggactgagattgtgccactgcactccagcttgagcaacagagcgaaactctgtctcaaaagagaaaagagagagagagagagagagaaagagagacagagacagaaagaaagaaagaaggaaggaaggaaggaaggaaggaaggaaggaaggaaagaaagaaagaaagaaagaaagaaagaaagaaagaaagaaagaaagaaagaaagacagaaagaaggaaggaaggaaggaaggaaggaaggaaggaaggaaggaaggaaagagagagaaagacaatacaaatgaatatcaaaacaaaaatcttaattgaccagctgaatggtaaaaaaaaaaaaaatgcagctgaaaagcaaataatgatttgaaaaactgagctaaagcgttttttcgtataactcaatatgatggagcaagtaaatagaacaacatgaacaaaagagatacagagaacacaaggcaggagaatagtgtctggagccagggaacctaacagccaattcgtgctgacttcctagaactaaatggaatggaaaacaccacctctctacacccaagtaacaaaaggatcagaggctacaccctttacaatccccatctcctccccaccgtattgcacatgaaaaatattctaagaaataaaataataaaaatattttaaaacatggaatatgatgaaacttttttgttaaatgattaaacattaacttgaatgatactagcgtattaatcgacctgttccacagcccagtccagaatgttcccatgattgatagggcaaagtggtccagtgtgcaggtttaggaaccaaaaagactaggattcttgttctaactctgtgactccctggccagatgaccttgggcaagttatatattttctctaagctccagtcccctcaacgtatatgcaataaaagtctctatatcctagtgtcatttgtgaagattaaatgagataatctacataaaacaggtagtgaatacactgcaggtcttccataagtacttgaataatgttaattattactagtagtataactactactgataaaattattcacaatgttgcttagtaatccagatatgcatggactgcaggaatatttttatgataatagataaaataaactatgggaaatggaaacaataaggcaaagagatatttgtagagctaaaaaaattgtatcaaggaaactattcacaatattttctatacattaattgacagcaaattttgaatctttatctttcaggcagtattttgagacatcaagttgactccctcatcctgcaaacttggaagcctatttggaaataaactatccatcaccaaataagatacccacaaaatgctagaaagaaatctccttttgcttctcccaaagtgagtacatatgttagcctgaaccacattagacatcccgattcctattgacactggaagttgtttcaaatcttgagccataaaatcttctcatctctgactaattccctatccctgtcaattgggtttgcaataagtctgccaactgatttctagggaatgatttctaagccagtcttccaactttacttttttattttttaaacttgactgattgattccaggactttgagacttccattacctggcattgaattgtaaagaaaaaaacccatcatcttttgaggtaaggagccatgggagaaagactctggtctatcacactacagagaggtattaatcaattaaagatttcttcaatgctgccacaccccaaaatatatgtattaatatttgatttatattataaaactaatcccctttagcctaacttacatatatatattgatattttatatatgtaaaaatatgtatatatagcttttgagattgatttaactaaattacatgattaattatttcagtaaggtaggaatctggaacattgtcaataattacctttccccctatttctcataggtccttacttaatccttcatttgcatattggctaattgtttctctaatataagctatgttgatattagctatatgattgaattaactttaaaaggtatacatcaaattatcaactacagagaaataaaatgatttccactccataaacatacacaatatacatcaacatatataggtgtttgagttcaatatgtgtatatttttaaaaagatttacgaagcaggaaatctttttgaatcccattgagtgagagtcactcctgctagctggagttagccataaagcagaactcgaaattttgccgcccggacctctagagggcagacctggaacctctctagtaccaccttcaatagcacagcaatggggaatgagatgcataaatcatttttaactatattcagacaccttttggggacagctacaaagtgctaagcacaaataataagaaaaaaaatccacatggtcaaagaaaggaaattacaatatgatgtaatgctctgtaatagcgggaggttatgaggaatagacacaaggttccttgaaggaacaaggaaggctttctggaggaggtgataacaaagcaaagtataaattcgtcagatatggaattttgggagagtgttccaaacagtgcaagcagcaaatacataagcttcaggtaaaatatattgtaggaacactatatgtagttcagaaaagcctcttgtaggaaagcaacaccttacagatttaaatggtaaaaatgtataaaagtagctcaagcattaaatttttgccagttattgagccaatttttattttccatatttctatttttcaatatgttaaagataactctaagctgggctcagtggctcatgcctataatcccagcactttgggagtccaaggcgggagattgtttgaatccaggagttcaagaccagccaaggcaacatagcaagtcctcaattctacttaaaaaataaatacataaataacactaaaaactacatattaggattgcaaaaatttgcttctataaaactatggcctgccactgaaaaggagaaaaaaaagaaagaacaaaattgccaacttaatttaaacctgtacaagcatacaaacagactcaagttctgaaatagataatcaaaaatgttcacctaaccaatgcatcaagtgaattttatctgaatgtgctgtggcataatagtgtttggaggtatttagaagatggtaaatcccagaatctttctaattattctttgagaaaaaataacttgcacattttgaaaataaatatttcaatatataaataaactttcagtgtataaaaacaaatttataaaacaagtttatctacctctttcattatatatgaaaggtttttacaaagacctttttaataaagattctaaattaatcttaaattaaggttcacctcaacgttcttaaatatgaactaatgttcaagcatataattatatttctagttatagtctccttgacagcactgaaatcattccagataacatgattcctattataatatacctagggaaaataacccaaactaaaaattattagggggttggttatttaaatacattattttgaaaatggcatcgagtatagcctgaatttttaattctaaaacccaaaactcaggcaaataaacttattaatagagctttgattggccccttggctaatgatccgtggctcagagcatcaatataccaggtttcagatcatgataagtataccaaatttctatagattgtctggcaaagcagatactatcactatcttgtgacaatagtcttctaggcttacgtatcttgccggtttaaaaaagaaaaaagaattccattgtcaatgtatttattaaaataacactgtattttattgatttaagctggacatccctttacattttaacttcactgagattgggatgcataatgaaattaatgataggaaaacattttgctagagttcaattagcagaatttttctttattacctaaaataataattcaacttcaaatgaatggctgcagatttgctaaaatatggttatactactattactgctaatagtaaaaatggtaatgataataagtagtaatcaacatttactgattgctgtcaatatgccaaaccttatttggttatattatttgtattaaataatttaatcttcaaaaccttcaatgaacagagaagttaacaaaagtggggtggaactgatgataaatctgtttgattacatgtgctagaattcagatacattcttctgtttgtaaaggaaaaaaagtcttttaaaattaaataaggaagatatttgtgctatatattactgtcttaaaattatcaaaaatatcaaaggactattaacttatatctgttctttaatttttactctattgttcattacgataccataaaatgactatataatgcccgttattatggtaaaccaccttcttaacatttacatctgaatataattacatatgaaaggaaatactcaaaaatcaatatttttattctgttttttaatcaataaagagaatactcagcaactttttaaaaatatttactcgtagtcatcctataatcctttgcatttaaaaacattttcctatctgctaatgtttttacattattggacataaagtaaatgcttgtcaaaaatcaatagtctccaaattcataacttatatttatctaatccttaagcactacacagttctaaacaaatagattttatactcacatctgtgatattttgaagttacctgagaagaatattaatgagggacacaaataattactaaaaatactcctttgatcaatttcatagttatctgatattaaatttccaagttaaaaaaatttaaacataattttaaaaagtcaagggtcttccttattcaagaaaattggtttaattctttaacacaaaatatttcaccatatggtcataaccagcactattggcaaagggccttacatatattggatagtcaggaaatatttgatgaatgaatgaacagatgcatgaataagtggataacaaacataagcatattcatctattttatttctaaaaatgtctcaagttaacatttttcatttgaaagatattttcaattacttactgagctgtatttttgcaactatgcaaatgatagcactaactttaattgtattcatttatctttaatcagcattattttattctactagtctacaggggggttttacacattacaaaatgcaaattatgatacatctcgagtttaagagaatgtcatttgtttttggattcccctacgacacagtcgagatttatttatttatttaagtaatcactcattggccaaatgtgttctgatttgtttctgatagaaacaaatgtcaaaatgacagaaattcttccttatcatattatcattacgttggacaccaaggacatgaagatgaattaaatatgtttctcacccttgatgaactcctagtaggttgtttaatgcacatttgttgaataaatgaatgaacaaatacaaaaattttgaaagcgctgcacattcagtcattgtatttagcaatatagagaatgagaagacagtgactatactcattttaacagttcacaacactgtactctattcataaaaccacacatcttaaaattactgacaggctcatagactatgctggctacattagattaatttcataggagcatatttagtcttatctacaaaattagaatgttcacaggggtaaacactgctttgaagttcaagagtgtgaatgaatagaatcttttcctaagagaaaataaggaaattgacagcattcagagaactatatttgttcctaaaataagtctattcattcagtcacagccatgtaaattggcagctgctctgacttagagaacaagattcatgctttacatgacatttatcttagcccctgtggacagagttcacatgagtaagcctatattgaccatggccctttttaaagatttagagtatctatgaaatgaaatgcttacagcaaaaaatgtttttctaaacagaaattttagttatatgtttttctaaacagaaattttagttatatgtttatcaaaataaaaatcattaaaacttattataacttctgtagtatgttgatttggtgtcccccaaccccccaaaaagatatttctacctggaacccatgaatgtgatcttctttggaaaaaggatctttgcagatgtaattaagttaaggatgttaagatgaaatcatcccagattattcaggcaggccctaaatccaaaaacaggtgtccttatgagataaaagcagaggagatttgaaatactcagagaagaaaaccatgtgaagatagagaaagagactggagttaacacagctacaaccaaggaacacttgggggctactagatgttggaaggggcaagaacatattcttccctcaagccattagaagaagcaacactttgattttggccttatgaccaccagcactgtaagagaataaattcctattgttttaacacatcaagtttgttgtatgttgttacagtggccacaggaagctaatatagctaccaaatcaaaaccattttcaaaacagtctattttaagtggtataaggaagttgagagtgagagagttacttaaatgagattgctgggttttaggattagaattacacttgaagatgtagcaataaattgagctaatcattcctcccaatctttcattatataaataaaaatcaatggctgaaatttggtttcctgagacagtttttcacccccatctctttgacaacctgttgcttctaaatgtcccggacatttgtatcctcccacctgtctgtactcctactaatcttctttagaaatataacatctcttgtctaaagaaatactctccttccttgagccatatctgtattctaattcacctatccctcataagccagaataatcttcctattgtttccataacttccgttttaaaatcctcaatcaattcttgttaacagggcaaattttaccagctttggaatgctcttcaagatgcagccccaacatgtttttccagcctcgttttttgaccatggattgcccaagacagtgttaagtgcctccttgttgctcgtggagcatcctgagactgctgttacaggatttatcacaaagctatataaccctctgcctctcccactagactatgactctcttgaagacatggataaggtattatttaccttttaaccctcaaaaactagtactgcagcaggactatcaaatctaagcttctggtggtctaaacataatcaccaggtgtgtatatttgcaggaaaacaagagtattgtaattattattattttatttgtttatttatttatttttgagaatcaaaacagcaagttttctattaaggatttcaaaagggaaggggtataataacagagagtaagtacaaagatcacatgcttcaaagggcaaaaagcagaacaaagatcacatgcttctgagggaacaggacaaagggcaaaagcagaattactgatacgggtccaacaaagatcccaaggcaaagggcaaaagcagaactactgataagggtctatattcagtagtgcacgtattgtcttaataaacatcttaaacaacagaaaacagggttcgagagcagagaaccagtctgaccacaaatttaccagggtggagttttttccccaccctagtaagcctgagggtactgcaagagaccaggacatatctcagtccttatctcaaccacataagacagacactcccagaggggccgtttatagacctctccccaggaatgcattcctttctcagggtattaatattaatattccttgctaggaaaagattttagcgatatctctcctacttgcacatccatttataggctctctacaagaagaaaaatatggctctttttgcccaacccagcaggcagtcagaccttatggttgtcttcccttgttccctaaaaattgctgttattctgttctttttcaaggtggactgatttcatattgttcaaacacacatgttttacaatcaatttgtacagctaacacaattatcacagtgatcctgaggtgatgtacatccttagcttatgaagataacaggattaagagattaaagtaaagacaggcataaaaaattatataagtattatttgggaattgataaatgtccacgaaatcatcacaatttatgtccctctgccgtggctccagctggtccctccgtttgggggtccctgacttcctgcagcaggactaaatgaatttaaaattttattttaaatttagtcccatgtgtttagtggccacagtattggacagtgcagatatagaacatttccattatcacagaaagttctattaaccaatgctgagctaagctagactcaatgtttttggaagagcatttcagctaggtgcagtgactcaggcctgtaatcccagcaccctgggaggctgagacgggtggatcacctgaggtcatgagttcaagaccagcctgggcaacatggcgaaactccatctctaccaaaaatacaaaattagccaggtttggtggtacatgtctgtaatccaagccactcaggaggctgaggcaggagaactgctcgaacccaggaggcagaggctgtggtgagctgagaccacaccactgcactccagcctgggcaagacagcgacactctgtctcaaagaaaaaaaaaaaaaaagcatttcacaggtagtgatgtgaacttccttcagaaggcatataatgtctggatgtttctctttgtattaatttagcagtcatttaaggccattgcctggacctattacttcattaggggttgcaaagttatgacattataattctatcatctccaatctattttattgactggaatgcttttagaaaaacaaaacaaaacaaaacttcctttatcaaccatttcggttaccgtgaagaataaatttatacaggaaagttaggatccaaaggtgaccaattagggttgttttttagtataattatgaacttgtgcacttaaaaatatttgatatgttttaattcattgcagttattgttcttattactactcaaattgtcttatctctagccaggattgtctttggaatccttttcacatgaccccagaagcttttgataacatttttctgatacaacaagatattttaggctcatcctgtacatttttccctcaaacatggaatcagccacacttccaaaaagtcattgtttattttaagacgaaattatatttaggtagtatggtctgggccctaaggggtgccaaatggtactgggctggtcattgtttctaagccttttcagtggacaatgctaagaactgcatttttttttttttttttttttgacggagtctcattctgtcacccaggctggagtgcggtggcgcaatctcagctcaccgcaaactccacctccaagctcaagcaattctccgcctcagccacctgactagctgggaccacaggcgcttgccgccatgtccagccaatttttgcacttttagcagagatggggcttcaccatcttggccaggctggtcctgaactcctgaccctgtgatccacccacctcagtctcccaaagcactaggaccacaggcgtgagccaccatgcccaaactttttgttgttgttgttgttgttgtttttattttattttatttcattttttaagacaggtctttctatgtccctcagcctggaatgccgtagtgcaatcatggctcacagaagtcccaacctcacaggcccaagcaatcctcccacctcagcctccccagtagctgggaccacagatgcatgtcaccacacctggtcaacctgttgattttttgtagagacggggtctcactctgttgcccaggttggtctccaagccctgggctcaagccatccccctgccccagactcccaaagtgctgatactacaggcatgagacaccatgcccagccaagaaatactttccttttttttttttttttgagacagagtctcactctgtcgcccaggctggattgcagtggcatgatctcagctcattgcaatctccacctcccaggttcaagcaattcttctgtctcagcctctcaagtagctagggctacaggcactcaccccaacgcccaactaatttttgtatttttacctgagatggggttttgccatgttggccgggtgtaattattattttaacattccgaagaagattatgcacctttgaggaggtacaaagaaggcagggatgattagtctagctccagaaatacagacttgaaagagagcttgatgataaggtagaagaatttatcataagacactgttttaaggcctgggtaaatatattgaattggatagcattccctcaaagttcatgcccacaggaaactattaatgtgaatgaatgtgacctaatttggaaatagggcctttgtaaatgtagtcaaattaagataaggttacagagggttagggtaagtcctaaatccaatattactgttccccttataaaacagggaaatttggacacagggacacagtcacacagaagaagagatagagattggagtgattcatctataaactaaggaatgccaaggattgctggcaattatcagaagctagaagaggcaaggtttcttccctagagcatcttttgtttttccaagcaatcctcctgcatcagcctcctgaatatctgggattacaggcatgcaccatcatgcccagaaattccctagagcctctgaaggaaccatggccctgccaacactttgatttgagacatctagcctgaagaaccctgagagaatacgtttctattgttttaagccacccagtttgtcatacgtcattactgcagccctaagaagctaacacagcaactaaacaagatattgaatgtggggaacagcattttcttcatttctgtgtagaacatcacttggatttagtgcccatgaacttgataatttgtaactttggaaatactggagaaaaacctctcttgactcaaactcagcgttgtcactgtgcatgctggcccaaatagcagttgtgagatgccattctcaagtgccttcaagaacagacagcattaacaaaataaagccaaagtggaagattatagaatgttaatctactcagcctatgtgacactctctgggatctccccagaacaagtaggtgagattttttaggggagctgctcaagttttaaggacaactccattgcaaactctactcttgcctgcttagaaagtagttcaaaacaacttgctttaaagtaaaactattcacataaatgtccaactctaaacagacacgggctttgtgaaaatgacttaaaatgaaactggatgattaaatttgtattattcaagatgtaacatggagatctgtaggtagatgctaaaaaaaatagcttggatactttatgctatcataaacggagtggtcaatgacatttagatatctgttatctttagagtattatttgatcaaatctgggcatttatttttaatttcttttattttactgcttcaaacacacctctcacattgctttatttgaacatggagacatagcctcttttctcactaaataaatcccattacccttcaaccattcttcctgtttaaaagtacatagtcaacactaaataactgaccctaattcttaaacatgtagctggcatttaataaaatcatggctgaatgttgagtaaaaaaatgtacataatattgtttacttgtgcaccctttattggcatctagcttgtatattataacctcttttcctcttttaagtatttttcttcagccaggcgcagtggctcacgcctgtaatcgcagcactttgggaggcgaaggcggatggatcacgaggtaaggagaacaagaccatcctggctaacacggtgaaaccccgtctctactaaaaaaaaaaaaaatatatatatatatatatatatatatatatatatatatatatatatatatatatatatatatatatatataaaaattagccgggcatggtggcgggtgcctgtagtcccagctactcgggaggctgaggcaggagaatggggtgaacccagcagacagagcttgcagtgagccaagatcgcgccactgcactccagcctgggcaacagagcgagacactgtctcaataaaataaaataaaataaaaataaataaatcttttccttcctcttccaattcactgtcaacagagatctttttctaaaatgtaaatctgttttttgtcttcagtgattggccattgtccttgggatacagtttgaacctatatcagggctttcaaggcaaacaagaaaagtcttagacaatgaggtgaaggaccaactctcagacaaatcttccactcaaaattttgtgcctgggacctgtttctctgaattgcccttagctccactcccctcctggcatgttcctactcagcagtccctctgtcaatcatttggcatgttatttagcaacatttttcaaattgctttgtaattatttgtttctgtttccaccccctacccccacctcccaagtaatttggagctccctgaatatcactcaatgcatcaactcacttgggggtagtgcctacaaccaccaatagtaaactcacttcagctctctccattacagtgtctagtattttcaacaggaggatgacccactgcccttaaaatgaacttccaagtgccagtacttgaggccctttgaccttgaacagttttagaatgcaaagtcacaggggtgtgaggtactccatttgcattccacactctaatgagagcacaactcatttttacatatttgattgcatcatatgttttataccaaaatagagcattccctaaataaagagaaatatctataattagatttttatagcgtaggactactgaccagaaaaaaaaaaaatgcattggtgcattggctgccaggaataatgtattagacaaaacacaatgtaaacttcaattgttgttaaacagttctttccttttgacaatgactagacatatatatatatatattttaactttttttttttcaatttatatgccccctacttggttttcatcaagttcacatcaggggaaccctgtgataatcagacagaaaaaggttcagcataggaaaagctcaataagcagtgggaagcagacctgaattcataacaaccactgaaaagtggactgaaacccaggtaaatcaactatgaaaaaagacgaattatgagaaacagaaaacaattcgagataatcactgttaattacagagaaataagttcatattaaaaactgtcttagattgcattattctgtaacatattcatatctagcagcttttattttaaatttataaaaaatctactggcatatcatgcaaattttaaaaaatctagtatgaaatattagttaacatgttttaacttttgttctctaaactttatgaatttttaagtacaattggtttttacttgatttcaacatttgtggaggagaggggtggacaaatctatatttaatatgcaagatgaaattctagaaaaataggacctgtattttatattttcagttaataagctttttacatagtggtgttacccacatattaattacaaataaataatgatagtgagataccttaccttgcatagtatctctgaataaggtaattaactcctcaatgcctcattttctcatccataaaatgggcataatatatacatttgagcattatttggggacttataaaaagaaagatatgaaacactgcctcatagttgtcacttaataaaaggtagttgtcatttttattattataaagtgccagatgcatggaaaacatcaaatgattatactcattacaaattatttttaaaatgtcactaaaattttttaaataattaaatatgcagcgtatttgaaatgtgatttactttgagaaaaaagagcacacacaagtataacaacagtctttcaatatgataaaaacatatcaggtgtggattttgctgcacttgtattttcaaactagaatactacgaaggtaatagaatgcaacttccttgagtgtacattatctttaaataatttcttggaaaaatacattgtttttattcttaaaaaataagtggtatagagaagagtaaaaaagctaataaatgttatttataaaccttgaaacttctcattttgtgcaagtggctttgagagacacacaactctatttcagtataacccaaaactcatttgttggccaccagacagtagaatgaaaaggttgaaaagaatctcaagtatgaaaagattgagaagaattccctggaacataatgtaataaaacttattttcaattaaaaatatgcatcttattcagagacactatgcaaggtaagataaatttcgactcagttgtgaatgcaaaggccatgctctctcagtatacaatgttgttgcatataaaaattaatatttattccacatctaattttccttgggcatttttaggaagacattcatgaagttttgcacatcagccaagactcttaatacctggaagtgactattgtatattaaataataatttccaagtaagccatttgatggtgcctccactctggcctacagtggatatatcttaaaagagcttgcccaaatagatggtttgcctctggaagtttagtgataactattactactaatctctaatgagtattagcaaaatgattcctgagaaaataagcatgccacactgaaaattttctatcttgatttctaacataatctgacaaagataatgttttaatgtagaaaaagaagctattggcattatccttgatgattcatcaaagaggacaaccatatgggagatcaacattatacttagcttaaatgcagagtcttgaatggaaaatataatttagggctaaagaaatatggctaaactataagaaattgttgctggccctgggaacacttttaggtaaagtattaaccaccaccccaggaagaataacaaatcctaccagatgtttcattaaaagtataagtatattgggaaaggaatattgtgaggagggacttacagagtcatccaacaagccacagcaggactaggatatcacatcttcaataattctctcacctttaggtttaacctgagataaagaatacaagggtctcagcagctatcctgtttctattttggatagcccggagtgctccatttcccagtattcctgggggatatgacatattaatgatatcaaaatattgagtcacttaccaaatgtgacctaaggattctagagtgagaaaatattctaccttgatgtatttggaaataaaccagcatagaagattaagaccttaaattatcatctttaaggaactaaacattaatgtctagttcattgtttcttaattttgtttcacagacccctttgaaaagctattgaaagttatatacgcttaaatactaggtatagagaaatgcatttactcagtgtaacttgcagataattttatagggttcatagaacacattagacaagactaaagacaccagttcaagaccctctgggtctgtatttgtcagttcttttcaaaatctctttcaatgaatatatattttcctcctgattttcagttatttcacagcattcttggtcaaaactttaagggtacttaaaggagacagggagaacattcaaattgggcaatctggggatagttaaataaaagatttatttacaaaggcatgcacaaagtgtagtaaaagcaacaagaaatagttcaagacccaataactggcgaatcattacattaaaaagtgagggggagcggtggttatgggagctcataactactgtcatcttatctctgacaggcacattcattgacatataccaaacagaagccagagtacaagaagcctggttgatgtagttcatagaggtcatcctcccgaagcacagagcagcaaagagaagggtagaggaagtacctagagggacaatgtagaatatctgagaaattagcaaagcaggtttctttacaaaaataatgcaatttctttcaggaaggtcttagaaaatgtctggctctttaatagtatgtatgatgcgcccttattatatagccatctttaaacaataacaatggaaacttctaaatcctgctgaaaaataaaccttatttttccatatgtgtttgcttattcataatctgccgtttttaattaaaaaagcatttaaggttatctacaaaaatgcaaacataaaaaatttagcacactaacataaaatgatgaatggaaaaacacatgtaaaagggaaacaagaatagaaaaataggcagggcacggtggctctcacctgtaatcctagcactttgggaggccaagatgggcagattgcctgagctcaggagtttgagaccagcctgggcaacatggtgaaaccccatctctactaaaatacaaaaattcagccaggcatggtggcgggcgcctgtaatcccagctacttaggtggctgaggcacaagaattgcttgaacccaggaggtggaggttgcagtgagccaagattgtgccactgcatccagcctggaaaacaaagcaacattctgtaaaaaaaaaaaaaaaaaaggaaagaaagaaaagaaaaaaagaaagaatggaaggaaggaagggagggagggaggaagggataagatggggtcaaggataaatctcttattttgaaatccaaaacaagctagagatggggtctatatttaatgttaagtatacttgcagtcaataaaatggtaactaatttgcttacataatttaaaaggtaaattttataattataagaaaaaacatccttactctggaaagtataatttctagaaacagaaaaatgattcttatgtagatactcatagagaaaattctgctacctaatgaatgaacaatatattccacagcatccttaatgcatatgtatgtctacagagaataagatgcatattctgcttgggatataagacatgttcttttattaaagcaaaggagttctgatttactaggagtaagatttcttcaaagttcagtagaagatcaaactacttaacaatcctacgcttcatcttttctctctaaaaaaaatagactcaatatgctaggacaatattagaacttatcatatatagaggttcaaaaaataattaaatgaatgagtgatttttggggattatcagccttctcacttgttctactggatatatccaggtttactgaatcctaggtcaccttacaatgagaatatatctctgttaaagctttttaatgttttcctaagttttttcaacatgtattttatttttaagctaggttaacttatatatctattggtatatacgtttgctctttcttttacttatatttatgtaaatcaaactcagaatgctttataaaagtgttacctacaaatgtatcctcaagctatttaaggtttttagagtttttattgcctcatacactaagaataaaatacatattcttcttaaataataccaattaagcttttctcacaattctcagcctactgcctgtagtagttactttactgatatttgtcttccatttgttaataattcagatcattcaacatgcaattggtatcacagaaacaaagtcttctttcaagtttccattttggtgccattaggtaattttcaggaattattctatgtcacttattactaaacaggtttttgttatagttcatattttttttactgctaccagattttcttatcattaaaatcatatgtctacataaaaaggtaagaagaggtaatcataatgtatttatggattacatagaatagacagatccatatactttacattgatgaatctagttttagaatataaaaatatgctcaccatgattatatagcactttcttatatgttttagtaagataatgaatattttattcctgatagatgtttacttttctcttcttacctttttgatccagacatatgattttgatctagaaatacgatgataaaaataattagacctttagaattcctattcaataggtataataattattgtctgatgcctaagtcttaatgcatgattccaatggcactcaaaagtgaccctttaaaaactataatcttgtgtagtttgaagtcgggtagcatgatgccaaaagagcatggtactggtataaaaacaggcacatagaccaatggaacagaatagagaactcaaaaataaaaccacacatctataatcatctgaccttcgacaaacctgatgaaaacaagcaatggggaaaggattccctgcttaacaaatggtgctgggagaactggttagctatatgcagaaaattgaaactggaatccatttctcaccacttatacaaaaatttactctagatggattaaaggcttaaatgtcaaacccaaaactataaaaaccctagaagaaaatctgggcaataccattcaggacatgggcacaggcaaagattttatcatgaaatcgccaaaagcaattgagacaaaagaaaagattgataaatgggatctaattaaactaaaaagcttctgcaaagcaaaaggaactatcatcagaatgaacagacaacaaaatgggagaaaatttttgcaaaatttcttaaacaaatttacaagaaaaaaaaacattaaaaactgggcaaagtacatgaacagccacttctcaaaagaagacatttatgtggccaagaaacatacgaagaaaagctcaacatcattgattattagagaaatgcaaatcaaaacaacaatgagataccatcttacaccagtcagaattgtgattattaaaaagtcaagaaacaacagatgctggcaaggtttcagagaaataggaatgcttttacaccattgctgcgaatgtaaatttgttcaaccattgtggaagacagtgtggcaattcctcaaatatttagaactggaaataccatttgactcagcatgactcagcaattccattactgggaatatactcaaaggaatataaatcattcgattataaagatacatacacacatatgttcactgcagcactattcacaatagcaaagtaatggaattgtcccaaatgcccatcaatgatagactggatgaagaaaatttggtacatatacaagataaaatactatgcagccataaaaaggaaccagatcgtgtcatttgcagggacgtggatgaagctggaagccattatcctcaccaaattaaagcaggaacagaaaaccaaataccacatgttctcacttacaagtaggagctgaacaatgaaaacacatggacacagggagggaaacaacacacactgggacctgtcaggggagtgtagagtggggagagcatcaggaaaaagagctaatgtatgctgggcttcatacctaggccatggtttgataggtgcagcaaaccaccgtagcacacatttacctatgtaacaaacctgcacatcctgcacgtgtaccccagaacttaaaaaataaaaaacataaaaaactataatctgaaggaaaattaactgggtttgagttttatttgtatttttttgtttcaaagttttattataatgatagaaatggtcacaaatgaaataattcatttcttcaggtaaagagtatcctcttttgaaaggcaaatcttcctgcttctagaggaattcatcttagtgaggatttatgcaattagatgacacttcttcctggtaattactttatgtggaagtaaggagggccatctttatggtggtgggaaagggcaggtacattgcagaggtatagaagtttgaagttcattttttttttattacgtttttattttttcatttgcacataacttattgtttaggaaatttcactagaaagatctctgtcatggaatatctgcctagggagtatagagaaaagtatgagaatcatgggaacactgtttaatctggagatctccagcctggacatgagccattatacaactcaagcttttatgcttatctgatgagttatatttatatctcagcttcacttctaaactttgaaattactttactacataatttttgtagtccattgtagttcattttgaaatttcatccctaatgtcttttccagttctgcaattctgtgatctgtcatcttctgaactgggtattacatgttctctctcacacacacctatgagatgatatttccagatgtttatctcttaagaatgcactagccaacaagctttaaatgatagacagggatggttcaagtacaaaaagcagtttgttaagtattagattaataaaagcgtttatacaagttaattttttaaaaaaaacagatgaataagtcaatcaaaatctcaaaaataatgattgaatcagtgcaacttctctttctcaatttattaatgaaatatatgcagacttcaacatgcatcatgcaaaaatttactgagatggataatacagacatattgaaatggataatatcaatgtaaatttctgctaattcaacttttcttttgaaaaaaaaaagaaaacaattttattgctctgatgagtagattcaattaaatcaaatgtccccatgggtgtctttgaacggtagtgatacctaaactggaaaggaaacgtaccttttgaacaatatccaggaaatgaatatgtgtctgtgatgatttttaggacaaaatagaaaatatacaacaaaaacttacacacaaaatattggctttttttttttaggaaaacaaatcaattataatttctggaaactaatcaaataaaggagctcactccctttagagtataatgagcttcatttgtcttttgtccccaaaattctaattagattgtcttccattttctctcttcccttctctccccttttctctcaggcagacacaatctcgatacccagggtattttaggtgtgagctgacttaaatctttgtatttcaaactgcttaatcaagcataaatggacacagagtgtttcattctcttttaagaatgtattatctcagcccagatgaaatgactggctctttcattctatacctctgtcccccttcttgctctacctaatttccaaaatagattgtggttcttcaaaacaacttgctgcaaagcacataaaaaaaaacaaagagctttgttaatgttatctttatattatcagaagcaataatgtttccattatttatgacataccccaccacacagaaaatcaatgttaataaccaaggaacacaaagaaaatcccttattgcttcgtgttcacacagaagttctaagacagaaacaggctcaagttgttccttagatctccatacttcttagaatcccttgacaacattcttgtaagtcattttgacattcaaaaggagatacatcaaaaaggttctattttcaaaatcattttcctttttcttttactgacagtctaacaacacctatcacttcctacttacctctcactctcttcatgtgttgtcctccaaatctgtggataaatcatgtgacatattcaacgacataaaaaggaaaagagtcaagtattcaaacagaaagggttgactgagcaggtggcctaaaatcaatcctaaaatctacactctagagagtaaaattatattggagtctgatgtgatatgaatatcaaaatgtagtaaccaaggaccttggattcaggacaatttagttcacattccatgctatcctttccttgatgtgtgatattcagcaaattaccaagattccctgagctgtcttctctataaataagggctaccagtacctcctttaaaaagttactgtaaaataaacatgtaccattaatgtaagcatatagtagacacctaataaatggcagcaaatatgattgttagtattaaagttggcagtttagagaaaggagaggtcatatagcttttagacatactggtacacggtaactccttgaagaataaataggatttacagagtagaatgaggagggcatttctatcaattggtgcacttaggaaattctaatcatctatttctaataccatacccattatgagaaggcacttgaaaggtgttatgatagtcaccctatttgcagcccactacctagtatcaccgaaattcattttaaagtattattctttgtttaacagccaagaaatgaaatgggaaaatgatttcaatagttgtactttgtatgtattcatatttatgatggaattacaaagagaagtagaaagtcttgtccaaagagaaatcattttttaaaatgctgatcctcaagaacacttgtgataaaggcagataattttccttgcccattacaccactagaaagtgtgaatagttcatttgagcctgtaagattgcttccttttatccctgacacagtatcattcaattatgttcctaagtctgttgcattaattatatcataagacttaatatattagcttatcaagaacttctcaatttaggtaatgagagcttccctgagaaaaaatactcaaactgaaaactagtaaatctactcatactcctctctcttttctagaaaaggtcatgggtcatcttcagaagagtccctaaaataagtgatgagccaaaattcatataaatttctttcagtcaaaacataattacaccgataatctactgaaaataaagaactttattttctaaaatgtgttatatttgctatatcttatgtgactcagggcaaatctctgaacttctctgaagcttaacctgttctcttgtttgtcagagtgggatgagagtaactgtcctgcttctcccataaagtctcaatgaggacaaaaataaataatagatgcgtaaatgctttgaaactatatatctctatgcagatattattattaaaatcaatattaaatggatacgtaagccaaagcaagcaagattaaatgaggtcacgggaatttttttaaggacaagtaaaaaagagacctttaaaaatagcaacataacatgtattcaataaatatttattgaataaaagaatgaatgaattttagtatataaataaaacatatttgagtaaaaatatcacacatataggtttttcagtcacctataaggttcctaatagtgaagtttaaattgaacattgtcttgataattttatttaaaataataaacagaatattcatcgttgagctcacaatataatattttatactgtagataccagaacctctataactacttgtgaaaagaatactgaataagtgtatgaacaaattcgtcactcaaaacaacttctaatgtaggaaaagaaatttcaaacctatttatttttagcagccacattaatagtgaattattataaacacaccatttaaaatgcatcaaaaactttctagttggtaaatattaaaaatcagtgtacatgatgctaaatggtgggcacaatctttcaaaatggaatatgaatctcctcccagaatattaaaacatgttttttcgatattattgtttgaattatatatttgcattaactcttcctagaagcaatatatgcctatggctgaaattcagttcatttatgcaatctcaggtaatctcctggagaatgacatcaagtataacctctgttttgacacaaataaaaatataaccaagtcttcctagttttttcaagctaatttttccaagagtgtaaagaaagattcattcattaaaataagtagacaaaattgcttttccataaaaataacatactatttaataatgttataatatttagttgatactaacaataattaattaatacaaataataatttgtaatatttgtatttgcaaattgctccatcatacatcaacatctcattcaagtcacatcaaggttatatatgtggtacaggtattatgtccagttactcatccataagtgtgaggtaacatctgtgctatttaatatgctaagcctcagtttattcatgtaaaaaccaagctgaggttaattatgaatagcattggagatagatgtacatgaacacatattttaaacactttcattaaatttaaccatggaaaatataatgttcgtgagaaattatatgtgttaatacaataacagtctgaatatttcctagtgatgggtcacatgatcagaaaatcaaaggtgcataagtcaaattgggtatttatttttttatttcatagaattggagagtttagacccttagcttaattataggttttcactgtatacaaaagtgatccaaaaaccagattaatatgttatttttactacataaacaagagatccaagcacagtgcttatcattgatcaattttgtaaatcaatgagaatgtggatagttaagggtctggagaattgttgagaacaaagagtgagtatgatatctttattcttactccttggcttcactttacacctctgttgatcactgtttccatttaagcagttggcctgaaaacagaacctactttcatggtgacagttacaaactccacagttttactctctggccagagaaatctggatagatcttagatttctataactgacctcaggagtccaagaattctctgtttcttagtcaatatagttcactttgcagcttagtctttatttttttttcaatattttaacaatatatcttgcatctgagtcatgcggattgagcaaaaacttccataactggagcaatccgaatatagtattttgagagcagaaacagagattcaacgtacaactcataatcataaaaatctaggaaagctttgtagttcttcaaaatctgtgactgcatggaacttaggaaagttcagcaacaggaaatgaaggaagttgccagttgttgtccagcaactagcagacaaaactctggaatttgtgaatgccaacacttccttcaataatagcaatgcccctgattttttttcaggcttcaagttgtgtgtgttatgtgatgtcctgtcacatcagtagaaaagtacaatcatgtgacacaccaaaggcctgacaagtttggttcctatgaattcttcaatttccaaaactccttgaactgaggaagtggataagccaaaaccttcaaaaatatgtctacgacctaagcgactcactatattttaaaaaaatcaaactgccataggaggtttcactttcttgtaaatgtccccgcctggcaatggctagtaacacaaagacaatgatgtcttccttctatactttgtgaaaaggtttgacttttaagtttcagaaagacaaattttctcataaatgacgcaatggaaattggattaaaaagctgtctcagttggctttaataaactaccaaagtacttttgtttcgttgttccattctaggcagggaacacagcaggttttaatggtcagctaccactaaaaagctaacagactgcacgcaggcaaaacattaatcaaaactgtgaaatagtttccctttagttccctggatctccccaatttgtgccctttctgcccttttccaccctttaaaagctcaacatacctgagttctctatactttattttcttcttttacagtggtgctcacccttgagagcattcatttttatatggagcctagtagacttaacccaaaggaatttatgtctaaatgtgaatttttattgcaaaaagtaagtgggcaggagagggacattctagagttagtgaagtaggaggcaggatgtaactgcagaggtggggcttagacaccacaccaaattgaggactagctaaaacaggaccggggtggaagcagatttccacaagacatgcccaccagtgcacgatgtaagtttaccattgccatggtaacacccgggcgttgcctcccctttccatggcaatgacctgatgaccccaagttactactccttccttagaaatttctgcataaattgccccttaatctgcatgtaattaaaagtgggtataaatatgacagcaaaactgccctgagctactactccctgcctatagggtagtcctgctctgcagaaggagtcacagagctgtaatactgccagagctgtaacactgcctcttcaataaagctgttttcttctacctccatcttgcccttgaattctttcctgggcaaagccctggaaagaaaattctttcgtgggctaagctccactttggggcttccctgccctgcatcagtaggatcatactagcagccttctacatttcctaagcagaagctttgagtaacacccaaacataactaactcctattgtctagattataaagggcttgatatctgtgtatgtttttataagagtaccatttaaaaaaggatttaagattgtatttagggtttaacttcctaaagcaatcagcatgtacaaaaagataagttctgaatattcatgacatcgtgctttctataatttgcaatatctgagttgtaggttttaaaagacaagaatgcagacttgatttagatgcattcatctcatacagtcttccaaaagattgctttccagctattattttatcagtattcatacttctcaggtttcattaatgtgtctaaacattttgtttaagttcacttatgtatttaatgctcaggataataccgagtgtgtaatctataccacatctgaaatgatgtgacaaaattttcagtcaaattctacaatccccactctaacaagccttctcatttgcctcgtatattccttagcttaatctgtacttttctgccacataaggttttgcaagttttgcactgtactatcaagatgagccattcaggcataccaggctgtgactatttcacataaatagcacttgttgggcttacacaaaggatagcctgcatcctgactacaggtggtatcactgtgtgctatctactgagtttgggaagttcattaatttgatttgctcatcatttcatacaaatgatgaaatgtatgaacgcacttccatcttcaatccccatatccaatcaatcacttaatcctttcagttctacttcaaaaggagcctcatatatctccctttcctatttcactacctttatccaggcttcttctaacagtatcctgcaccagccgtctaactagctggatgccttaccaccactttctcccctatccagtctctccttcccattgctgctacttttcttgctgcaatataaagttcctcactctcttggtttaaatttctttagttgcctactttagtaagcaattagataaaatccaaattattttcctaagagacaatgttgtcttagtttgggttctttcagaagccaagcctgaatcaaagattcaagcacaaatcaaactttggtgagctctttccaagaaacaagggtagggaaatagaaaaatgtaagagagatgagaaagcagtgacaaagagtgtgttatcaatctaattacatttgttgaatcctgctgggaccctggggacctttagagaatatgtacctcaaagttatttagcacaatgggcaagggaactggggtaataatccaccaagttcaataattggttgtggactattctttgaggaatgttaattctccagcatttctggctgccccaattgtaagcagagaaagttccaggaggtaaaaccatcagtcgtgggtagtttgaaattgagccagccgtcatggtattgtaaatacagtactaaaaagacatgggggaggggtgcaaatgagagtatgtatcccaaagtatctgctaatccaccgacatttaacaccaggctaccattccagcctcattacctttcacactcttatccaacatccgtcttctgcctcatgaaactcacttctcttagacatgctagatattttatgattccttgattatacccaagctactccttctggctccattctttgcccagcaaaatctttgattttaaggcccagctaaaatatcatctcttcactaatgactttgttctcaaatttttagttgtttttcaagatcccagattattgaattaaggctgtgacttgcaagattccagaaatcgaggtaaaatgtaaatcttttgaccagtcattcaaatgtttccaagtagccacatttccttctatatttaaattttttatatatcaacctgtcattctatcatagttaaagtgaggctttaaaacataacatatattagaaattagaaaagtgcctggcacatgttaatcattatataatgccagctattgttatttgtttaatacacttaagaagcaactgtaaaagcttttttaaaaatgcagacccccaggccacaaagccagagattctggtttagcagatgggctccaggaatttagatttgtaaacaatcacactacgtgattctcttgcagagcagttgatgatagaatgaccagactttcagatatgatgtggacgatttcattttatacctgtttttatggtttaattatcaatagtgactcctttcactttcaaaagtgtcccagtttgaacaaaaaattaaatggtaactctatggaccacattttgaggttactgttctttagaaaaatgatggctgacgatatgtatcacaaaatttttagagaagtcattttctgacactttatattaaattgtgtgcagaaaagactcaaggaaagacaagtgatggcaaagattattatggcaatttccctagtcactaaactatttcccgctgcacaatccctggtgagtttagagtaggagttaagaaggagcctgcagggaaagcaactttgctgtctcttggtgcctgttttgagtctgagtaagaatgactctgccaagtatattaatattgctaaatattattttagaaaaatatgctgtaaatccagattcagaccattaatgaaagtgtacaattttcaaacatgccatttcatatgcaatgttgatgcaggccttctcagctaaaaccaagatgataatgagtcacggctggcttttcagtgagttacagctatttaaagtaatgtggtaattggaagtgacactgtagatctgtgtgtttattctgggttgccatgttgtggttatagtgcaaaacctagaaatactgaaaaaacatcaaatgtatgtgtcaagttaatttgccactccttttgccttaggctgattagcacaaattaaattggccactaataaactcaagatgttattatagaaagcaatatgaaaatgccacatatgcattctgctgattatttttaaaaagccacaaaaatgcatggcttcatagttttatatttaaacaaatatgaacagatagagactagtttaataccttcaccacttttgataagtacatatttaagcatcagtgcattatcatatcaaatggaatactttatatgtggatataattttaataaaataatctttagagaaaattacatttttctttgttcaaaataaaatatacataggaaataaagtacttgtttagtagcatacaatttggtgggggagggtggtattggcactgaccctatttctacagacttccatatggacatgcttcttgataagtttataggtaaggacatagatgggctagagagtggttcctgaaataagaaattataggaagaaatatttatatggaactgaaaatatcataagagggaaaggaagttcagttattttttctcagagagaaaaggagttttaaaaaagaaaagaaatgaaggaagaaagactggaccaaaaaaacccaaaacaaaataaaacaaacttagcaagatgactaatttcacttctatgtgagagttgataggaaactgggaaaggatattgagtaacattgagtctattcatttggtggccctattaacacagcttaaaactagatacacggcagggagaaatgatacttacaaaattatataaatgtaccattttagtctactcagaaatctataataatgttagagactgatttatattcccaaatctttcacttattctttgtacacttttagataggcaatttggaaaaacaaattagtgatatcaagattacttttctaatgaaggtagtggaggacccttgggatctcaaaagagaagctgggtatgtagctaatcattggtgctattaaaataatattttattaaattttgtaatgcagctcaaggcaaccaaaataatatcatgtcagagtattaaaactgatgataaacaattaagaaccaaattccttatatattttgcaaagagcctaaattttaaaatattaaaagcaaaaaaacttttccaatatttgtatttaaacagaaaagggaattatgtaaccttcataatatggttcttaaaatttataaagtaactgtatttttaaaataaattgagttattttaactttgatccaggaaattgtaaaaattgtacataccaaagggcaacatttacaatataagtattaccagaagtaataacttaaacagtggcatggaagccattttaggtattagttaaaattggaggctctaaggtcatggagaccttagtttaatttaatataatctctgctacttattagctatttgatctttggtaaattatttaacagttctgagtttgagtttactcatgtgtaaaatagagatattaataccaaattacgctgtgaagattctataatgaaatagtataaggaaaatactgaatgccacaaaaattgtagcaggaaatctcaataaatcataatcaaaaatgaatcattatgcttcctcatttaactacagaagaaaacacaaccctttaaacaattgcagatttaatgaagtgtagacccaaagtcttatttcttgtctcttaaaatcagtaggggttatgagcaagtctgaagatagtatacttcccactggttgtatacataataaagataattacccatattaaaaaaaaccctttgtgtcagcttactaatctgtgtttcttcttatttttatatgtcccttcagagagacttctctgcagggaatatcaattatgcattttccctacctttacctacattcactttgtgtgaaagcagacaattagttctacttttgactattaaattactctaatggacaaaatatataaaaaggaaataaatatctaataagtcaatatggctttattagctgacattttgttagttttctctattttcttaccttacaaaggattaaaaaggaatagtggttatgattcccagctaatggacaaagcaaaaactatcctttagacataataattgatgggaaaatgaaatcaaagtgatccgtacaataattttactcattgactacttcagaaagctcctaagtgatcaaaattatagtcatgtatttctttatagaaatagataatgggagtacataaacttaacagttaataacattagttggggtatggaaattaataaaagcttgggggaaacagctttagtttaacaaatgttagtttcttttttatccatatagtcaagattctttagcctttttctcttatatcatagtcacaactgatacatttagaaacgtaaatgacttggaaaagatccactgatttttctctcatttgattataagaaatatatgtgagactggtgcaaaaatgctaagccaatgggatggtttcactggaacaaagtgaatgtccacctttttcaaaattcagtttgtgtggaaatttttaggaaatgactccatgaaaattaggttatgttaattccttgctgattcattatttcccgctgacaagcagtaggaaaatatcttagataataacttagatagaggcaccatatacgatgatgttcattcagaggctaatagtttaataacagagaacataaatcaatgcaattctcctctttgagaaacactattaaaagagtagtctctctaaaattcaagcctgtgttaatcttttgcttaaaattatgaaaggctttccagttcctatagaataaagtccatgctccttagcataatttgattctacttaggtacaggttcttatctcattcctctgtccccactcagctcccagaacttaactgttttatttgggttaatgtcaaatagcttatagatgattgaatacactgtgttgctttagagcgctatgactttgcatctgctagttctctctgaggtgtctcatccctccacccacttctaactagttccatccacatgcaaaatattcatgcttcaaaacccacagctcaggtgtcatcaactcagaaaggcttttctgatgtccctagatgagataaatctttgcgctctcttctgtaataatgttttaacatacatacatttcactcttcacccatgtcacactgtattgtttctatttttacatttgctattgtcttctattagaccataaaatctttgatggcaaggaatgtgtcatgtactttcctcccgcaaatgttagctacttgagggcaaaaatgctgttttgtcttcagaatcttcagaatctaacagtccctggcatgtaatatgcactcagcagatacaataagtattaatatttcaaagaataagtgaatggataggttcatcttgtcctcattcttagcaaagtacctgacccaaacaggcatataataaaaaaattgccaatcacttgaattgattctaaaattaaacttgattactcctatgcttttgatttcctatagaggaaaagaagacagcattttttagtgattgtacatatgaactctacctgggatacatataggtaaacatttataagatatattcttaattcctcctgtattacttaagtaaaattgttatccattatatatcaataattaatatgctaaatcttcatatcagttacaaatcagacaaaactaatataggatgagtcacctttatcaacctcattgctatctacttgaggttcatattgagaagacagttagcctactgatcccaacagttcctttccaaaggcttctcctgaactgtgagaatgtcttcaaacaaaacttgatttaaaaaaaggataaaacagttaaatgctagttcaatttctgacttgttatgggcaacatgaaagctgcaattgtttctgatgagaaagtcaagagtacattttttttttaacccttctttatctagaaagcatgcattggtgacgcttatacatacagcattataccagacgccgtggaactagttcaaatcatggataaatacattcttttttttttttttagatggagccttgctctgtcgcctaggctggagtgcagtggagtgatctgggctcactgcaagctccatctcccgggttcacgttattctcctgcctcagcctcctgagtagctgggactacaggtgcccgccaccacgcccagctaattttttgtatttttagtagagactggttttcaccgtgttagtcaggatgctcttgatctcctgacctcgtgatcctcccgcctcggcctgacaaagtgctgggattacaggcgtgagccaccgcatgcccggccaaatacattttattcttatgagtatattccatgcaagtttagattctattaaaaaaatactaacaactaccctttgattgaagcttatgattttctaaaatctggggacaaaggacagagaaattctcattgtgcgtctaaagttccccgaattgaaaagcaaatcctagagatagcagaaatgcagctagattttatcaacttggtagaacagtttgagggctatttctaggcaaaagaaataggcgctacagtagagaaaattattcagctatcatgttgctcctccttttcattttcactgataatcaatcagcttttaatcagaaacaattttgaagggtttttttgtttgttgttcatttgtttttgttttgtttgtttgttttgtttttttgtttttgggttttgtctgtttagtaaaaggattcatttcactttaggaaaactcagcaaagtgtagaaggggaagttggcacttagcctagaccttttgtgtcttcaagtttccaagttctaagaacagcatggagccctgctatgttagagagggaacacatctgagagatgagaatgagtatatctggaagatcacagatgtaacaggaggcttagcctaaggaaagcaccaactggataatgagagttaccaagaaaaggtaatgacagcatctcaaaaacaacactaaagctattatgttcaataacttgtataaatgctttataagtgtatcccaaagcctacaaacaacatctagctaataacattcaagatttgtacgttccttatgtaagttaaagtggacacattgggtgttccaatgcagaagaatacagagaaatgccacaggctgaatatttgggcaaagactaacattctcttgctgacaaacatgtctttgtattttgacataaacttcttatgtgcagattggttctgtggaaattacaaactttttgaagtcaggggaagggatgaaagtaaaattaaaaattaatcttttctaaggaacgttgtaaatctaatagacattaaataactgcttgaaattctaatcagataaaaacatctagaccaaacaataaagtttagatggacaccggggaatgagagcaaatatttttcaagatacttcttcaaagggcactacaacagagaatgattcttagaatctcagggattttgaaaaaattagccgttgtatttctttgtatttatttcacaaaaagtattgttctttaatcatgtatttatttaaagtagccataacattccatgtatcattttcaaaatggtgatgaaatatattattatgggataaactttcaggtatatagaaatatgtgatgtaacttttgaaaaatgtggagaagctacttcctgcctataggaggtagctttaaaaatgtggagaattcccaaatatttccttttataaatacaatataaaattcattatcctagaatataatctattatatattagtctctttatttatatatatgaagaaaaaatctagataaaaatatcattgaatagttccttcatgattaattggattcagtaagcaaaatctaacaactttataattctagtcaaatatggtccttcctttaggcttctccaaggctttttactacaactaaggtatccagctgcactctacctttactgagtgagtccccatggttaccagcaaagtgtgtgactgaaacaaagaggacggctgttcaaaaatgtatgtctaaaatatctctacctaagacatttttttcttttgtactttgtgtgttctgattctcaaaacaattgagttactcgttgattctttttttctcctccataaggaaaagaaaaatgatttttctgaccactgaattgttaaagcttcttcttctttcaccatatctataaatcatggtgttaaagttacagaggagaaggtcagttttgttgtatatatggataatattgcttagctaagtgctagactaagataataaaataagagcaacagaagaatatgttgtattctcagttatgtaaggaaatgccttttcttaaagctttttcctcatttcatggatatgaacatcttctctagggcatgatcggggaagagaagaaaagtaaagtaaaaataaatgtgtgtttgtgagtgtttattgttagcatttgtgatataggttttgtttagagaaagaaacttaaggcatctggcaaattggtggtttgtgaattgtagtgaatttaaatggtcaatatcattcttaaccttgattctatctcccaatgaaataaaaatttattttctcatttatttagtgaatgtgtattagtactttatattccgggtgctatactagttttggagggcctgaaaatgaaagaagtaatttctgctttcatgatacccagcctagcagaggaaagagaagagaatcactaataaatcccatatacacgttttatatgaactataactatgtttcagaagaataatgattgtatactttctgctcactgcctttgaatcataaaattttctttgaagggttactaatagcactagtttcctttttatatatggttgaactaatctctgacaaccgtaattcttcacctttgtgaaggatcttgaagagaggatactttacatggctacattttgcctctttaatgcttagtacctctttcattatagattgaggacagctataattaatattttaaaagaaagtcacaacataatttcatagatgtattttaaacttttgagaacttcttattaagtagtgctcagcattgttcagtaacttgcttatgctgagtagcaataatcatcgccagctttaactgaacaattatcatgtgccagcttctgtgataaccattttatatgtatttttaattttcaaccactctgcaacacagaaattatgattacctctttcagaatagggaaaataaggttcagagaggttaacagagtcagcacatgggaccattctgactccaaagcctgtgcttcttctcctagagagatgccacacacaaatgcctaccaccacaaaaaaaagaaaagaaaagaaaaggaaagaaaaaaggaggaatccatgtcattccaaccatagtctcttgtttttagctgcatgctaaataacaaaatatatccaaagtcttccacctctaatatatttatgtggaaactacataagtacatattttgccaaatttaagtgaactatgtttttttttttagttcaggtatttttttcttaatttccagaagctaaataaatcataaaatatggaagtagacaccttcaaagggcatgccagttatataaatattttaactgagaattcaatgtttcaatcagtttagtctattttaaagttggaagtacctagattatgagtctttttgctttaattttactttctttaaaaatatatgtactttttaagtagtttatattactgtttaattttttctgatggaaagtaacacacactattatttggtgaatagaaaaattttagtagtttttttttcttctctaatgatttttagaaagaaaacacttatatatttttcctcatttatgtggtttatttcaccttataacacaagctgatatgaacaataagaacagaattgaaaagtgcagttctctaaaaagaacatatgaaggaatattgatggctttgcagcttgctatctcaaactaacaaaatacttcagcacggataagagtctcataaatctagcccttttttgttaatttaaaaacaatttagagtagtagggcatcactatttctaactcgtctctgccagttgccctatattcacctccatacctagcatggtagctccggtaagtgtttatcataagcatttgggatattcatgtacactgagtagtacaacttaatgagcttctctgtgaacttctgattttggccttcaggctgtttgtgacctgctctaagactgtggtcttttctccttgggctctgcttcatgggcttttcactgccgtgagattgatttttaccctttgccttcttcaacttttgcgtatttaattgctttcttctcttctgcctatctagaccctatttacctttcacttatcagttaaatctcttttaactattctgttctaatctgaatacggaaacttttcaggagaggtcttctaacaagctcctaaatctacaaccaggagcagagtctgaagagacttcttggttcaaatcccagttctatcagtgggagttacgtgaacttgaccaagttacttaacctctctgcctcagtacgtacttccatctgtaaaactgatcaataacaaaaaacaaaaaaaacaaagaaagtggaaactgaatgtgttcatgtatgtaaaacatttagaaaagtgtagcgtatgttattttagaaaaacggtaaacgggttacaaaattatagctgcctaccactagctgccaatgtttagttgttgctgttttttttcataatctatccagaggtctttactgtaaacagatatatctaagctaatgagtataaaaaaaattcaggttacccattggtattaaaataaaagggaaagtactaatcctctatcagaaggaactgctcaggtgtgttaaagaataattagcaccatctttagtttccagaattgttcacaaacattatttaattttcagccagcttaattttaaagtttttagctcatttaatgacctgaggaatataaaatgagataaaattgaaaaaagaaatagtagcaatatggatcatattacataaaaaaaaaaaaccagtagcatctcatactcaaattaccgcgttctttcaaagcttacatgactaaaaaatagtaaattatgaaaaagggaagcagaaaaaaacagtatcaatatagaatatcctattctctgcaaaagctcaaagacgtctctggagtgtcaaaggcatgtccttcaatatttaactttttcactctttgttccccatctcaagttgaacaatacgttaattacccgatgaagcattataattactctaacagctccactcttacttataattactgcatcaacactttctttttcatatgcttcaatctatacctattacattgtcatgatgaagacacattaacattataataccgtataattagctgatgagcaattaaattattccactgctcttgttcctctttgccaagaggttgcttccacgctctattatctccttttttccttcggtttgctttagtggttctccccctaccccacccaaaacaaagaagctcataagctgtattcaaagcattttgatttcaaattcagtatgggtaagtgctcaaattggtgatagttgaagaaataaatcggcattataggcaagttttactttattttcattttggttctacaataaagaattgcaaatccatgtaacacaataagaccttgcaggcgctttcctttctacatgctgatcttttttgttttaaagattaaaattttccataatttacagcaaaattgtttagactatattagattctacctgaaatatagccatcatgaattattttacaaatacttcaaattaggttttcacggaagctttgaagttttggaaattgggaacataaaataaaatcatgcacgattgtgtagctaaatatgacagtatactgctcaatgaaagcaaccaggtgctttccgttattattttttctttttgtttttctttatgctacatatcaaaaacctatccttcaatctgacttgtccagttgacatttaatctacataacatttcctttaagtgcctataatctttctttgtggttttagtatgcttttttgaagctccctgtaaggaaactggatctcgctccttggttaaagacttactttagttcaaataaacttcggaactaattggaatacaattttaatgcctccaaaatacttgtcatccacatggtttaccattgtgatcatttgctgcatttatattgcaaactagttcagttgttgtttagtctatattttataagagaactaaatctttcttagataattactttggagaaacattatgagctatggaagaaaagtggaattcattttacaagcaaggcctatgccaataaaatgacttttgttgtctcagcttagtttctttagctgtgcggcaaaggaaaatctattgagtactacagtctcatatgcagaaacttgcttcttcactgagaagagccagatgggccctgccaacatcacaaagccatttaggactgttagtacctttatgctttgaaagcaatgataaacaagttacctttgacacgatatagaaaagcaactaagtctttacttaagtgacaattagttcagctataatcctgtgactttcaaagtccttaactgtgatttgatattttttagttgacaaagactcaactctcatgcttttacataggtacgctgtttattttgcctcaggtcaaaactaatctcccaaattctgataaactttgttagaacctgcatttgtttctaattgtgctagaaaaatgaagtttatctaaccattaataaatgagaatctctctgtagagcaaagaggaggcaatacattatatcagatgtaacttggtctactgacagatattaaagtgcaaaaggtatcaaaatgcaatcaagattaacagggatttcagataaaatgttagctgtaataatgtgacactctcacttcaaattcaaattattaatacattgtaaataaggatcttatattgattttcattatatgcagttaagatgcctactattttcagctctcataaataggtttgctagtatacatgttaaaagccagagaataagtgaataagaattagagagtaagaacctgaccattgaatcaggccctgctccaacacttactacatttgtgaccttgaacaagttatttaatcttcctaagtctatttgcagccataaaattatagcagtacctatcttgtcaggttaccagaaggataaaatgaaaaatttaatgtaaagcacttagcacagtgcctagcataatgtgatcactcaataaatattacatattatcattattccctattattagcttaaaggttatttttctttatgttctttggaaaacacgtcatacaaagttcataatcatcgagtgctatagtttctcataaaatatttgatctggaaaaggtcttaatttttgttgttgttttattctgagtgctttatgtgcattgtctagggtcataaatttaattagtgtccaacttagtactacacggtagtgtctcccaatagtatatttttccatgataccattttacttaggagatctgtgaaatttgctcaattggattatagtcgtttaaaatatagacataaaatttcaagcatatataaaagttacactcgaaaaataaattttaatttcagaatcacctgtagctgatttggactcttgccattattcaagatataagtacaagtttattttattctatataaaaaaaccaaaatcctctttcaatgccgatatttctgccgccttttggttgaagtactgagtttttttctagtctacctaaccctcccccttttgaaacagatttcgtatcagagttactgtatttccttcacaatgaattattataactaatggtttctatttttttctcccacattcaggattactcctcttatattacaataaattttaacatctactagcttttataacactttcttttacattctgaagactgtataaattctcaactcctaatcataaaacttttgatgttagtacaaagcttcaaaaggatgcaatgcttattgttggctaatatgttatctggaggatcttactcccatacctccttaaactgatacccttatagttcagggaatcttttatgtcccaaagtcctaatcatagaaaaaggaaccataaatgaccctgattgaagctgaaaaaatattttctttctttctttttttttctttcttctcagttccaattgttatgtgttgtttttgatgggatagatacgatttcagtatcatcagggtctggcagcaataggctcaaagatctaatgagcctctgacacttcattacccgtcatatattaacagttaacataatagccatcaaaagcttaaaaaagctttattctcacaattgtttattgaccaaaaaataattatgttatatgaatcttgcataaaaatattggtaattgtcttctcaacttgacctttgggacttggattcccttggtatggcaattaaatatactacgtgagaataaaactaggctgggtgcagtggctcatgcttgtaatcccagcgctttgggaggccaaggcaggcagatcacatgaagccaggggtttgagaccagcctggccaacatggcgaaatctgtctctactaaaaatacaaaaattagccagacatgtggtgcacatctgtagtcccagctacctgggaggctgaggcatgagaatcacttgaacctgggagacagaggttgcagtgagccaagattgtgccactgcactccagcctgggcaatagaggagagaggagattctgtctcaacaaattaaagaaaggaaaaagaaaagtaacattttgtttttggtaatatatagtagtataaccctcaattgctttccaaatcccattcccccataaaagcatcgtcagaagatccaagctaccattgaagttttagcctcagggaggactaagtaagagtggatcatacctggaaatgagactgaacagtaccaacatgaaacgtcaataagacttaaggctgatagatgaacctgaaaaggcttctttctcctgtccttacagatgaacaaaccgctactgtgtccaagaatagcttttacaatcaaagtagtctgctgaaataaccaagagtgacaatcagctcttaacttcaaaagggaacttcacatttcccgatgcttcatttacaaatgaccagtaatatatatatccttggcagagatgaacatttgtagctatatctctaagcacaaggacagagatgtcaaaccctcctactttgtatcaccaatatattctatggaataaaccgtcttagactcactggtattcagggattctctcattcaagctatcacaattctcatgatccaccatttgcctctgaagatgacaatttggataaatgagtaaagatgggaaacccaatccatgttaatttttttcagacatgtgaagtggagaagagaacctgaaaataatgctgttgaacagaaatatgcgaaatctaaaaatggagagacctaattttttatgagacataataaaaaagcaaaaggaaatagaatcacagcagtttggtgctacgagacacctaagagaataaactaatcccttcactttacagatgagggacctaggccccagagaggtgaagcccattaaccatgtttgcacatagtaaacagtagcacagctagagaagttcagttttctgaccctacccactatgcaacaataaatctggtaagggagtattttgctgtttataagttaaatgtgtgcagttttgaaaagaacattaaagaaaagtataggatggtctagatctgatatcactcccatatgagtttccatttatatatttactattacttagcagtattgatgtatttatcatttaccttcgtattcatcaattaataggacattctattgtacagaaggatgtctattacagtccagtgattcttatatttttccaccaaattgtctatttgccattgcaatggagtgggaaatcttaaagccaggagatttgggggccgtggcacaaatctatcagatgtaatggaaaaatttcttcacctagtgatatttcatcctaagagtaatgcaacgtttgctgtttgctggttgtcatggtaagctgtttttttctcccaaaagttcaaggtaaattaatggcccaaaagtatacaagatttgctttgcttaaccttgtggaattcctgcatatcttcaagagttcatctaccttggatatactgattatatgccattttcttttcccaatttggaagcttactatagaaaataagcacaaagagctgagtgcaaaaataattcatacaaaggatatatttttgggttctctatttcatgtaatagccattattctcccaaaaagaacataattttaagagaaaagttacactgaattttaactgcatattatatattgttgtcctaaaatgaagtaaaaaaaaacttttaagttttctacctctaacactctttatcctaaacaaaatccacccacactttacaaattatccagcaatgttaactcaaatatacatgaatttgaataatctatgagtatcaactgattaatcaaaacaaaacttctaaattattctctttagtctcaatagcttatctaaatggatgtggacaggatgaaactacaaatatgtttcacgaaaataacactattttgcaagaatgaaaagaatcttaactttcttctaattctccatttgaccattcttgaagattctccttcatattaattttatttatttatttatttatttattttagatggagtcttgttctgtcccccaggctagagagcagtggcttgatcttggctcactgcaacttctgcctcttgggttcaagcaattctcctgtcttagcttcgcaagtagttgggactacaggtacccaccaccacacttggctaatttttttttttttttttgtattttagtagagatggggtttcaccatgttgcccaggctggtctcgaactcctgagctcaagcaatccacccacctcagcctcccaaagtgctaggattagaggcatgagccaccgtgcccagcccttcatattaatttttaaaacaaatatttatagaatgcttgatatttgatgattcttatagacaacactcttgttttcatggagtttagagataataatcagacagtaagcaaacgtaaataaataaaaagcacattgtgataggttctatacaaggaattaaagcaaagtgatataatgagattgatgtgtatggagagggttacattttattgggtgttcatgagagacttcgttggggtatgatatttaagcccagctataagctgacaagaaaaactgcatgtgaagtcagggaagaaaaagttcagaagataaaatagctatgacaaaggcctttgggcagaaatggaaagagtgcctcagctggaacagcatggctaaggaaggtgagatggtgtcagaaagatgggcagaaccaaattctatagaattttgttattttacaaaaaggtatggaatatgacttttactttaagtgcaatgggaatcctggagtatttaagtggtggagtgatgacactgtgtaattggttttcacagtcttaatcatactagcagtagtgtaaagtaagaattgcaggggacacagctggaaatggaggaagctatagcagtgatttagagcagggtgctggtagtagacatggagacaagtaaatatatttgggttatgctttggaaggtaaaaattaataaaatggactgatagtttgtttagcagtggaaaagagaaaaaggaaaatcgaaggtaatccctagatatttggctcaagcaacaactggagtgggcagcagtgccacagtttgaaatggaagagactggggaaaaatgaattggtgctggggaaagaggagttgagaattctgttttgactttgtaaagtttgagatccatattctacatcaaagtgaaggtgtcacgtagttagttgtatatttaaatttggagtttcagggtggtgacagagctccctgagaagtatatttgggaatcatgagcacatacgtagtatttaaaaccctgggactggatgagatcatttaagacaagtgtgtttaaagaaaaaatattccccttaagcattcgaacatggaataaataaggagaggaagtcctacaacctcaaggagttgaattctgtcatcaaccagttgggttggaagagaacccagagctgatacgagagtgcaatctgggcacacaccttgatttcagcctggtaaggctctaagcaaaggacccagctaaagtttatccagactcatgaccaaatgaaaaccttgcagtttaaacagatgcgtgttttacattgctaaggtggtgatttgttatatagcaatagaaaattaatgcatccagtttcaagtttcgtttataaatctttccttgtttacattctttcttaaaggctaacaactgtaattataatatctctgttaaattaaaataatctttgggaacatcaaacatgtaataggtaatatctttaggggtcactgatgtgtgttcaactttccagttgtgctacaataattggacctatatgaaaggacttttcattttttttaaattaattttcatagttttgttttccctattatttattattattgttgctattggtgtgcacgcctgattcttgtagccaattatatatcggtatgctctaatctgttatgagtcgggagactagaggaccaggctttttgtattgggtctacaatgagaatacctaggctataaactacgttatgacagtgtatgatgaaattaagctatcctttttgttttctcagtacttctcagtatttaaagtcatcagaaaaaaatgacatttgtttaaataaaaagacacaattgtaagaataccagttggttgttgatattttaggttatttctttaaaaattatgattgcctgttctctacattaaaagaacattgctgggcagaataactggattcaaggtaatgtctttgtcttcacatagtctttactctcaagtgactccagtgagtcagcaaaacatgtgtgggcttcagaaagaacgattccaccataatttgcaaattagaacagtgggatatgctatgtactactttccaagtctgcacttcacatatcattttaatgacccatcaatagaaaatacgtgtcatgatttatctttccagtcatggcaatttaggtaaaaggttggaaaaatacctatacgaatagtggtattagaaaggaacagggacaaagataagctagggttaccttttgaaaaaaaatggggagaatcttgacaaaagattactgggaagcatcaaatttcaagtatttaaatctttaaaatgcatcctcatagtttcatattgtctttttttttcctttctatgtactctctggaccaaacagggtatgtctgtctgaataactccatgacttactcaggtaatcgtatcagaaaactttctggcaaagtttagatttaggggatctatggagatttctgtatccataaccactttctgcaatgcacacatcttaatgcacatatctaatgcagtcagtcacattatcattttagctttctttgtgaatgagaaaaatttcatttcccctcctgtttgcagatacataaagtgataaatgtgatggaatgctttgttagcaccctgccacatggaatagtcctcctggtttgactctattttctcctcttcctcttatttaaaacttaagtgatcttctttggtatagtactgggtagaatatcaatttaaaaataaaataaatataatattttaaatgacgttaatgctgttctgctgatattacttccaaaataaaaaagtagtcgggactaatcctgccaagtttcactgtaaaattaagtattactgtcttaattatctgtgctagtatggaaaataaatggactgcacacatgattatggtgattaaggatgttgtatcattctcattcacttttagcctatttttttcttttactttttgataactaagaaccgaatacttgtttttttgttgctttaaatctgagattcttaaataatgcaggcaaaaataatcactactaccaataccaatccacctccagaaaatgggtatttctgccgtatgaacaactagagaaggtacacctgcaagcttccatcataaacaaccagggaatgtaaaagagcagcctttttgtagcaaagccatactgtaactgaaatagcaatcgccttccagagaacaaaggcactgccatgaaaagtccaagtatttgctctttggcaacattcccccaattctgcagacatgtttagaaagaatgcctacacctcctattcagaaattaaaaggcagctcttctaagctttgaaaggtaatatttgggttgtatcagagtctggcattttatttctttgttctgcttgggatttcatattgacatacaaatcatttagtttctttaagtattttaaagtaatgtctttaaaatactctttaagtaattcttttaagtgctttaagtattaaatgtataagatagctttagatgtggggattaaaagtgacatgagaggaaattgttatcatttgagaggttttatttaaacatcatgaactcacatagtattcactaagacttttatttttaaggttctcaaacctatgcatttaaagaataatttttagcaattttcataatataataaaaattgatgttatgtttccttacacatgagattacttcttacaggaactcaaacgagaaagcaaatgacaacaaaaatactttctttcagtaatcatggaagcacagggttttggtaagttatcacacataatttaaagaaaatctgagtgcaaaacaaccttattttaaactataatgtggtcactttctcctcagttcttgactatggcttcccccatagattttgattttctttcactcatcatgtcctatttatttgcaaggttaaattttataatagtctaaattttattaacatttaaaaatatgattacctctcaggattatcattattacaatatcattcttaaattacaccacacagattagaaaaagaataatctggcacacagagtcagattgaggttcagattttgaccttaacacttatataatttgtggcctcagtttttgtgatggttaatattgagtgtcaacttgactggattgaaggatgcagaatagtgctcctaggtgtgtctgcaaagatgttgccaaaggagattaacatttgagtcagtggaatgggagaagcagacccacctgcaatctgggtaggcaccatctaatcagctgccaatgcagctagaataaagcaggcagaagaaggtagaaagggcagacttgctgagtcttccagctttcatccttctcccatgctggttgtttcctgccctcaaacatcagactcctagctcttcagcttctggacccttggacatataccagtggtttgccaggggggtcttgggccttcagccacagactgaaagctgcactgttggcttccctacttttgagattttggggctcagactggcttccttgctcctcagcttgcagatagcctattgtgggacttcaccttgtgatcctgtgagtcaatactccttaataaacttcccttcatatacacatctatcctactagttctgtccccctagagaaccatgactaatacagtctgcttatatgtaaaatagaagtaatgactaaccaaattttactgaatgtctaaaagttacttaaaatgtgaaaccagcccagttgtccaatagaaatgatgtttatagattttagaataaacacagaaatggacccttttggtcttgaaactcgaaacttgtatttgtctcatctgacttccttcctcaggaagctgactcacaggcaagggactaaaaccacatccagagagtgagatgtcagactcctcattcattattactactcccgtacccctccctaatttctttcaacactgtagtgacatttcttctcctgctatataaataccccaattttagttgctcagagaggtgaatgtgagattattcttctgttctcccatttgacatcacccgaataaaaaagctttctttcctgacaatacttgttgtctcagtgattggcttcctgtgccagtagcaacgggacctggaccaaatgtggggtttccataacaactatagcttttctccaacagtatacaggccaggtgtggtggctcatgcctaaagcccagcacattgagaggccaaaacaggaggatctcttgagcccaagagttcaaggctgcagtgagccatgattatgtcactgcagtctagcctgggaaagagtgaggccgtgtctcaatcaatcgatcaaaataaaatggtacatatcatttccctcttcaaatctattacttctccaaaatttctcttttagtaaggtacaaaacagtctacatagttttccaaataataaatcagaagtcataattaattcctggaccaaattacccctggactgggccaatctaaacatccagtcacccaggtctgataatgttccacctggacacatcctaaaaatcccctcctcttcccttcctcctctgccacctcatagtatgggccacaactctatttcatgcaaactgctctttaccccctttactgatctggctgcctctagccttgctcctctcatatccattctccactctgctgccatagtaattctaaaaatgcctccatgattgtgtgactttccagtttaacacccttcaaatatttccctttgttcttggaatagaaacagactccttaaagtggttcacagggcagcctatgatctggcccttcctccccttccagcttatgtcttgcattctttgtctctgttagctccgtggactccccaagctatctctccgatctgttcctttacctggaagactctggtatcttctttatctggctaaatcttacgcatattcaggtttctattatcaattcttccacagggtttttatgatgccaacttaggcctacatcaccctgcattctcaagaaacacttattaaattacttgttacttataaaaattacttataaaattgtttattaaaagtcactcttccccattagtatatggggataaatatgatggcagctgagagagaacagaagaggggagaaaatcaggattttgaggccgtggcgtctacagaaaaagctgtgcagtaacctccttcccctcctcctcttgccccacagggaagagtattgcacctgtcctcatctcaaatccagtgagggaggtttccactgtgctatgtggagtatatgtgctatgtagggagtttattatatgacctatgtaataggagagaagtggaaaaatatagcataactcccacctaagaaatttggagagtaagaacaggttaatcatttttgtggtggaaacagcctgccttctctctgtgtctgagtaaagcatgcatgaaggtttttgctggaacagatgtaggccacataggataaaaagaagaggtctgggaccattttaagttctgtttcagaaaacaacctggaaaggagaagaatgcttaagaaccaagattgagtggaaaaagctaccagcaaaaccagggctggaaggactggacaacctggggagtagaaaagagtttctactggaagaaaactagtgatgggaatatttgaaaaactcaggataaaatgtggtttcttctagcaggtcccaggccatcttcaccaaagaaactcttgtgcttccattttctcttcttccctctccagtgccaatcctagagtgccaaaagctataggaagtaagctgcgtggggagagcagaaaagggacaaaagccatcagatgctttttctggaagatgctggctgccaaacagtggcctcaactgtcagagaaggagaggaagtattaccttagaataaggatgaaagtattgattaatattttggagtccaagatggccgaataggaacagcttgagtctacagctcccagcgtgagcaatgcagaagatgggtgatttctgcatttccaaatgaggtatcaggttcatctcactggggcttgtaggacagtgggggcaggacagtgggtgcagcccactgagcgagagccaaagtagggtgaggtatctcctcacccgggaagcataaagggtcagggaattccctttcctagccaagggaagcagtgacggatggcacctggaaaatcgggtcactcccaccctaatactgtgcttttccaatggtcttagcaaatggcacaccaggttatactccgcacctggctcggagggtcccacgcccacagagcctcactcattgctagcacagcagtctgagatcgatctgcaaggcagcagtgagtctggggaaggggtgcccgccattgctgaggcttgagtaggtaaacaaagcggccaggaagctcgaactgggtggagcccatgacagctgaatgaggcctccgtgcttctgtagactccacctctgggggcagggcatagccaaaaggcagacttaaatgtccctgtctgacagctttgaagagagtagtggttctcccaacacagagtctgagatctgagaatggatagacagccccctcaagtgggtacctgacccccgagtagcctaactgggaggcaccctccagtaggggcagactgacacctcacacagccgggtaccccgctgagatgaagcttccaggggaacaatcaggcagcaacgtttgctgttcagcaatatttgctgttctgcagccaccactgctgatacccaggcgaacaggatttggagtggacctccagcaaactccaaaagacctgcagctgagggtcctgactgttagaaggaaaaataacaaacaaaaaggacatccacaccaaaaccccatctgtacatcaccatcatcaaagaacaaaggtagataaaaccacaaagatggggaaaaaacagaggacaaaagccgaaaattctaaaaattagaccacctctccccgtccaaaggagcgcagctcctcaccagcaatggaacaaagctggatggagaatgactttgacaagttgacagaagaaggcttcagaagatcaaacttctctgagctaagggaggaagtctgaacccatcgcaaagaagctaaaaaccttgaaaaaagattagacaaatgggtaactagaataaccaatgtagagaagtccttaaatgacctgatggagctgaaaaacatggcacgagaactacgtgacgaatacacaagcttcagtagccgatttgatcaactggaagaaagggtatcagtgattgaagatcaaattaatgaaatgaagtgagaagagaagtttagagaaaaaagagtaaaaagaaatgaacaaagcctccaagaaatatgggactatgtgaaaacaccaaatctacatctgattggtgtacctgaaagtgacggggagaatggaaccaagttggaaaacactctgcagggtattatccaggagaacttccccaacctagcaaggcaggccaacattcaaattcaggaaatagagagaacaccacaaagagactcctcgagaagagcagctccaagacacataattgtcagattcaccaaagttgaaatgaaggaaaaaatgttaagggcagccagagagaaaggtcgggttacccataaagggaagcccatcagactaacagtggatctcttggcagaaactctacaagacagaagagagtggagaccaatattcaacattcttaaagaaaagaattttcaacccagaatttcatatccagccaaactgagcttcctaagtgaaggagaaataaagacctttatagacaagcaaatgctgagagattttgtcaccactaggcctgccctacaggagctcttgaaggaagcactaaacatggaaaggaacaactggtatcagccactgcaaaaacatgccaaactgtaaagaccataaatgctaggaagaaatggcatcaactaatgagcaaaataaccagccaacatcataatgacaggatcaaattcacacataacaatattaaccttaagtgtaaatgggctaaatgctccaattaaaagacacagactggcaaattggataaagagtcaagactcatcagtgtgctgcattcaggagacccatctcacgtgcagagacacacataggctcaaaataaagggatggaggaagatctaccaagcaaatggaaaacaaaaaaaaggcagcggttgcaatcctagtctctgataaaacagactttaaaccagcaaagatcgaaagagacaaagaagagcattacataatggtaaagggatcaattcaacaagaagagctaactgttctaaatatatatgcacccaatacaggagcacccagattcataaagcaagtccttacagacctagaaacagacttagactcccacacaataataatgggagactttaacaccgcactgtcaacattagacagatcaatgagacagaaagttaacaagggtaaccaggaattgaactcagctctgcaccaagtggacctagtaggcatctacagaactctccaccccaaatcaacagaatatacatacttctcagcaccacatcacactgattccaaaactgaccacatagttggaagtaaagcactcctcagcaaatgtaaaagaacagaaattataacaaactgtctctcagaccacagtgcaatcaaactagaactcaggattaagaaactccctcaaaactgctcaactacatggaaactgaacaacctgctcctgaatgacttctgggtacataatgaaatgaaggcagaaacaaagatgttctttgaaaccagtgagaacaaagacacaacataccagaatctctgggacacattcaaagcagtgtgtagagggaaatttatagcactaaatgcccacaagagaaagcaggaaagatctaaaattgacaccctaacatcacaattaaaagaactggagaagcaagagcaaacacattcaaaagctagcagaaggcaagaaataactaagatcagagcagaactgaaggagatagagacacaaaaaacccttcaaaaaatcaatgaatccaggagctggttgtttttggaaaacatcaacaaaattgatagactactagcaaggctcataaaggagagaagagagaagaatcaaatagacgcagacgcaataaaaaatgataaaggggatatcaccactgatcccacagaaatacaaactaccatcagagaatactataaacaactctacacaaataaactagaaaatctagaagaagtggataaattcctggacacatacaccctcccaagactaaaccaggaagaagttgaatctctgaatagacccataacaggctctgaaattgtggcaacagttaatagcctgccacccaaaaaaagtccaggaccagacagattcacagctgaattctacctgaggtacaaggaggaactcataccattccttataaaactattccaatcaatcgaaaaagagggaatcctccctaactcattttatgaagccagcatcatcctgataccaaagcctgatagagaaacaacaaaaaaagagaattttagaccaatatccctgatgaacatcaatgcaaaaatcctcaataaaatactggcaaactgaatccagcagcacatcaaaaagcttatccaccatgatcaagtgggcttcatccctggaatgcaaggctggttcaacatacgcaaatcaatcaacgtaatacagcatataaaaagaactaaagacaaaaatcgcatgattatctcaatagatgcagaaaaggcctttgacaaaattcaacagcccttcatgctaaaaactctcaataaattaggtattgatgggacgtatctcaaaataataagagctttttatgacaaacccacagccaatatcatactgaatggccaaaaactggaagcattccctttgaaaactggcacaagacagggatgccctctctcatcactcttattcaacgtagtgttggaagttctggccagggcaatcaggaaggagaaagaaataaagggtattcaattaggcatagaggaagtcaaattgtccctgtttgcagatgacatgattgtatatttagaaaaccccattgtctcagcccaaaatctccttaagctgataagcaacttcagcaaagtctcaggatacaaaatcaatgggcaaaaatcacaggcattcctatacaccaataacagacaatcagagagccaaatcatgagtgaactcccattcacaattgcttcaaagagaataaaacacctaggaatccaacttacaagggatgtgaaggacctcttcaaggagaacaacaaaccactgctcaatgaaataaaagaggatacaaacaaatggaagaacattccattctcatggataggaagaatcaatattatgaaaatggccatattgcccaaggtaatttaatagatccaatgccatccccatcaagctaccaatgactttcttcacacaattggaaaaaactgctttaaagttcatatggaaccaaaaaagagcccacattgccaagacaattctaagccaaaagaacaaagctggaggcatcatgctacctgatgtcaaactatactacaaggctatagtaaccaaaacagcatggtactggtaccaaaacagagatatagaccaatggaacagaacagagccctcagaaataataccacacatctacaaccatctgatctttgacaaacctgacaaaaacaagaaatggagaaagattccctatttaataaatggtcctgggaaaactggctagccaagtgtagaaagctgaaactggatccctcccttacaccttatacaaaaattaattcgagatggattaaagacttaaacattagatctaaaaccataaaaaccctagaagaaaacctagacaataccactcaggacacaggcatgggcaagcacttcatgtctaaaacaccaaaagcaatggcaacaaaagccaaaattgacaaatgggatctaattaaactaaagagcttctgcacagcaaaagaaaataccatcagagtgaacaggcaaactacagaatgggagaaaatttttgcaatctactcatctgacaaagggctaatatccagaatctacaaagaacttaaacaaatttacaaattacaattgttgttacaaaaaaacgaacaattccatcaaaaagtgggcaaaggatatgaacagacacttctcaaaataagacatttatgcagccaacagacacatgaaaaaaatgctcatcatgactggccatcagagaaatgcaaatcaaaaccacaatgagataccatctcacaccagttagaatggcgatcattaaaaagtcaagaaacaacaggtgctggagaggatgtggagaaataggaacacttttacactgttggtgggactgtaaactagttcaaccattgtggaagacagtgtggcaattcctcaaggatctagaactagaaataccatttgacccagccatcccattactggttatatacccaaaggattataaatcatgctgctataaagacacatgcacacgtatgtttattgcggcactattcacaatagcaaagacttggaacccaccccaacgtccatcaatgatagactggattaagagtatgtggcacatatacaccatgcaatactatgcagccataaaaaagaatgagttcgtgtcctttgtagggacatggatgaatctggaaaccatcattctcagcaaattatctcaaggataaaaaaccaaacaccacatggtctcactcatagatgggaattgaacaatgagaacatttggacacaggaaggggaacatcacacaccggggcctgtcatggggtggggagatgggggagggataccattaggagatatacctaatgtaaatgaggagttaaagagtgcagcacaccaacatggcgcctgtatacatatgtaacaaacctgtacattgtgcacacgtaccctaaaacttaaagtatgataataaataaataaataaataaataaataaataaaataaaaaagtaaataaaaaatattttggaatagatactcttaattgaggtcacttaaaagtaattgtagaattgcttagtctgtaggagtgaaaagagaagtcacaggtatggtgtcgaagttcccattgaggaccagaagacaataacctctaccaagtaaatattaaagaggatatggaggcccagtgcagtggttcatgcctgtaatgccagcattttgggaggctgaggtgggcggatcacttgaggccaggagtttgagaccttgccaacattgttaagctccatctctactaaaaatacaaaacttagcagggtgtggtggttcgtgactgtaatcccagctactctggagcctgagatgggagaattgcttgaacccaggagggggaggttgcagtgagccgcgatggttccactgcactccagcctgggtgacagagtgagactctgtctccaaaaaaaaaaaaaaaaaaaaaaaaaaaaaagcttccaggagacaacaatttgtgtttccattaagccatattctatagtttctggcattcattacacttcaatacccatttaaatatccatgataacagtcattaaaatttgtcattgtgaaaacaatattgtaaagagtggtgatggatatgggtgggaactgttatgtggattatgtgcacctgcaaaatgggtcccaaacaccacatcagattgcagattgtttctttctttcttttccttttttcttttcttttttttttttttttagacagagtctcactcttgctgctcaggctggagtgtaatggtgtgatctcagctcaccacaaactccacctcctgggttctagcaattctcctgcctcagcctcctgagtagctgggattacaggcatgcaccaccacacatggctaattttgtatttttggtacagacagggtttctccatgttggtcagactggtcttgaactcctgacctcaggtgatccacctgcctcggcctcccaaagtgctgggattacaggcatgagccactgcacctggcctagattgtttcttttatactgttaaaaaaatctatatctgtcaaagttatgaaatagtattatttgtattagatatgctcattgtgagtagccatcagaatctattctgtttttcaatattacaaattttcatcttttctttatgcaaatagcatatgagacataatctgcttttcacaaaagtctacatgtatattaattgaataagatgtagaaatgactgcttttctacagatctccattcacgtgtcaacaaacttgaagtgagactaaatatactaacttaaatggaatcttaactgtgctgactgcagtctcactccagctttcgtcttcctcctactactcttctcacttgtcaattctttttttttttttttttttttttttttttttttttttgagatggagtctcactctgttgccaggctggtgcaatctcggctcactgcaatctccagctccctggtttaagcgattctcctgcttcagcctcccgagtagctgagattaaaggcatgcaccaccatgctcaactaattttgtatttttagtacagagggggtttcaccatgttggccaggatggtatcaatctcctgatctcatgatctgcccgccttggcttcccacaatgttgggattacaggagtgagccaccgctcccagccctcaattctttaaaacagaaaattcagcatctcagatggaatcaattgagctgttagtttaattttgagaatctcagatcaagctgatgaaaaggacataatgaacacattttaagaagacactggctatgaaaccagactggcctgtgtataatgtcatctccaccatttactacatctctgagcaagttaaatatcttaagtgttagtgtccttatgtgttaaaagaaaaaacaaaaaaggattgtagtacctagctcactgagttattgtgaaaattgaataaaataaactatacaaattatttatcatgctgtctaatacaatggaagtgctcacatgcatacacaggagacttatcaaatagtaaaattaaattaataatattctcttggcctgccatttttaaaaaatttagttttgttaactttttgcatccaaaccaggaagttaggtatcaaatctaataatttttaccattttactttacaaagagtaataaaatgatctaacaataatgtgttccaccagaatagaaacagatgatttagaacaagaaaaaaatatttttaagaaatttatattagcataagaataaacaggtccttgaatttcaaaaatgtgtatatcatataaactcacctgtatgatatttaacagattataaatgttatcttaaatagtttgaaggacatacagatatttaataaataatctgatgatgactggctagtcatttaaagaaaagtcatgattcctacttcactaaaggcaaataaatttcagatgttaaaatgtagtgcctaaaaagcaaaaccatttaaatactagaaaaatataaatgtatatttttacagtcctaagattttatcaccactgaaagcatgatagcaaacccagcaaccatagggaaaaaaaatgacagaattgagaacataataatttaaaatttagggatggcaaaaacaaacgtaaaaattaaaacaaaacctaataaaatcaacgaaataaacaaaaagccataaataggttaaatataggaactatcatagcaaaatcgtatgcgtttctctcatacaatcataggggttaaaggatttaattcagagagaggtggtatcagttgtggcttgattactatttgccagatgatcccttgaatggcccttgaatgccctccctcaggagtaggagctattaaagaccactaaagctggaggtgactttaaagatcattctggtcccctctttgcattttacagacatggtaactaagacttgttgaagttaaatcactgtagccataatagagatatgtataagacacaataggagcagaaaaatctttccctgcctggagaacaagaaggtcaaaagaatctttcctgggaaagaagcattgtagctgaatgtagaagtaattccccagaaggaaaggagattccagattagaaagaaaagaaaaataacaaaaaccaaaactattatttacaaaggcctgaagcatacctgagacaggtatgtctagcatattataaatgattaggcataaccagagtttatagggtattagtggtgttacacgaagtttaaaatatgggcagtgtactaaatacatggatgccatgctaaataattttgactctgtcctacagatgatgaggaacctagaaatcttttacaataggcaacacatcaggcttgtgttttagaaaggaactgtggctgcttgaaggatggaaaagagtgaagaatttagagattaaaaacagcccacccctttcaagatcctgctgcaatactccactcggccttctgggttctctcttggcagagtcttccttctctttttcttctttgcacttttggtaggattatattttttcatacattcattatacctacatatatgagtttctaagacaaaaagaggtacagtcaaataaatgggtgggcaagcagtgtttactttcgcaaactagagaacaaaagaacactgtaggtaaactgtcatttgaaataggcattgacacataggaaggatttgagtacaaagcgatttggtagagaaagaaaaaggagaaaggaggatagcataaagaaaggtattgagaccagaacaagtaactataatttcttaatatcaaacatcgtgtcagtattaaaatttctgattttgtaattgttgttaacagtttagagaaacaaacattgtgattgactgaagtttctaattaactcttgtttaaactataggttccaccaccataacaacatctttatggtgtgtgtgtgtgtgtgtgtgtgtgtgtgtgtgtgtgtgttgtgtgtgtgtgtgtgttttctgactttcattgacatgatagaagatagttcactcaatcatctaaatggttttactaatcacccctactagacaaagcacaagaaagtagtttctcaacaggcctttagatacaagcatttatttgttgaatatattcaaagagacgtgtttagacaaccccttcctggaagttagtttgccgctaattactctctagtatgaatagaaaattatgtaaatttggtgaaagaatgttctcctttgtgaaataaagcactttcatttttgtgtataaatctttgaccatattaaggtgaaccatgcaaaattgcctacaaaaagagcaaattcagtggctcaactcaatagaaatgaagatgagtttatttcccggtgatttagtgtaaacaatagtatttataatagctaacatattggatatgacaaatacccatgtattattaatcaaacatatttataaatgtctaagttaatatccagattactttacttttcaaaagcagatcactgtcttagtttgtacataattctcccattcaatttcaaatttgttcttagaaggcaactggaaatatttggcaagatattagaaacggagaggaagtggaaactgtgtgaaaatgtctataatgacttaaacagattacatgtcattaagatccctctgggatatcaaggtcaaagtgagtgaaggtattcactgctcatcagtgaaagtcagggaacggagtacagtcactttctaaacactatttcccaaccccatagagctaggattaatttacagaatttaatgcttagttgaaatagaaatgtgcttgttctcagtgaagcgatggtgaaggtgcctgtaacaattgtagttctgaaccggaattatttaataagtagtctggttgaaagcagttggtctcccaggaatattaggtaattttctctcaatttgagttaaatatcatgccagaaaaagaatcttattgactagtcacaaagtgactgctggacagttttctctctaccttaatgaaagccacagagaaatactagggttgaaagtggccactattactcattcgattaggcctcgaaagactcttactctgggatgtggagcaacaggagtaaatttaaagtcctctggctggctctaacttgtgtcctaaactcctcaaaaataatataaagattaagagggttttcaaaaagtataatgacttgatgactttccatagccacttaacaaaccataacctcaaaagtcttacctaggaaaaaataaaatggttttgttttaatagtctcaaatatcaaaattaagtctttctgacctcagtcaaacttttggacattttgtaaggaccccgggaagtacaaaagagaaatattgggctaattaggcttatccgatatgatgaattctaaaagaaacattgtcaaagtaagaaatgatgtttgaaacttcttggagttatatttatatgaatatgttattaatatgtgtttcagaattatataaagttcctagaaatctgatatgttttagtgtaaatgctatccatcataattgtggttattttaaattgttttatgctacagaaataaccaaatttccttgtcaattgtgtaactctcttatcagatccttagccatggccattggaattcttgatgtccacaggtaattgctttaatctaacgcgtttctaaaagcttcttgccagcaattacaatcctaaagtattatgactttaaggagattcatggaaagcatgaaaagaactctgacaagtacaggtttccaatagctatgagttcattccattggaatgaattttcaaaagtctaataaagaaactgatgggtttgtgaaactgctaaccaatatcaaacaaagcaagaattaattacattagactgaatgaactgataagaaagaattatggtttttataatagcttttatatttgaaacattactggttctttcattgttttgttttgaggtttaaggaaacatttttcattaaagctatctatagtttacagcaatttggtatagcacacctttataaacaaaaatggaaacatttaattttcttctttacctgatcccttcagaaactattcacaaatatttttattttcatgacattatggttatatgcataagttcagtaagaaattttcaacaaagcaaatttaaacagagcctatacgtgtatttgtgctgcacttatgtaaataatcaggcgaactggtcttcccatgattatctttggtagaaatgagagtgatgatagagaaaaaaatatgtttcaaaagaaatctaaagtaaacctgtcattagattgtagacttattcactgtttttgagtttttattatctacctatagattaagttagatcctgaattcttctaattttgtccaatatctggttacaactctataacaaaaacaaaaattactgttcctgaagtcctacaggccaaaactggacagcattatgtaaacttcaaggtacaaatctcatacctgattcattggtcacacagagagtttaccaaaaatgtcagatgtcacaaccagagacgttcaatctacaaatccaggacaagaagttgctgacttcatgctgtggatatcttttctcagcattgtcagaacaagactccctattgtaatgagacatccctcctcttaattttctctttacttatccctacctctttcagttgacagaataacactgtctttaagatttcacaataagtagttcctgcgggtaacttgcaaattgtcatgcccattcctaaaatgctagatgatagaattgctacctactaactgaacagagaggaatctacacaatcaatgacacttgtacaaaaataaatacattgggtactatatagacttagatgcaaaaacgaatgaacagactacttagttaaaatggatagacttcttgcctatctcattttttatttgattttaattggttcagttcatggggagcctggctgaggaataaactccaaactcttagtattattcccatgatagtcacagtagtttctctggtgtgttgtatcctttctaaaagttttcaatgtttgtatgcagccatctgtctaacatcaaatggtctctgtccagccagaaccacaaaaactcaaagacacaggtgataatgagtaggacactgtaacctataaatggcaactgagagtaatactgatgctctaagtgctggtcacaaaaagaagggaattgttaaataaaaatcataggagaccattgttttggactcagtttttgcactagttcccaacacagccgactaaaaacaaatggagtcatccatgctaaagttccaaatccactaaacctaaactaatttgttgtctggccttccaagaaatcaggaaagataacagccaatttcccaaacaggccagtttaaatcttcagttggcataataatgaagtttcctctgcttgaattcttacacaccaaaagctaccctgaagtaacctgatgttaaccaatcaattactttcctatggctctgtctctctgtacctgccttacaagaaaagtagctttaaaagactaatacgctctttgttctttgtctctgctttcttcagaccctctctgtctgcgaagcaaatcatctctgctcattggaatactgattctatttcatggaatgaactgttgtccaattttagaatcacaaataaagccaactgaggtatttaagctaaatttgttgtaattttgtgttttgaccatagggatagcaattggtaaataaggaagggaaagtatctatacactttttatctaagaacgtaaatatgaatgaatgaatttggaactcaggtttgctgatagtctcataaaggggagccccccatacatgctctcttgcctgccaccatgtaagacatcactttgctctttcttcatcttccaccatgattgtgaggcctccccagccaggtgaaactgtgagtccattaactctctttcttttataaattacccagtctgaggtatgtctttattagcagtgtgagaaaaaattaatacacttatgaatacagatgtaaaaattctaacaaaatattagcaagccaaatccaacaatctataaataggatcacacaccatgaccaagtgtgattgatcccaggaacacaaggttggtttaacattcaaaaatcaatgaatgtaattcatcacattaataaaaaatcaatatggtcatctcaattggtacagaaagagcatttaagaaaaatccaacatcattataaaaaaattaaatgaactaggattagagtgaaactaacaacctgaaacggacatctataaaaaacccacagctaacatcatacttaatgatgaaagacttaatgcttccccactcccgatcaggaacaaggcaaatacgtttactccttctgcttctattaaatattgtactggaggttctaattagagccattaagtttatttttaaaaggtgttcggtttaaacattcagattggaatgaagaagaaaagtttctctatctgtagatgaaatgatcttatataaacattttacgaaatacacaaaaaaactattagaattagcacaagttcagcaagattgcagaacataagacaatataacaaataaactgtatttctttatacaagcaatgaaattccaaaaataaaattaagaaaacaattcgatttacactagcatcaaaagaattacttaaggctgggtacggtggctcctgtctattattccagcactttgggaggctgaggtgagaggatcacttgaggctggaaacttgagaccagcctgggcaacatagtaagaaccatgtcttaaaaaaaagaaaaaagaaaaaagccaagcacagtggcatgtgtctgtagtctagctacttgggaagctgaggtgggaggagttgctgagcccatcagttcaaggttgcagtgagctacgactgtaccactgtactctagcctggctgacagagtaagaccttgtctcttaaagaaaaaatgaaaataattttttaaaaagtacaagacttctgcattaaaaacttactatatattattgaaagaaattaaagatctaagtaaatgaaaagatatcttattttcccaaattaaaggcatatgttttttaaagtatcaatacttcttaaattgatctacactctcaatgcaatccttataaaaatctccgatggctttctagcagaaattgacaagctgatgttaaaattcacactgaaattcaagaaatacagaatagtcaaaacagtctttataaagaacaatttggaggattcatactttctggtttcacagcttgtgataattaagacaatgtggtagtgtcataagataatacacatataaatcaattgaatagatttaagagttcaaaaataaacccataattgatatttggtcaattgacttttggccagggaatcaagactgttcaatggagaaaaactagttcttccaacaaatagtatggggataactgtaatgtacacacaaaagaattagtttggatctctgtcttacaccatacacagaaaattaactccaagtggatcaaagacataaatataaaagctcaaactataaaacacagaaaaaaggaaagtagatcttcatgactttgggtgaagctttggtttctttctttaaatacatttagttttaaaattgaatttgaatttcctttttcaaatttaagaatcagattgccatttcacacttctttttttaatgtaagcatatctgaaatgtccccgttttctctaacgggaacacattattttcattcttattatgttttaaaattttgttttcaaaattatatttatttctggctttgattaaatgatagacaaagtaacaacaacaattcagtatcgtaatttgactctggcattaagaaactgcactcttgaacaagtcacttccctcaatgtctctgcactgcattgaagaggggggtgttacaaaataatactcactagatatactttctttgggaatctgtaactttgactatcatgttgaccatctattggcagatataaagcacttgatataaaaatatttttaacaaacatctatctgatctggtccatacctatatttctaagttaaagctgactgttttatgtgcataaacaaattaaagcagacagaagaaatgaaaaaaaaaaaacccactcagaaacacagtttaaatcaatattcattgatttctgggacactatatgcaaagagcaataaacagaggcagattctaaaggaggtggccacagacactaatcaaagacataatacatttacagggtaatgcagcctaaggtttttcaagaatatttgaataatcaggtggtagcaagttcatgaatgtactttttgagtacaaaagacaataatcttctatcaccattgaaatcattaaaagctataaactactgcattaaagcgtgtagttttacataatgttcaatcaaaatatttattcacgagaaagaatactttaacaacagatgtacaaagtatctcatttgtctttttggtttttgtcatgacagcagtttgcagttgttataaagctattacgatgaaacatacaacatttgaagtaattgtctacattggctaaatattctttcccagtaatgtgattcatagctggaaagatacatctacttctctagtctaggcaagtaatttcacttgattggagtctgttaataaagacaatagatgtctactgcagtcttactatgtgccagtcttgacagttgctttttatcaattgttgtgtttaatcctctcaacacatcatgaggtatgtattggtatttgaattgtacagaagaagaaactgaggctcagggaaatgaaatacacttccatagtcgtacaggtagcaaaaagcaaggctatattttaattattcctgctccaaatgttgctttgtccatagtatttttctaggcagtaatttccaaatgtgtgtattcaggtcaagggacagtgaatggttgagtacagaagttacaactctagtctaactctactaaacttgatggataagtcatcctcacctgggattaagaggatggaactatttctagttttataattgattagacaaatcttaggcaaatcttcagctaattcattgaaacagtccaactcatcctactttagatatcatggtagcagggtgagtgacaggtagtagcgtagaatgatgatagttttccgtattcgaatgtctaaattcacaaatccttaaaatttaatctctctgcatccacaacatgatccctctctctgacagctccacctgttacagcataaaatagaactttcaagtataaaaaagacagaggggacagctctgggatgaattccctggagaaagatgtatacttgccaaagcaagaaagagggctgggcagtaagaattcactcacattattagaatattggagaactgttttcgatctactcgtcaaatctcattacaataaactgtagagcttttaatgaactcccactgatactcagttttagtccttattcattcacttagccatttaaatcaatagatatttagtcagtggctactatatgctcagccttggctaggtattggagatacacagatgaggaaaaagtaagcccctgtttcatggagcttgagattattaggagaaatgggatttaatcagataattatgcaaatgagtgagtatctggaagttgagattaatgctaagaaacaaagaaatattgtttcatgaaagcacacatcaaacaacaacaacaacaacaacaactggactgaggcttgagaaaagcttgcttgagaaaacagtgcctgaactgagcttacaattaagtagaaattgattagacaaaagtaggaaaatgggaaattttccaagcaggcagagaaccagtatggaggcctggaggtggaaggaaggaaggaagagagaacactgaaaatgtgggacatcagtattagaaaagctagaaaggaaagctggagccaagctgcagaagaaattgtagatcacgttcaagtctatatgaaagatactcatctttatcttgagaataactggaggtcacttcaggatttaaagatgcatttgtgtcatgggtagaggaggatgataggtttgcatttaaaatttcccaattactatacaaggaagacatagctagaatggaggcagaaagtgaagttatgagactaattaatccattggtgaaagttaattgtatatttaataagggtcttgacagggattctatgaggctgtatatatacaatattcacacaccattgtggccagaacaatatataaaacaaaagcagcccaggtagctagtcaccctgcagggagtgagtcagaggataaacactagttctcattcacctgatagtgtctcccattggctaaatacaactgaaagtcagaaaaccaggagtcttcttgatgcagtgcacacaggaaaatttcttggtgcacagagcagggtgaagaagagtgatgagtggatctgggcgggaggcaggttcagtgagagacaaacaatatatgtaatttatccatcagacttgaacaagtaaatcagaaaagatggaggctatacttacacaatcaaagcatgattatttttttacattcaacaagatttatcaatgtctagaaatatttttaagccagttatgtgaaaatatgtttaacacattactttgacaaggtaagttatagtctagggcagcagaaaaacatgcaactgaaatgatgccctggacactgaaaatgatcgagaaagtattcctcacattctcaacttgtgagcaaaggattacacgcaaatgctgatccagccaagaaagcacacatggacttgtccattggcctatgtacattctactgaaggtgaagcatgagtcaaatagtgtaggcaaaaattctgccaaaacttagcttggctccttggtttgtctattcaagcttttagctgtagccaataagaactctgtaaaaatgcaaaaagatggaagttgcactccctagaaacaataaaaatgatgggtggcaaatgccaattgtatccagacaactaatactataaataatgtgtcaaaataagatgcttaagttattcctttcaggaatcactaaacataaaataaagatgcacgtatgagtaagaactaacttgaggattgcggattataactcatgaaagaataaatcatagcacatcattaagggtaattctcaggttaatcccatatttatttaacgtatttaatagaagatcataatgccccaaaaatcaattgaagaggttttggttattatttaaccaaatactattttaaaaaatataatacttctacaggacattcaacaggttggcaggtattttgatgaatatcatcttagtgaatgttgccagcaacctggggagacaatggttatctccattttataggatgattaatacttacagtatcacagagcattagatttggaagggatatttaaggatccagttggtgctatgattctaaggacatattttcttacaactagacactgaaacagtcgttctgggagggttccaggaatttatattttaaacagctagtaggtcattgtaaaacgctatcaagtttgggaattcttgtcctagcgcaaccatctgcccagtgccttagtctcctttcctctaaccaaacaatattttataccttgtttaaaatttgctggtcgtagaggtcctggcaatttcttgaagcaatccatcacatcttaggacagtattaatttgttcaagttcctagctaaattgtagaactaagaatcaaacccaagtattagtttaaattatagggctcttttcatgataacacatctattctcttctcagccatgatgaaactgagcataaaacaatttaagaaagttttcttaaaattaaagcacttaaaaaatataaaagtgttatactctagaaaattcttccatgggattttttttaaaagaaatactaattaatggctttagttaatccaattctcatacacaagacaagctatatttattgtgtaagaaagttttaattggtataggatattcaggaattttacatgaaataattgtcttgggacattggaatataatatttaatatttaatacatgcaatgtaatggtacaatacagcttggatgaaaaagggaataaaattatacaatcattgaattaattatatgtcaggcattttcattagtcttcagcatttctcggaatggctgggtcacctgaagtaaactgcatattagccttcatctttgtgggtagtatatctcattgtaggtggtttatctcagagccagtgggtcagagaaattatcaaagaaatcttacatagtatgaatttcaaaaagaaaaactttagttctctatttcttaaataattatatggtttataaatttcttgaatgtagagaaacacataacattggttggttttatataatattcatacctgttagctgaattgaagggcagaatagtgatgtggctcccatataacttactaagaaggtattttcaatgtaatctcatttatttttgaattttacagccaacattacatatgaaaagttctcttcacttgaatatgggaagaagcacaaataattctcttatgactagaaactaaagtttccaacattttttatttcttctattgctacatttatgataatacctcatcagcttgaaatccagtagttggaatatgtcttacttttttgtaattttaactagagaattttaattttattctgcctattaagatatttaagtaaaatcagaatttagaatgaataactaaactgctaagaagcagacaccaaaagaatgaaaatattttatagacacctcaattggtttgttatgatgaatctattatgtaatttaatttaaacacttttggagatatttctgagggactgtattaacctaattcaaatcatagttcacatttggaattaacaaaacattattttaaaatattctatatttcggactttaattacttcaactttttagacaatttgttatttatttgacaattatcttccatgtaaagagtaaagtgttagatcatgagagagataaatattgaataagacagatgttttaatctatttgactttaccatatcataaaggatatcaaatcaattcaattcaatccaacagtattcattaagtgcctattttaagcaataactaaacgaggctacacatcagaaaataaataaaataggttttcttcctgacaacttactttgtggtttaatgagagagagagaaaagtaaacaaacaactagaatataatgtggtaagtgatctagttgaaatatataagttttaaaaaggaagtgcaatatagaaagaaaccacattctttgcaagaggtatgctagttcacagttggcagggtaagagaaaggagtgaggtcaagagtcaggctattcttagaaaaagggtcccctatgttaaaaagccaccgacacaaaactgcttgaagaatggcttacgggaaaagagtttgtttataagatataaggttaacaccacattttcaaaatattcgtccatcaaaagacagcttaagagagtaaaaatgcaagccaccgaaagggtacatatatttgtaatttatgtaacctatgaagggctggtagtcaaagtatttacattagttctattgtttaataagggaagaaaagacatccagtagaaaactgtgcaagagatttgaatgaacatgtcaaaaaataggatagctaaacaattattaaatgtataaaaacgtatacaacctaattatacatcagaaaaaagtaaaaccaaaatggaataccacaacacacctactatactatgtaaaactaaaattatatataaaaccaagttagcaaagatatgggacaatgggaagacttgttatggtacatacgtattaataacacaactgtggggggcaaaattatcattatctactaaagtttaacttacgtatattcgatgacccagtgattcagttcatagatacatatcttacaagacttatacaccgtaagatatatacaaaaataattatggcagtgttagtcatgttagacaaaatctgaaaacagttcagatgctcatcaacagtagaaatgataaataaattatgatatatttgtttgtgtttgtgtgtgtgtaatggaatagtataaggaactaaaaatcagtgaacccaggtaacatgaaacaacatgaatgacagtgactaatagttttgagcaaaagaaggaagacacaaaagaatacatattattagatccaatttatatagatgtaaaccacaggtaaagttaaactacagtgttagaaggcagggtagttgtcacctttgggaggaaggaggacagggatgggcaaaggcaagcaggggacttaagagaagctggtgttaaattccttaagttaattatatactttgtgataattgatgaatttaacatttatgcttattgcacatttctgtgtttcttatatttcagttatttttaaaaatgaaaagcaatactttagacctgccttctccatgaaaattctcatctttccacaatttccatacttgtttctgaaaattttaaagtgctgggtatcttttctgtcttagaacaaagcctattattctggtggcattcagcaattaccaaataataaaattatattggcaataattcaatcaccacattcttgactaaggctaatataagaaatgatccatcaagaaggaaagaaagtaattccaaaggaagttagagattctcttggtaattagacaaaatcatattacaggcaaatagtattatcaattatttaatgttacttatttgcaaatttattgcaattatactataattttcatcacagatatagacttaggtcacctcattttgatgaactaaatttaatttttatttgtcccagcaacttcactttaaccttgcttttagttttaatgttttagtttcatttttgtttaagaaactttttttggggtttcacttttagtttcttttagtttcagagactttacgtaaactatacctctagtcccgatcagattttgttgttgtgcactatctttcaaaatacggacagctataaagaagttaaatgaaacagcgtagataatatcctattattgaacaaaaataagcttaaatgcatattttacactagattaattataacagtggtaataaaatataaatgtattgaaataaaaattatctttgcaaggaaggaaggtcagcaagcatgtgaatacacacaaacacatatacatatatgtaattaattttgtggtgttgtatttttctaatatttaaatggtactatgggctcattgtacatatttcaatcaaaatttggaatgtaaagttcactaagatctctatttccaaagacatccaccatttgcagttaagagactattattctaattgtagtttttgtttacaaacacaactattaatattaatataattaaaacaatcactaatatgaaaagtaattaatactattaattactaatagtttataacactaattattactagttaccattttatactgatatttttagtataatattaatgctaatattattagtcttaattttatataaatggagtcataatatacatactttttaataacttattttttcacttaatgtacagttacctatccacgttagtatttatagatttacttcattccttttttctatttcatttttatattatccataaagcataattcacttacctattattgataatccattgtattctcttttttgatgttagatataataataaaataaaaatttttatatatatgtatcagatatacacataattttctggagctggaaatattaggtcaaagaatgtaaagatcccatttttaagagcaattgccaaatttcaccccccaataattatatctattttattccccttatgcttgccagcaataactgttattattttcattcttaatcgctctattttttaaagaaatcctattgcttcattaatacaattagcaaacccaatgaattcacgatagctaaaacaaaagaacaaatatatatcctaccaaaactgttggttgagttcctaagaaagtaactggaggtattcatgctttcaacaattgaggtctgtgttgtatagaatttgctgaatgactaactccttattttatttcttgatataactactcccataaccttttaataaccatttcaataacttaatataagggttattgaaataaccatttcaataacttaatataaggagatcatgaacaaatttagatggtactattaatcacaaaccaaataaatatcatcatagatgcttccagttaggcatagatgcttccttttaccttttgtaaaaaggtgcctgccaagtatctttttaaaaagtatgtaaatgacagcaacaggcatacacacatgaacataacactttgctaccctttcataatggtgttcagatttcctgtttcttctttctttgatagtgcaaaatctattttattcagatagatagatagatataaatggatgaagctaattacaacccaatatatattaatcttaggattatatagtagacttttcattaactgttgttctaaatcttacagatttagaaagctataatcactttctattcagttcattaatcataaaaggaaggagctcctcacataaaaaaaaattaacagaaatcagctgggtgtgatggctcacacctgtaatcccagcactttggtggatcacaaggtcaagagatcgagaccaacctggccaacatggtgaaaccccgtctctactaaaaatacaaaaattagcagggtgtggtggtgcgtgcctgtaatctcagctactcaggaagctgaggcaggaaaatccgtttgaacccgggaagcggaggttgcagtgagccgggattgtgccactgcactccagcctgacaacagagccagactccgtctcaaaaaaaaataagaataaaaataaaaattaaaattaaaattaacccaaatctagtatgtctcaatttaaacagaataggcaagaaaaaatgatacagttgagggggagaattaataaatctttaaggctaaggtatataaccatttttttaaaaaataatggttattcagtctcatgcttaccatccattacgaatgtgtttctagtgaagaccacaatttttatgttgatttacatgttttggtttttaaagaccatagcctcagagttcacccaattggagatatattggcaaccctccatatgtcacaatttagcagatgattttgcgacaaagttttatctcattttatggtataaatagtaaaaaaaaaaaaaaaaaacctctttatattcaaaatttatctggaagattacatttcaagctttttagaaattgctttcaacatttctttttaatttgtgaaactattcatagcctttccactgattccttccccattacatctgaaatgacaaaaaggtgaattgtgccatatggaaaacatctcatccagcatgttttgaagcaacctcataaatcgaatattatttctggatgcttcatgatcatttgataggtcacttaaaggtgttctaaaaatattatttggaacattcttcatagagagcacgctgtcaaccttcagtctaacatgagcgttagacattatatgtctatgctcactttattttttctgtcaatagcacagaagccctcacacaaagttataaaatatttctgacattcatggctcacagatcaggagtttcaaagagctgcagacggttatgttaattaagcaaaggcattttctataaatccattgctgaagcaaataaaaagacgggtggtgagggaggtaggtgtgtggtgtcccagtgatcaaccaaactgcagtcagcatggagattgtaagagatgaaatgaaattaagcatcttgctttgtaatcctcttctagaatgttctagaatcttctgcaatgtttatatgacatacaaaaaggagacagtataaacctgtcaagacattaaaaaacaaacaaggaaacaagtaaaactgaaattgcctttcctggatgacagtgcggtactaatcatgtaatgccatcacactaaatcaagggtaccaatcacaatagatctagcaaaatcacaatgctctttttgccttctgagtggtgctaatgttatatatgtcaatgagagcttttcctgtgcttgagtctaaatacatttactgattaaaaagatgcaagtgcttatgaataggttcttccaaaagccacatttcttaagcttcattctcctgtttctaacacaacaagatgtagtatttagggtaatgcttgtcaaatgggcaccgactgtagctgattccataaacatttgccccctttgtgttcttgaagcagaatacaacattacatttccagggaaagttaagaatatgtaggtacttaaagggctgtcagttctgggttttttatatgtaacattaatttttacaggcagcaaacatcagacaattataaagcacttcacctagcaaacttcagcctttgttagacttacaaagatattttgtcatttgcttatgagacttaactgatagccaagaattggctgtattattgtctagcaaagtttccacggaacaattataatactaaaggatgaatacttagaatataaaaagccaggtgatctttcatatttatgaaataatttttcagttagtgacactcttctgcatgaaccattgtgagtcccactatctcttgaaagagaattttatcatgtaaggagaatatttacatttatgtagaaaaacagtgtttactatgtccagctttagacgtagattacatatatagaaattatttcatttaagtataaattgttaaatatttatatggtcacatatgtataaacacttcctttaaaatatattgtgtttaatttttaagaaacaaggagaaaattcaaggagatttttatttgcttgttaaacatagcaatattgttcaaatgatgttaaaattaaagtaataaatgcagattctgagcaaagaaattgggaaataaagatgactataaaataatgttttataagggcatttgcatactttggcacagtaaaatggcatatgtgggtattagaacagggcttttttaaattaaagactatcattatgaaagaaaatagctacagtttttcaaagcacttctgacttcctataagaatacctattttctacaagtggattcgtatgacactcagtcttaaaaacctgaagggaaaaatatttttgacagagatttttaaagttttatgaacaattttgatgtccctaaagggttaggaaaaagcatgtgaagcagtgtcccaggtaaaagtaataactcagcaaggaaatgaaaatatttaattaaacattacatgcatgcatgcatttataaatgcatattggaattactgtcatatagtaggtaaaacgacaagaacacaaatcagaaatttccttctctggtcctgaccaaccatgtgtcaatcagccttaagtgtatatacttgtcccatgaagatttacattataaatgaatacaataggtgttcagcatctactgatgaacaaatgaaggaagctaactctgctatgattcataagtaacctagtatcatatatgttctcactaatagaagccattaagataaacttaggtacacggagaaaagataagaaaaggcccatgaataataaataagcagtatggatatacggagatcaaattatgtcaaacaaacctgattgctttttttgatagaattacaaaattaatggataaagggatgcagtaaaagtagaatatttggattttcatgaagtatgtaattcagtgtttcataaaatctgtcttacaatattaattcaaattggcttgaagatgattattctcagatggtgggaaaaccatttaaagagctataaacaaggggtaatgataaatggcaacagatagaattggggggaggaatgagctgtcaccaaggttgatttaggtctcgaattttagtatcttcattactaacatgcaaaatggaataaataacatgcaaatgcaattcgaaaatgacactaaattggaaggcaccataaacgcaggacagtaaaatagtcaagagaatgtgggctggaacataaaataagactacacgagagactgcccgcactaaaaggcaagtgtatgttaaaagatagtttggatttattaccacccctcccccccaaaaaaaacaatgccagacaaacctggcaaaataggttgacaacataggattgcacaatcccataagtaaagcattctggaaactgctttaaaatatttatctccagattttaattcatgtctaaatctcagcagatctataaacagaagggagtttagaaatgacagtttaaaccaaattctgattttctgtatggtatcccaaacagaacaacgcatatctttatagagtgactttatacattcaattctctattttctccatatggattgttcacaggaaaaaaaaaaaaaagatccactacaacctgcctattctttgacaatgaacacacttataggtctttccttctctcatgagtgcagttgaagtgtatgtagggaatatcatctacacaaaagataatcatgaaggtaaatcttctgtaaatgacttttggattacccatggcacaatgctccctcttcatccgtgcaaataattgagagtcgattgtacacacatataaggaaagataaataggaagacaaatgacttctatgagaagattattaatttactccactttatcctcttgtatcggacaactcaacaaattagcgggaattcagagcactgaaacaaaaacgataaaggcaataaagttatccacttatgagaatgaattaaatgagctaacccatggagtgcatcagacagccatgagcaagctataacgcgcaacacctagttatacgctgaaaattcacaagaggaaagaaattcttttcatgggataagggcaatttccctcttactcagattctcaaataaagaaaattacaatttagagaaaacactattgcctaaatcattgtgaacaaatttgatttagacttttactgcagaaatatttctgaagtactaaagaaccaactcttgattacccatggggaaagacattaaaagttacaagatattagtgaaaatcacaaggattttgaagtgagatagtcgtaggtttgaatcttggctctgtcacttacacaagacatattggtgtggtcaaacatcttcatctgaaacatagagaaaataaatctaacctagttcacatatgtgttaaaatagaaaagaggaacccacagaatgttaaaataataaaaagttagaaagtcacatttcatttaaaaatatacacaaaaacattatttgtaaactatcatccctagtagggaggaaagatggtagaaagagcatgatattgggatcatgaagtcctaaatttgaacactacttccccattgaccaattacatgacttaagtaatttatttaaaatctaagtgtaatagttctcatttataaaattgctgaagtgctgtgcaggtcagtagattgtaatgcaaataactgacatatagtgaatacaaaataaacatgcattttcctgtcccctcatctttatctttccccacctaaaatagttactttaactgttctttaaaaatgtgcatgccctcttggtgcatatgtagcatcatcaatctcaatattcaaactaaattggggtagaaaacacatactgcctatgttttctcttccacattctagcagtttaaaaaatatcaaataatatatttgaaattatttaaggccagagtgtaacattaatgaaaattttatattatttactcaagtattcctacatgtgtattattttgtttcatgaatcttagagataaaaggctgtatttatatagctcattctgtacagcactgaatacaaatgagtgataaataaaagcttttgataatagatggcaattaggcacatcctcaacctctttctgcttaaccctgatcatttcagcttggtattagtatctggagcctgacacctgactgaagagtggcaaaatagacatttgggcttaggtcatctactttacatatatatttttgacagttgcaggtcatcttcatagcaaaaactataatgtaatatgaatagattaaaaataaaactggaaactttgagagttgagactcttttttaggaaatctgtttcattaatgtcactttaaaactatgttatttgttaatatttatttataaggaaggtaaaaattataccttcctcataaagtggcttcgatatataaagaagcttacacatatagtagttaaaacagtatctaagatattatataatcccccaaaataaagttgttattagccttattgtattgccatcaatatttttatatcaagatcacctagttccaaagataagaagggatataacaccattttttcataagaggatataaaggcattcttgtagacacctattgtgtctaatgagagctatacatctgagaacttccccaatctctcacatcctaatcattgacatggttacggttggaattgctatcaactggcttcagttaactcaaggtgactcaacctccttttctgaaatgaattatggggcagaaactggggggaaaagttagttttactttgggtatcttaactgaaggatataagcataaaagtgattggctgccacgttttctattatgtgggccagaaaagcaaataatgtcagtgtacaagaaagtgaagtccactaatagcaggaaatacgaatgatagatggatacaatattcagatggtctttatatttctgatttaaatttttaaggacctatgcattctccccaccaaaaaaaaaaaaagaaaaaatatctttggattctatggaatatttctgatttaaatcgcactaaggccttatgcattaccgcctctaagaaaaaaagaaaaccaaatcttatctttaaattctatgattttttatatcaatatcatgaattttctttttgccttagcttctttatgtctaactatttaattttatgaatgtggtaatcaaggcccagagtggctacatttttgcccagtatcagacaattttcaagtggctgatatggaaccaaaaataagaataatttgggtatattatcagggtcttaattttataagatttcaaataaaactccacactttgtatcagaccaggtaagagaagagggataaggctaaaaaagttaaagcaacggcttccccttatcttccaaatccagaaactgttaggagaagggagatcatagccagaaccatctaatcagagtctttaaacctgatgcaaagtacatgggtaggagaacaccttttccaaagataaactgaactccaagcaccgaacaaactgttcacattctagatagggttactgggaggcttccaacagtttcgaatagagcctgttagagacattacctcctacccctaacatctgtctcaggctagtcacatccacttatattctccaggaaagatgtatatcttcctgcttcggtgatgcagagaaagggagcttaaaaagatcatctgttgattgttatgattacagtcctctatatggaaaatgtgtctataagcaagatactgacctcttatgacatcaacacacacatacacacacacacacacacacaaatatcttctaaaggccatcaccaaactaaacttcactaaatagtgagtatgcaacatttttcctatgttgcttagagacttaggaacacttccacagaaagcaaataaaactagaaatataaatgatttatactgtgataagtggactatctgtatgtataaattaatgcaaaccaatgaacacaatttatagtaacagtactaacgccaccaatttctaaactacattctatagctatgattctgtcatcagtctttgtttccataccacatcatcatggttcctggcacatagtaagtgcttaacaaatgtttggtgaattaataaaatctattaacaatcctcaccctgctgggtttctctgtgacacttccagccactcagcactctacacagtccaaaccagcttgagaggtgaaaatttgcactctagtggaaagagttctaaacaggaggccgggagacaggttctcagtcttagatccgtctagacatttgcattaacttccctcatctataaaacatgtttgctgcactagatacttctaagagctaaattctaataacattctacatttttaaggacaaagaagatgttatagatacattttaaaagcagaaaagggttagaatcctagctttaccatttacttgtgactttgggcaatttatttaacctctaaactttagttcctttttctgttaaaaaggaataataataacacttacttcatagaactgttgtgagagtcaattgaaataatgcgtgttaagcttcagacacagtgcctggcactaaacactcacaatcattatttgttgctattgttcttactattttttatttgttgtgttgtttttatatatctgctctcttctctgatccaggaacaagtggaaagttcatcatctaattaaaatctgctgggaaaaggctatcaaggagactaaactctgcaggacaaatcaatgtaacaacactatatataaagggcaaatcgagcagtaacatcaaagggttattgaactgtgtagtcttcaaacactttaataaatagaagtttcctattacaggtatcaccttattataatagtaggacatgaaggaaattttaaaccactttagaggagtctgggaattatcatatttatcaaaggaagatgtgggttttaaagattaaacagtgctactggaagaattattgtgaaaaataaaaatggattgtctatcacatgacaggtactaaccataacaagaattctcataaccacacaaaatcactaaatgaagaaagacagagttgaatatgatgcaatcctgcacgtgtcacagaaccagtaaactttagagatgaaattcacaccctggttggtagtccctgggtagcagctaagagtctcaggatatcattacccacttctttgtggttgatacagttctacttcaagaaacaccattgccagtgagaaagctacaaatatggtggttatgaccaggaacttgagaatctaacaagtgaaaagacacataattcatagaaattacttaaatgcctataagaaatagcttttatgtgtctgaattctattttaaattaaaaaattacaaatacaaaaatggtttattcattgattcatacaatggacatgtgttaagcattctcatgtaccaggtacgctattagacactcagtttacagcagtaaccaaaagcaaccagattccctgctcagagaaagctcaaattctaggaaaagatgagggggacctgaaaatacagaaacaaaaacaaacaaatatgtaaagtagaattctgaaataataataacaataataaaactggggtttccatttgctactactgatctgcatgtatattaattttgtcaatagttgacaaaggaaagcaaatagaaaaatacattaaaagctaatataagactatatacaaataccaacctgatttcacattttgtatcaattaaaatagctttattttttaaaattgacttcataatatataagcttaatgaatttgaaatttcaaagtaaaaatatactaataaaatagatgtctgggaattccactttgggaaatacaagttccaatcaacatttaaacaacttttgggatagtggttagtattagtgcttattcttcctggctgaattgcacatttttaagtttgaggaatatcttctgatatgatttggatttgtgtccccactgaaatctcatgtcaaattgtaacccccaatgttggagggggaaccctgtgggaggtaactgggtcatgggggtgaagtcctcatgcatggtttagcaccatctcttcttggtactgaatagtgagtgactgctcatgagatctggttgtttaaaagtatttagcaccttctgtctctctctggaacctgctcctgccatgcagatgtctgttcccactttgacttctgccatgagtaaaagctccctgaggcctcctcagaagcaggcgctggtgacatgcttcctatactgcctgtggaaccatgagccaattaagctcttttctttgtaaatcacccagtctcaggtatttgtttacagcaaagggagatggaaataatacatctttactctttttgtgagtttgtttcatccaagttatataataggtgaatcttatgtagtttgtgcctactgagtattttaattgttctgaaatctctttctttgataagaacaagttgcttagagcaagcagcctagtacaaggtgtgcttataaaatgtctaccaggccttcattattaagggtttgctatctccacaatgaagtatgattactcagcctctgcctttcctggtcagatgtgttagtcctattcacagctgtcagcctatcagaaacctgcatggagataaatgatgccattagaacacatggtctgctcaacagacactcagtctagaagctgtggcactttgatttacttatctgaaaataaactctaccaaatctcctctaaagataattcccgtcaaggaacttaaacaaaaatacaatgcaattgaaaataaatgttaaaattataagcctattatttgtaatcactgctattataacagttattcaatgcccattgtactatatttcttgaaacctctttaacttgtaggagttgtaataattctcccttacacacaggtttgaaactttcatggctctatttctccttagaggaaaaactgtttcagtctttaatatcctctaaagctccctggaggtctagtgattgtcagctcaaactggtctatcctatagaagcatctagtcttggaacttggtccctgtgccttcaactcctgaaaactgagtctctgtccttgaaagattataactgatcactcatttagacatgcttgctccacaattctccatcctagatgcatattataatcatattcagagtttaaaaacaaaacactgatgcacaggccatacttccagattccaatttaattcttccaagtctgtccacttcagatgctatttaaagggccccatgaatgtacaatgccttcatcaacatgtcagctaactgatgattaaaacaaggtttactataaggtaatactaattcttgggtttttgtttctttcctctcttcatgtccactatctttagtgatttgcttcaattgttaaaactgaactaatgtgatgacatgtgcaattcttcttttttctaacaatctccacccttttaaattaattctttatctatcttacgttgtgttggtcacctcacccttttggggtgattattaatttgactttaaaaaccattacatattcccagcaggagttcataactgtttcccaaaactgacaatgacacatacctgactttctgtatacaaaatgtgtaaatgtctatacagaaaacagaatgtgaaaaataatggcattttccttggcgtgacagagagggaagaggaagctgaagagcaggagacaggtaaaaaaaaaaaaaagtacagaaagatatattaaggtcaattgatgtggcagggataaatctttttccaaaattcaagtatagatttatagcttatttattgcaataaacttaaattaccttaatctaagcttaagttcgattttgagctcttattctaccaggcaggtaaactaaaacatcaggtgattgggatatgacttacatccctacttcactgacttttccttaaagatctatccaatttccatgcaactagaaggaattaccaggaattgaggtagggcaaatttacttgcagtattgtaactccctcttaacactgccaatggttgctgtatcattttgcatgacccctgaagggtgagatactgtctcaggttgagaactattagactgatggaaaggaacaaagggcttaaagaaatattggacaaaaaattggctaaagttcccagagtaggatccaatctatttgtatatgtatagtgaaacaaacattgaaaaaaaatcataaaatattaacaatagctagttttagattgggaaattataagtgattttttaaaattattttttgtcttttgtttgcccatatttttgaaataaacttgatttccttcataatatgaaaataattttaaaacatatctttaaagtttataaggcaaagcaaaatttattacttttttttattcagaactccagacagtgttcccactctttatattagtaaatgatcattacgaagcaaatactcatcactctcagtattttctctcttcctaattatatgaagatcccacacgtgatatgtctccagttccacttcatttagggaacctctgtgaccttggaaaaattattataactctaggtcacaggtggagagttattagcaatgtcctatgggaaacaaatgtctttcctaaaactgcctaattatgatcattgtgtgtacataattttcatgtattttgtgaagaacatcttaaatggtttagtttaaatgccattagggaattatacatagttattagaattgtagaacaggatagactattcacataaaatgagtctcatttacacatcagatattacactgacttgttgactgttgctcttgttcagtgctcagaaattattaaagtttgggaacttaaaaaagaaacactttctgctccttggagaatggaattataccagtgtttttatttttagagtgttacaatcaagttcatatcaagaaaaccagataggacaaggagttgaaaagttattccaatttttctgacttttgtacctctttatagatcgaagagtgaagactcatgaggctaaggaaaatgatatcgtttacagaaatagaattttaaaatatattgaatatatacaaatttaactaacaccaatctggtcttcttcctactacattcctgtatagtataattatatttgttgattagatggttgaatacgttgtatatgttgaatgatgctttcttagtggaagtaattttaggatattgtagtacaataaaattaggcaataagttggagttgaacaatgagaacacatggacgcagggaggggaacatcacaaccggggcctgtcagggggctaggggagggatagcattaggagaaatacctaatgcagatgatgagttgatgggtgcagcaaaccaacgtggcacgtgtataccaatgtaacaaacctgcacattctgcacatgtactccagaatttaaagtataataagaaaaaattaggcaatacagaaacacagggaaattattgatacgaattctaggatgttacttcacatgtctgatcacctcagtttgcttaactaccaaatgtggagctagatggcctttttcctctcttttacatggaaaatgcttccatacttttttctattccagaaagcaggaactataacttcagaatagaccctatcagaggatataggcgagcacatcccaatggaaagtatctccagagaatgatttatgtcataacaatttggatttgcttatcaagtacttaaccttgtgctatgtgctttttaatacattaggtcatttaaacttaatgaaagtcctatgaagtggataatattactatcatttctacagattaaaaaattagagaattatttttctccatgcttgtgagaataaacaacaacaacaataacaacaagaaacagaactcagaagatgcaagatgaacctcgaacctaactaaactcttggaacccatctgacatctataactcaatggtgtgagagaagtacaactaaaaaagaattacaatgatgaggaggataacagcaaaaaaaattacaaatgaaaacaatgaagccaactgcctgggtttaaatcttggctctgccattaataaactgtgaactctcagccaatttatccaacattgtcgtatttagggattttcatatttaaaatgggaaaattgatagttctcaccttgtggtgttataataatcctgagttaattgtgacatatactcagcagtcagtaaacacattataaatatataaagacatgctattatcatgccatttgattgcttttatataataaatagctgccattaaggatgattagggaaaacatagatattttaattctctgacacatcagaaaaaaataagtatttccagagaaataaattatgtaagttatcacgctgttactgaatagtaagataacctttccttccagtaagagacaatgaaaataaataaataaataaaagaaatagaaataaaatgaatagtaagataacttggttcaattacaaatcagcagttgaaaaataagactccttagaccataatatggtttggatgttctatcccctccaaatctcatgttgaaatgcagtcccctatgttgaggtggggcctggtgggaggcttttcactgatggggtgaacctctcataaatggcttggtgcccgccctgtggtcatgagttcatgtgagataaggttgtttaaaagaacctggctttaaagtataataataataaaaaataataataataaaataaaataaaattaaattacataaacaaggaaaaacaaaaagaatacaaaggtacaaagctcctttaaatatgaatagttttccagacaaaatctacttaacagtatgaaattaatagctatgttttctcaattcataattactctatttttaggtaaagattgtgtcataataaaatacaggaaacttctcaattcaggattgtacaaagtttagatttcaatcaaacttgttctttaaaactctaaattattgtggcatggctacagttaaataaaatatgaaaataaaaaaataaaaaaaaaaagaacctggcacctccgcctgcctctcttgctcctgctctcaccatgtgattcgcaggctccccggttaccttctgtcatgatcgaaagcttcctgaggcctcatcagaagctaagcaggtgctggtgccatgcttcctgtgcagcctgcagaactgtcagccaattaaacttttttcttgataaattatacagtctcaggtattccttgataaagacacaaaatggactaacatagtccataaataaaattctcgaggttagtgaaattatagacatatatgtcataaagattatttattacatttatatgtttatgaaataaatgtgttatatatggattactttcattaaaggaaattagaaaatagggcagaaagtgatatgaaattcctcagcacaattactaagtttctgatactgtttttttttcttttctacgtaaacatcaaaagtaatattcttggggaagagggactacctttgtcctggagcactcacaatgccttacaccttatgtcatcttgattgctagattgtaagaattagtctgagaaaaaagtcactaggcatttcctgagttctaatttgagatattttttaaggtactgaaaacaattggcatttggctttgtattactcaatgcaccagaggcatgcagttatcaaaacaacttttgtgtgttattcccccacttattaaattgattttattaaacttgttcctggctgatttgctatatgccaagctttctcccgggatccatttctaaggaattcataatagaggtgataacttttgatgggtacatttcagaaagttctacgattctaataaaattcccaaagtttgcataaaaccctagagaaagcatccaagttgtataaatgttttggagttaagtgtgagagtttaaaaaagcaaccgaatattaattgttgtgtgatacaaatcaaagaacagagaaaaaggcttgtgactcgattgctaatgaagtttaattggaatccatgtgagtatcagaatacagagcatttatgacacaatttcttagacagtaaattttggccgggcgcggtggctcacgcctataatcccagcactttgggaggccgaggcgggcggatcacgaggtcaggagatcgagaccatcctggctaacacggtgaaaccccgtctctactaaaaacacagaaaaaaattagccgggcgtggtggtgggcgcctgtagtcccagctactcgggaggctgaggcaggagaatggcgtaaacctgggaggcggagcttgcagtgagccgagatggtgctactgcactccagcctgggcaacagagcgagactctgtctcaaaaaaaaaaagaaaaaaaaaaaaagaaagaaagaaggtaagttttatatataatgggcagaatttcccaacgagaacccagagctattttctatatgttctaatattttgatcaaattgataataagctaagggaaggaaaagagaagactcacactgcaaacaatgtcatagtttgaaaaaacttttaatttataaaaggaaaatgagagttgtgcttcacagagaaaagctcaggtttggacatgaattgaagaaaaagggtttaagaggtcagttacaatggtatagaggaggcaaaatctgagaaataggtgtttattaaatcccagattttagaactttagtagattgataacagcatagcctttgtgcaagtcaaattacaagttaaaagttaattagaaaaaaaatagaaaataaaggagtatgccatcgtaactacaggatatccttagagaacttggtgaaaatgttaaataacatatctcatatgttatatattaggaggcattaagatgagatcagaagttctcatcttagttatgaaaacaaagtttaaaggaccgttttgttcttcaaaataaaataaaagtggtggcttactgagggctcacatttcctcaagtttatttagatgagtaagtcattgaaactcacatagtatacatgtcatgcattatctaaaatatactgactttttcatattaaacattttatttttgctagttgcaggttcatgatttagcattatgcaaaataaatatctagcttaattatctgcttagaccctgggaaactagggtaactaataagccagagcaggataagaaaatgtgggatgaagaagcctaggtaaattgggtgccagacaatgggtatttgtaggattctattcagctggaatcttgagtgctctgctattcaaaagcaatgtacccttttgcctacctctctcctacattgatcctacttccattgctctattattattatgtgcaatatctatttgttcctccttctattaagttaacggctaaggaaaaaacatggaaaacaatatagaacaacttgttaaagttgggcaattgcatttcatttggacaaagcttaatgaagtaatttaacaaatgtttatttagtacatacagataagctacagtactacgcactggcaatattgagatgaaagataaatgttgttcccataagataatcaaagtgtagagactggggttttcatgtagggacaagcaggagagtcaacagtcataatttcatcattgttgtaacaatgtacaggatgctgcagaagggagaggggaaaagtgtgccattacaatttaggaaggcatagtgtacttttatgaggaggtaacatgatactggaaagactactaagactaaaatgaataaagaagagggtaacagatgaaaaccatttcaggtaaaggatacattgtgagcatagggaactgatttgactaagggcctggatccctagctaaatggtggcagatagtttggtgaaagcaggtgactaaccaaatcataaaggttagctaaggcacagatattcagaaataaatgtggatttaagagatagatttgggcagggatgaattatacagaaaggagatgcattgtgataacagaaggcaaagatgaaatataccatactatcaatatttaaatggtgatgcagagaaaggggtagccaatgaaagataataaggaaggatcaggcagatgggacaaaaccaggaaataatagtgttagggaatccaaatgatttcaaagagaagaaatggtcagcaacatcaaatgttgcaaaagataatgactagaagatgtccactgggtttaatacagaatatcattagtaaccttgttaagagccatttcattgagattaaagagtaaaaactgtagtagacaggtgagagttatggagacaaagacaatgcatatagacaacactttctggggtcttgacttcgaacatattagatagaaagtagccaaagatatatatgggtttgaggggaattctctgatttatgtggtagaattgtgagcagaataaaatactatatggaaatagacaatagagaaagagggtatggccaaaattttagaagactcatagacaataaagaaaacaaagtgctgatactgataccatgaggttttcacagaggcagatttatctcggaaccgatgaagcttaatcttcatggctcccttctccaagggcccctttcaaaacaatgtaactaatttacattacatttcttaaagaagaccccctccaaccctcaaagaagaaattgcaagcttctatccttgactttgcatttaaagggagacttttcttccaggctatgagaagaaaggttttagacaaagataatctgtttgaggaaaggcagtgaggccagatttgagaaaaatcctcatggcctctatttcctttaaggagacaccaatgggaaagctgaatgtttgtctttatctaggtcttatcaatgttctggaatacaaatatatagagtttggtctttgatagaactttgatgaaaggaaacccccactttgatgagagtgggttgtttaacaggcaattggaaatggcttgtttgtattaaaagacctgctagtcccttggggcatgctttataaaaagaagtttttattttcttttccaattagaaaattcccagttagggatattatataatattgtattatataataccgttttataatgtgatgtgcaaatgcatttgaaagatgttctaataaaaatatgctgaatattaaagtttgtataagaaaatttagctttgaatttaaataaggcttactcttgtaagattggtatcctataaatagttcaaatgtacaattaatgactcctatatttattcaggaatgatgcagaaataacaggaaaattggagaagaggtgggaaaccgctttctaacacctactgtactacccatggaattgcctgcacaaacttgaaagcactgggctatgcatattaaaaggctactgctggctgggcactgtggctcatgcctgtaataccagcagtttgggaggctaaggtgggaggatcacttgagcccaggagttcaagtccaggattttgaggccaggagttcaagactagcctgagcaacatggacagagcccctctctaaaataaataaataaataaataaataaataaataaataaataataaataataaaaataaatcatgccactgcactgcagcctgggtgaaaaagccagactgtgtctcaaataaatatacaaataaaaggctactgcttcaaaaaattcttattcctgaaacttcttcttgagatatgagataccttattttacttactaaatagtaagtcacatgctatctatctagttataagaaaattataataaaaaagtatctatcaagattttctcttaaatagtaaaataactatcctccatttacaacagctacagtacattgtgataaatgtaccctttgaattaccaacaggtatgtctttccacagttttactttgatggccttaatagcaaggcacaattaatagctatctccaatctgcatgtgatagccatagatatgaaatgatgacttctcccggggcatacaaacatattggtcttgctttcctacaacctctaccttatctgacagtgttagttttggctctagggcaatgccaatttagaattctaccatttcagaagtcagctctatatagctttgttttacagtttttttttttttcttttcaggatgacattatctaattatatttgtaaagttctctctctctccctctctcttttctttttttcctgttatctgtattggggatggtggctagtggggattagaagggctatctacagttagtaagatatctgcagcatactaattccattttaaagataacagtgatcacacagataaccacctctagcaaatctatgcatgcatgcaggtatgaagacaaatgataaattcactatagttttaaaacagccattccattgaaataaaatgattatttgcatattaaagtgaactgcaggcaaaagattgtacatcaatggtcttacagtcattactgaatattaaaacttttttttgttgtttctttgtaactgcaggataaattgacctcctgcaatagatctaactgacagcatggctgttttcagctaatgggttgttatatcaatggaccttatcctggcctcaattatagacatcagcatttactgcaaaagaagcagcatcaaaaagtgtaaggacaaggtgatgaagagaggacaggtgaaacagaagtaagcagatttccatcccaagatctgggcccaagattctgctctaatatttgaagccaaattgttctcccttatcactatacctgatacaagaaataaatagcatttttaattggtcttataagttgataggatggttttgtcttaattctgtcattctcattgatagtttacactcctacagtgtgtctctataagtattcataggcatgttgttttaacagaactacagtaaattggtttcacaaaccacaaatgtccactctgtgccaagaacagtgctaaggtacaggatacaaaaataaataagtcaaagttcataatcctgaacctcaggggaatggccaaataaatttgtgattgcaatatggtatgaggaatgaaataaacgaagtgactactgggagcagtggagaccaaaggaagaagcaattattctgcctgagtaggagcagggaaggttttaaagaaaaggtaagtcttgatcaaatacaaacaattttggcagcatttagataactaggccttgagtcctttagagtcattaaagcagatttctggaaggttactattctcaagagattctggtttttgtttattctgcttattgaaagccacaggtaagtagataaatgtgtattgctaatcatcttatttcaaaatttgctgacattttagtgttgttgagtatgaagtgtctgggatagtcaatttttaatggctttatttatttagatttggttataggcaagggaccagttcttgatagacgagtctatcaggaagtcaatatttttatccacatatgaaacttacacacggttttaagttatgatcttgcattaatgttattaatgagcagaaatgatatgtatataattttgttaaaaaagaaaaagaacattccagtgtgtagcacatggcggataataaaaatatcattattggataagtaaatttatgaataaagttacatgtggctacactgaaatgtgttttgcatttggatcaaaatacaaacacacacacaccctatacatatatatatatatatgtatatgtatttcaaactacttttaacatagaaaagacaaaattttctttaaggcgaagaaagatttttttaagaggtggcaagggtcaaagatttccaagcttcttaaaagataatgtattaggttatatgaaattagtgaggaaacacgcataccacaaaaaataaccaatctatccctagataaataatattctaaagagctcagagcagtaagaattaaaattgaaaaacacaaaaagttgaaaacgctcttatcaccctgaactgaaaataatatataacaagtaaaggtcagttaagtcagaaattccttataaaagcaccctaaacattgttcaaggccaagatttctcacttctttcatttccttaagaaaaaaaaattacttctacatagtctttcaataaatatatttttcaacaataatgaaaaggttataaaaagcttcctctcccgctggaagcttattcagtgaccttacttccctgtctaccgtcaacacagacctccatggtccctgctagtacgttttgcttgggggggtacatttacctcctttcggtcaccaatttgtctgcattctcacagtattagttcctttgtaatgcttccaggttataattcccttctcaagttaattatgtgggtagaactctttcccttgaacttgtccttattttttgccttcttggagaaaatcatatacgttgaaaatttattttatatatatatatatatatatatgtcaggtcagatcaacttgttttaataattctatcttcctttaaaaatgtatcttttttctttaccgctggtcattttcataattttattttctctaactctggtgttcaaagctggtttgccttttaacaactcatttatctattgattttctggtttcatatttctgctgattaaaactctggtcaatttgcttctaaaatcaaattattttatctcaataaacggggaaaacattttattttattcaccctgtttgaccataacgtgttgatatcttgaaaatgcccttggcatttgtttcatttgttgatcattttcatctccaatagagaccaattgtctccagggataattcagtgtattaaaagaaaaaaagtctcttttcaaagggaggattgtttcctcttgtttcttttatgcttatagatattctttctaaaatgtcgtgtgattttttaaacaatagacatggataaccatgtgcaaacagatatactgttagtcatgtatatgaataagagttaaatatcgtaagtaataattctaaaagcctacttgatatatctcactttgaaagttccacaggcatctcaaatataatatttcctaagtggagctatagatctctcccatctattccaactcagtgtcaacagaacctcttccactcaattgatcttccaccatattcttcatccttgacatctacagctatcataaatactattaattctatttccaaaacacatctcacatctgttcaatcctctcaaactgcaataactttcattatccaacacactattctttcttacttagactgctgcaattaactaaccagtatttctacttcaacttctgctcttctccacttctatactccattttccacgcagcaatgttatatctgtctctgtccatctctccatcaatccatctctccatctatttatttcaatgcatgacagatggagcttactggacttctttctcttccagaagcttagccacactgaatactccattcctttaattatttgaaattacctaacttcctcctgccccaaagagttacacattctgctacttttgcttggggcatttgttactttcttcttcatgttcaggtaagctgaaagggaagtcattttgataagtcttccttcactttctaggccagtataatagaatataatgtgagtcaataatgcaagttgcatttataatttaaaattatctagtacctacagttaaacctgtaaaaagaaacaggtaaaattatttcaaataatatatgtgattttaatgcaatataaccaaaatattatttttaaaaatgcaattgatataaaaaagtattaatttgatattttatattcttttctggtactaaatcttccaaatcttgtgcatgttttacaactcctacatatctggattttgaccaacctgtttccctcttctgtgatcaaaagataaacataattctgggaggacatacaccaaattttaaaactacttctcagttgcatagggaatggagggattcattagaaagggaagactgccctttctccgttatgcaatccaatgtctgatttttcattttttttttttacaatgcacctcttctatttactacattaaaatatatttccactttgaaaataataattaaacatgatttaaaagagaaacattctgaatgttaagaactgtgaagtattgtaaattcactgtcattttgtgaataaattttatgttctgaaagagaatagtacttaaaacatgttgctttctctgtacaatgcaaaacagaactggataatttgtttaaaggtaagtcattgttcattttccagcattaaatggtccttaagaattgggaaggaattactcaaccaaaaacagttaaagcattattttctttgtgctagaaatacaacatgaggactataccatctcattattaacctcaaacagatttgtggatttttttagcccagtgtcatgcttctcaggcattttgttcacacttctatatgattaatattgtatcatataataataatttgattgatttcccattgcactgagctcccattgcattgtgagtgcttcacattcaaagaactgtttctattcatcttgggatccctagcaggtaacccaatgcctggtccataacagaatatattgttcaaagttaacctaatttggcatatatgtccttgtggaatttgaaaataagcaatacagtttatctgtattatcccatacatgttcaaataaaaatttaaattaaattagaattacacttcacaattcacctgaaattcaccatatctcttcataacaaaaatataatacatgcacatagaaacatgtctaacgaatgctagtttagaactgtaaatacattgggtcattacaaccaaaaagtaggtaccattaatatactcattttacagtaaagaaactgagccacataggagttaaagactctgcctaagttcattcagctaataagtgaggtctcaaaccatgcttagacactggagcccatgatcctagccacaacactataatgcatttctaaagtctcacaaaaacaacttcacattctttatgatattgcgattgtttaaaagcagaagtcaagtcgatttgcgctttgctagaaatatttttatttcaaaattgaaaaaataagtatacgtttgaatttctattatatgtcaggcattatgatagattctatacgttttaccattgcatttgaccccttgtgggtgttggcattcttatcctaaacaagaaactgagactgcaaaatgttaacgaatttgcccaaggtcaaataagtagaattcatcagacatcaacgtcctttctctttcaaaaagatataatttctcaaaaaaaacctggggactagaatgctccattaggaaattccctaaaaaatcagatgacttctggaaatgccactgttccacaaatacctcattcagtagaattccctaacacctaaacttcatgcagaaaacctaatatgaaaagtccattgagtcaccagctcctagaatatcattataaatttgtcagatcatgaattttaagattatagatcatgtgtgcgttattgcagacgagtgagtccaatgttttccaaagagtggtattcaacattattttagatatgtagaaaatagtttacatagcactgaattgcattgtgtaaaaacttttccttatgattatataagaagaaagtctcagctctgtgtttctatatcttaaactactctctaatttttgtcactcccgttttcaaaggagaaacaaagaattcctaaggctctgagtctttagcaatcacgctttttctttgcattaatattttattatttcttacttatgatggagatactggagtgtcatttttggtagtaatattgaattcaattaaaatgcatttgtgtcgaaaaatgtttcaataaaatttaaaataacatagttgcatgtgaatatgacaattatgaaaacaatctaatatcaactcaagctatacaacactgtcctgacctaattgatatggtttaactgtgtccccatccaaatctcatcttgaatcgtagctctcacaattcccacgtgttgtgggagggacccagttggatgtaatttaaacatggtggagggtctttcctgtgctgttctcgtgataatgaataagtcataggagatctgatagtttttataaaggagagttttcttgcacaagttccattattctctcttgtctgcctctgtgtaagacatgtcttttgctttccaacatgattgtaaagcctccccagccacatggaactgtgagtccattaaacctctttttctttttaaattacacagtctcaggtatatctttatcagtagcatgaaaagcaactaatacagtaaactggtaccagtagagtggggcactgctgaaaagataccttaaaatgtggaagtgactttggaatgggtaacagattggaacagtttggagggctcagacaacagaaaaatgtggcaaagtctggaactccctagagacttgctgaatgggtttgaccaaaatgctgataatgatatggacaatgaaatccaagctgaggtagtctcagatggagatgaagaacttgttgggaagtgaagcaaaggtaactcttgttatgttttaacaaagacactggcagcattttgtccctgccctagagattcgtggaactttgaacttgagagagataatttagggtatctggtggaagaaatttctaagcagcaaagcattcaacaggtgacaggtgctgttaaaagcatttagctttaaaagggaaatagagcataaaagtttggaaaatttgcagcctggcaatgtgatagaaaagaaaatcctatattctgaggagaaatccaagccagctgcaaaaatctgcataagtagctagaagctgaataataatcagcaagacaatggggaaaatgtccccagggcatgtcagagaccttcaaagcagcccctcccatcacaggcctggaggcctaggagggaaaaatggttttatgggcctggcccagggtccctctgctgtgtgcagtctagggacttggtgccctgtgccccaggtgatccagcagtgactaaaaggggccaaggtagagctcaggccatggcttcagagggtgcaagccccaagccttggtagcatccacatggtgttgaccctggtggtgcacagaagtcaagatttgaggtttgggaacctctgcctagatttcagaggacctatggaaatgcctgaatgtccaggcagaagtttgctgcagaggcagggtgctcatgcagaacatctgctagggaagtgctgaagggaaatttggggtgggtgcccccaaacaaagtccccactggggtgctgcctagttatgagaaaagtgtcactgtcctccaggaccctaaataatagatccaccaatgacttgcaccatgcacctggaaaagccacagacactcagtgccagtctgtgaaagcagccaggtgggaggctggaccctgcaaagccacgggggcagagctgcccaagatgatgggagcccacctcttgcatcagcgtgacctggatatgagacatggagtcaaaggagatctttttttttggagctttaagatttggttgccctgctggattttggacttgcatgggggactttagcccttcattccttcattttgggcaatttctcccatttgaaatgggtgtatttatccaatgcctgtatccccattgtatctaggaagtaactaacttgcttttgattttacaggctcataggcagaagggacttgccttgtctcagatgagactttggactgtggacttttgatttgacactgaaatgagataagactttgggagactgttgggaaggcatgattggttttgaaatgtgaggacatgagatttgggaggggccaggggcagaatgatatggtttggctgtgtccccacccaaatctcatcttgaattgtagctccaacaattcctacatgtcatgggagggacctggtgggaggtaattgaatcttgggggcagatctttcctgtgctgttctcgtgatagtgaataagtctcaagagatctgatagttttataaaggggagtttccctgcacaagttctattattctctcatatctgctgccaggtaaaacatgcctttctccttctgccatgattgtgaggcttccccagccacgtggaactgtgaatccattaaaccttttttctttttaaattacacagtctcgggtttgtctttatcagcagtgtgaaaatgaactaatacactaatattttcattttacaaaagaaaacaagaaactcagagagttaaataaatatataccagattatactattaaagagtttaaaacctaggttttctatttttccattaattatttgagataagcactgtggcacagatgagtcatgaatatgcacactttaggcaggaaagaataaagacacagcacgagcaaaaacaataggagatttatatgtagggtacccaaaaagcatctcagagggtagattcaaacacttcccctgttatcatttaaaaagcaaaactattcgtgaagatcagtggaatatcaactaacttccatcaagataaaatctaatagctgagatgctggttaataaagtttaagccccctaagacaaaccaccttagcatcttagcattttaataagagactaataagtgataagcactcaagatcaaaggaatgcagttttaaagaaagaaagataagcagtgtgttcaggggtcatgccagtattttttataccatactttaaaactctccaagtccctgttggatacaacctaaataaggaatgccataaatgaataaacttataaaggaaaatcagagggagttttggggtaaagcagtgattccaggagtacattcaactattcccaatcacttcactaaacctgtcatggaaatgttagaaatgggtctgcttttttttttttttttttttttcagaaccaaagtataattgaatagcacagagcatctgctgaggaagtagcgtcacattttaagaagacagaagagtcacaaagaataaaaagactttaaagttttctaaacaactttctaccaaatgcatgaaatcttgtccctcctttcctgattgctcttggctgagtatctatggtggtaggagagtacaggatagcaggtttctgtgatggagatggcagcgcacagtaggagggatgtgagaattggggacagagagatacacattcaagtcctcacttctccctttttcttgctgccttgtcctactctgcagaatgttggtaataatgacaatgtcatggatcattgtgggaatgtatataagaaacactcagggaggggaagaaaatgaacaaacatctttgggtgcctacaacatgccagcatctttaattttgtcttttatttttgctgctttgtggtgccaatggcccggttcctagaaaatacaaggtgttcagttaagagttccggtccattttcccatctaacaaggcactccattatgttgtaagaatgctctgattgttagcaaaacctttattttaagccaaaatctgcctcctttcagcttctgcctaatgctgccttctggaacaactcaaaactaggccactcccttttctatgagagcccttcaaatatctgaaaacaattactatggttcccttcagtactctcctcaccaaggtcaacacacccacttctttcagctattacttttgagacatggctttctaaaaacatattgtcccaattgcctattatagacacactctagtcagtcaattctatccttacatgcaaggtctttatctgaacatcatagtccaaatgaagtctgagaagagctgttgaatctgtgctgaggagcttactaaccaattgattcttctatccctttagcagcattgaagctaggaggatacatgattgtttcatgtgtatattttagggtaaaagagagcattaagcaagagcgtgatcaaacaattcaatattaataaataataagatatatttctgcttgaaaactcactgcaacaatttgttgtgacgtttccctttctgtaagccatgaggatagcataaattctacaatgaagatgcagagggtatgaattgagcttaattatctttaaagttaaattttgttatgagctctgaagtgagtcacttcagaatttcctgagtttaacttctgccagcttttgatacatgacctcaagcaagtcaggtaacctttctgtgcctcgttgccctcatcagtaagatgaacttgtcccactgcttcacaggggtagtgagaatttctcttaaaaagaccaattgtgcataaatgctaagataactgcagcaaaagttgccttataaatcttgactagaggagtcaaaggtgtataggtgaagctatcccactcaaaggattcgaaaaatctaagctatttggaaaacactgtggagctcatttagcatttgttttcattattagcatattcctgtgcttgtggcttcctctcagcttatccaaatccacccgtccccagtatatttattgcttactcttcttctcttccaagacttgacttctttcctgttaccatattcctctttatttgcaccacatgttagttagcttgtgccctctgcttccttaggaaggatgtcagattgctgaccccatgggctttgacacttttccagcagcctatttcacatggagtaataaagcagtcactgctgctaccgcctcactgaaatagatgagagttgagaacaaaccaccacactaaggcgaagtccactgatatctaagtcctttaactgataataggaaaaattcaaatgggactttgctagagcagagttatctgcaaattttatcaccggactgctttcaaattagctcctgcaataaaaaagctcttcatcttaattctaaatgcattgtaattacaatcagcaaacaaaaggttaagccagcctcttcaggggactacatttcttggaaagacacctagattattgccccaaatggctgaagcacaactagctgtttactgagcttaacttcttgtttgttgaatctgattactgtttgaaataaatgcagtggtcatctagtctttgcaaataaaagtttactgataaatgttttattaacactttcattctctggccacccgcctacctgacacttgaatgagccctaacagtgtaccttaccttacttgggatgcaaagcacatttccaatgaggggctcttcctgaaaaagtaatagaaattcaaggaacctgccatcaggtatctttggcaacaatgctctgtccttcctttgtccctgttactgcctggacgacacatctgccaaatgtcccagactggagatctcaggatctttttatctacttcttcacccacaccctttatatgcagttagttgttaagtctttattaagtctttccttataatgattattgaatacatctctgccttcaactgccactccaaataactgattccaggctctcattaaactaattccttggagtttgaaataacgccatacccatacaagtaaattcctccaaataatactttcttcctgctactggatttgttacagcttattagtaagctgacaagtcttaaaggctccccacaatttggtcttccgttttcagccttatgtcctaacatttcacaattttgttgcatcttatctctttccccctatgctatggtaaatactttctcttttttgctttcctccacatctgtgaatagaatttttaaaaaggagaggatttcccaggtggaaatgcacctagaataccttctcctttttctctattctttttttttttataattaactcacattttgtttcttccatgaatcttcttataactgcccccctgccaaatgcatgctactcaatcatctattaattaactcacaacccttttttaaaaaaataccaggcagggtgctaggtactggggatataaagaaagataagatgtagctcttgttttaaggcgctcttgagttcaatctgggaatgtctgtggcatttaccttttttggcactatacaaccttttttttttgcacttattaatttgggctaggtactgtcaactattacagatagcactgtacttctttacaaaacatagtgccatgaatttcaaagagttggcagtcagtaaacatctgctgaatgtttaattcttttttatttttattttattttagaaacaggatctctaaaaaacttctgtcacccagggtggagtgcagtggtacaatcatagctccttacagcctcaaactcctgggctcaaatgatcctcccatcttagcctccggaataggtaggagcacaggcagatcttttgtagaaacaaggtctcactttgctgcccaggctgatctcaaactcctggcttcaagcaatcatcctccttggtctctgtttaattcttttgactataaaacctgaatagcaaaggaggtgaatttgtctctcaagttctcggtacagttttccttatacccactgtccccagcactgagtaatcttagctctgtctgctcagggtccccaaattttgtggctctactgaggcctacctttttcaatctagttccgaaatttttattttattttttttttaatgaaaacctcccttccttgtactgatttttctaaaatcctggtttctttaagtaacaaatgggtcattggtaaatagtaggcagcagcaagacaaagtccaagtgtgtgaagtttaaagtgaaagaactggtttaaaatgctcactttgcccattagctctgtggtcccgagaaagtcatttaattctctgagcctgtttcatcacttacaaaatgtgaataacaacacttattcatagggttgtaataaggagtgggagatggtgttaggcataaaaccagcacagtgccctgaacctattttaacaaatggtatttccgaggtgttagtccatgccaacatgaaacgtgagtctaaggaagcttataaatactgtttctttttattacaaagattataattccagtataacaaaattcactggaagaaaaccatttaacacagcttattatctgttcaaaaaataaaagttcactgaacatttactctgtacaatcttcataaattgacaaaaatgcacagtatatctcaccacctaacacaggcctaaacaatgtgacatacggtatagtaccagtaggtacttaggactatggagaaacaatggaagacattaattctgcttgtcttgatggtaagggtggggatgaaaatacagatcgaatttgggggagcatgttaaggttaggggaatagagatagcttatatttagaacaagttagtagagactgtatgattttccaaatagagaagggtaaaaagacattccatagaggaagaaaattacatgcaaaaccacagagaccttagtttataaagagtaactgggtatggccgggtgcggtggctcacgcctgtaatcccggcactttgagaggctgaggagggttgatcatgaggtcaggagatcgagaccatcctggctaacacggtgaaacccgtctctactaaaaatacaaaaaattagctgggtgtggtggtggatgcctgcagtcccagctacttgggaggctgaggcaggagaatggtgtgaacccgggaggcggagcttgcagtgagccgagatcatgccaccgcactccagcctcagtgacagagcgagactccatctcaaaaaaaaaaaaaaaaaaaaaaaaaaaaaaggaattggacataagggatttgttactggagggattctcaggtattcgaggcaggtcagagaaggagaaagtgaaagttgtgaaggctacatgactctgctcaagtcatgcaactcagccaataagctgcactacctatatgtctgttaggtttctatgtaagagtgtaaatatataagctaagtatcccatgtttccattatgggtagtatatcatttattattaaccaaatcatttcataggctgtaagatgaaaggtactacagattctgcaagacactataaagaggaacttcagttggaaaagtaagtaatgtaaagtaattcctgtgcatttttttcctgattatgactttttatttaaagtcataaataaaagaattcttatggctataaaatttgcttacttatttatttcacaagtatttgctgagcagccaccccatgatagacactgtgtactatgctagaattctgcagtgaactagacatgggctttgtctggtacttgttatttaggagtgttgacagaatttacaaatacttaaataattgtcatagtagaagtgctacaaagaagcagagggtgctatgaatgtatgtaatgggaggaatttagactaggtagttagtaaaatatctctgaagaaattatttatgatggagacctaaaaaaccagaacagaacttagccagcacatgaataattaggtgtatccatatgttcatgggggagaaaatctgagaacgagagaaaggtcagtagagtcagaaagagctgaataccaaaaggaagttggttataattgaaagatggccagtgagttttcatgtcattagtgacagtgggaagacaaagcttattggtagggaccaaacaattgtaggaatttaataagaattttggactttatcctaagaggatggaaagttttaagaaggaaagtaatacaattcagatatgtaatccatatttgcttgtactttctctgtgtttgtctttcatgaatgcttcccaatgcttcattgatgcctcattgagtttttgatgaatacttctcattgcttctgcgaaatgatgttgaaacaaccctcacaaactatgtagagtctttgtacttcttcagccattgactgcctcttaaaaacaaccaagtgtttgacttgcaattttacctctctgaaaatacaaatcaccaccacccaaaaactgaacctccaaaaaagctttgtaaaaacttactgtcaagtcttcagagcatggctcaataatggtatacagggtatcaaagaagaaaggaagaagcctaatagggttaggtacagccaaccagctcttgttgaggggctacaaggtgctgggcatcatgatagacacttttatttttggaaagagtagcactaaattatttaagaggatttactttaacattcaattacatattcttattttcaggtagaaatttaatgataatgattttgaagaggcctttgtttactaaaataccttaattttaccacattcattataaattttactatattatttttataataaatgagttcaaattagagatcaggagaaataattaccatatttctaaatgtgacagttttcacattttatttttacacttttgatccttaaattatactctatgtgaccaacgagagacctttaaaattgatttggtctcatgcaaaattgttcatcaagtttaaatctgtcttttttttgaaagaaaacaaagtgtttcattttaagagtcagagaaaaataaagctaatgaaaatatatgtagtatattttgaaattttgaagaaaaaaaggtattgattatattccaatgtttggtttttagaattaaaagatagctcattgccaatatacttctttaacaacatcacataaattgtgttctctctctttgaataaaggtccttgctgttcccaaataaaagaagtaaagaaataacttttacatgctcaatttccctgagcaaagtatatcaaagaatcatagagtaaaatggatttgttacttgacttctctagttatttgtttattttgtttcattttttttgtagaaacagggtctcaccatgttcctcgggctagtctcaaactcctgggctcaagcaatcctcccacctaggccttccaaagtgttgtgattgcaggtgtgagccactgtgcctggatgtatttttctcatttaaaattaagacaagcctataaattcattatatgcacattttgaagccaaatttaaataccacaatgcccagaggtataaagaaacactttgcatctgctcaccatcctaataaattaatttttaatttaaatatatttgcaacaaaggtatatttgtggaaactgctttgcaattaggggctaaaaaaactttttgcaaacagttttattgttatttattattattgaaataatagattgttttcattatttagtaggttatacttaactagaaacattatataaggttaatattatatactaatttgattcttgattcctggaaagcggttgctaatttacatttatatatgcatagatataaatggtcactatatttacaatatttgtatatactatacttatatgtatatctttatatatattagattgataaatactagtctatttatattagattgataaatactagtctattttttatttgtatcattccttctaatacttcttcaaatatttactatcagttatacatctttatcatagataccattttatttatagttttttaatatgcttaagatacagaggaaactcatagatgtacatattttgctggtttatttattgttgttttttcttgagacagggttttcctctgtcacacaggtttgagtgtagtggcacaatcatagttctctgcagcctccaactcttggactcacatgatcctcccacctcagcctcctgagtaggtgggattacaggcatgtgccgccacactggttaaattttaaaacatttgtagagacagggtctcactatgttacccaaacttttggtctcaagcaatcctcctacctcagcctcccaaagtgctgggattacaggtgtgagtcacagcatcagcctattgaaaatatttttatttaacatttaattgaaatgattaaaaagaaaatttaaaataaatgtttaaataaatgccaaataaagaatatagaccttttttatcctttgatttatcttgtggaatttctgaaagagcatcagaattttgagtcaatgtatatttttagattaaatggtacttaacctctgagaaaaaaaaatcctaagccaagtgtaaattgcatagctttttcaaatgtaatacaagttccatgattagatttagtacaaaatcaagtttcaatttaaaagccagccgtaaatacacacatacaaaattgcatatgtattatctttaacggccttagaaacagctttcagatactatcaaagctttgaaaattctatttaacccaaaatgtctgctttggcctaaatgacatgttacaatattattctctctgtgtcctttttagcattctttatctcaccctgctaagaggtcatcatgttaatgcagtatctaaatatgtaacattttaccacaaaagcaattttacatgaaattaaaacagaaagaattaaagaaaaagttccatcaccatctcttttttaatgcttgtttacccaaccaatagtttcttgaaggtacagtttccttgaatctaatgatggcgaagtctaggtatttcaatgttgatcttgtaatcctctcttgccacctgtctcaattagtgacatggaagaaaaacatagactactgtgctcaatgaatagatacttacagattacaaatgcttgatacagaattctcatttacttgttcaccttttgagtgacaaatataccacttcattatcttacaaagtttatcaggaatacaaattcaggcttgtatagtaggaactatacagtcagatcaaaatgtgtgcataactgaaatatgcatgctgtatctgaaaatgttgcacttaaatcatcttttttgggaaatatgagattgtaattcatgtggacccactttgttatgtcatagatgtttaatttaaatggtgttttcctctctaatgtttctaaaatatgacaagttttctcatcctgattctctctctccaacataatttctgccacacaagtcattctatctggtatttaataagctaaaaataaatatagatgggtgttggtagctagtatttgaacaaactattcagtaaatcattttctaactcaaaataataagtactgtataaattatctatttattttgaaatatgtactcttcaatgtagggtttttctaaatcatgctatgcagcagacagcttagcccggacacagagttaaaagtacatgaggaagatatggaaaacagacacaaacataaaaaccatcccccacactgttggatttaattctggtcatgtgcttctaattgccagaggacaatgaaaaggaagcactaaagctagaagtaggctaaacgtaaatattttagaatttcatattaactctcaatggttgttcatccttactgaaaacagggaaggaatagatcaagacatggttacttgttgcaacttgaaactcattgtcaaacatcactcctgactttattgtaacaaaactgtgctaatgaagccaaagtctttggctgcagtaagattggcagtgttttgctgtctgagttgcagctttctctgccttcctacaaatgtttgtcattggtcagaagaggaatattcatgagaaagagaatgaaatagtatagatcctttactagcagtggaaaagtaatgcaaattttatgtcttacgaagagtagttgaaaagcaacatcctcagaagaatcccatacatatcctaataaaagaggatgacaattccatagcattataaaatgttaattattaactaaagacaaaggctatatttgaatttaaaaataggacattttctctggtagagaaaaataaactatttgcatgatttctccaaagtttttttaaaaaaaaatagaaatttttagatggcattatttcttgtacattcaaaaacagccatatagctctgccaaatatatataaaagcaaattatgtttttcaaatgtgttaccttttcataataacatgcatttgttattcattatctgagagaagttatcttttttaatctttttgcttcaaaaaactatactttctgactttttcaaagtcattgccttttactatcaataatagagtattaatgttatcttaaaaggcatctttatatattactttatttttattcatttattagaaataaaagacatgtataatgattaaaatttaaggtttctagactacagcataaggagttccaatgaattacgatattgtaactattccacatccatgcatcaactgttaaataaattcatctccttataatcttaatgtatactatttctaaaataatttgcacacaactaaattcaagccacagattaaaaattattacccgttatagcaatgactgaggataggtgttaacactcactatatgatctacatttcatagtatacttctttacacataattgacacattatagttatttgcttaaagttaatatataaaacagaaaataaatttaaaatgtaaaagctggtgggtcaggcacctttttagaagcactgagttattaagtgccagcagtagcaaagaagaccaatggaatgacaaaggagagaaagctcccaagaattctaatgagggtaaaaggtctaatagttcattcccattacttactacattttgccttgttttaaagagttcacaaagtgtaagacaatagcacaaaatctgtgatttttatgcctcgctgctttctattatatgtcttaaccttgtgatggtgataaaatacataataaataagttttagggcctttttctagccagcaatgtggttccttggtagttgaatgttaaacatagtaaactggatttctcttcccaaaaagaaatgcaagaactggaggtcagaagaaagctggcatgaaaggtgtttacagagataagcatcaagattgctgtaataaaagcgtcttgaaaagaatgcatttaaaagcatttcaacaaaatgtatctaacaaagattaaggaaagtatctacaaaacattaaaattatttaaaagtgcatcttcaattcaattgcaaaggctcacttttgctgtgttcttgaaatctcaggagacgtactagacaaggcattttagtgtactaaaaggaaacaatctttttctagtttaaggggaaaagggggaaattactataaagttgcaagagtagaggtggaaatggctggattgcaatcagtcatcagaagtagtgtaggaaacagaaatgaatggttccccaaattactatttggggtaaatattgcttttttctactctgtttctgtttcagtgtgttggctttgttctatctgcgcagctctctatgatattcaaaccacaagacaaaagatggctgtgtggtgatggcatttgagtagtcaagaacctaatagagaaactgaatgctattggtgacaattccaaatcctcatgggaagggattttgattgtcttattcccacatacctggcctgtgtgtgaggtcacactgaaataacatgactcacatgtttatctagacaatagttcatatatgaaattggggtctataatttaagacaaatactaattcatttgtccattcaacaaatatttaatgaatatttactatgtcttatcactgtcttagtcataaatgttgaatatgcagatagtgaataagataaatgaggtatcagggaaaattgtcacaattcatagaaattagagtggtttcatacaaaataaaacaaatgccaaagcaaaacactacgacctcactagctagagatgaaaatacggataaaaatcctttaaaaattaaagtaatttcttaagttcctaaagacagaaatgaatccagaatgaaatttaagatgactattgatcctctaaatacatcatttgggtcactcttagaggaaggaaactgtaaaaccattataagaaatttggtgcataaatgtagatgagaactatgtctataataggtatatacaaatttattatccactcatacaatttgaaacttataggaaataatggtaaaatcactatattttctttacatggactccacttactataatgtgttaatactggacagattacatattttggagagaagctactaagagcacaaataagccataatgtggttttaggaaggaatgaaattttatattaaatggagagctttgtagcatattcaaaggtataatttgaaataatgtatcatccaatacagtagtattatgaagattttggcaaatagtctctgctttcagggcccagtaagaaaagtaactactaatactgagctcaccaaaaaaacagacaatggggcatccagagtattctggttttttgtttgtttgtttgtttgtttttgagacggagtctcgctgtgttgcacaggctggagtgcagtggtgtgatctcagctcactgcagcctccacctcctggattctccttcctcagcctcccaagtacagatgcctgcaaccacacctaattaatttttgtatttttagtcgagacgaggtttcactatgttggccaggctggtctcaaactcctcaagtgatctgcccacctcagcctctcaaattgctgggattacaggcatgagcctccacacctggttaaagagtattctgttcttgaaccactccttgatcttactctttttaatctccattgactaccttatccaattacaaaatgttaacttgtcacttggatgctgatgtctcctaaatatctccaccatcgacgttctctacctctccagtggagtattctatttcacctgaaactttttcttcatcaacactatactatagattccctgggagtaggagtcacatgtgatttatttgcaatgtatattcctagtgtctaaaacagtacacactaagtacacatttattaactctgattcaggggcttccttctaagccttatactactcccattgaaatgcccttctcttacaacccactcacctcttgagtttctgttcattttctcaggatttaattcaagcactcctttgatgaaacttttcctgaatcctttagataacctagcatgcactccacccctaccattaacataggaccacaccttctttctgattctgggttcttatttgtgtcttagtaatgataatattttatatttatatatatatatatgtatataaactcatacatacacacaccccacatacaaacacatatatatcacatataaaacataatttatcatatatgtatatagatacacaaacacatatatgtaatatgcctatatatacacacatatacgtatacagtacttatatattacatatctgtcatcctcaacatgattgttgaagccaaggacaataaatgtcattgtttacttgggattgcagatatgttttctaaggattagaaaggtgtaatacataagtactgcatatgacatgaatgggtacatgtcataatataaatgattttttataaaaaagatatgtggaacaaaaaataagttagaaaacaaaaactaagtgctattagaattatctttaaatacatatattaaaataaagatatgcacatggattagtacaaagtttagatgaacttttagagatgctagttaggaaccaaaatttacttttgtaaaagaaacagcttactttttatccaggcagaaatcttgaccctccttatcttactttttccaaatctgttcattctaataatgtatcttactttttaattcaaaatggttcccaacacagtatagaccatatatcaaaaatatctacatgctactttcatattgctaaaggttaaatatggactaaagtctattttttatcattccatgctgttaccttacaagaccataagaattattataaaatatataaaaagacatttttatatattatttaatataatgactgtcatttacaatagtcacaactatttttgttgtcagtgaaatttagttccacgtacagaaaagtaaagcaaacataagaagaaaaacaaagatctttagattgcattttaaaatttttctattattccaatctaatagactgtttaaattatttcctttccctgcttcagaattcagctttctttgttagtttgtctattctataaagtcattgagtttcttgtcatatgttctaggatagcttgcatgtgctcccttctttgaacaacagctccctcaaaaagtaagttcttttgggccgggcgcggtggctcacgcctgtaatcccagcactttgggaggccgaggagggcggattgcctgagctcaggaggttgagaccatcctggctaacacagtgaaactcctgtctccactaaagcacaaaaaattagccgggcgtggcggcatgcgcctgtaatcccagctacctgggatactgaggcaggagaattgcttgaactcgtgaggcggaggttgcaatgagccgatatcacaccactgcgctccagccagggcgacagagcaagactccatctcacaaaacaaaacaaaacaaaacaaagaaaaaacaaaaaagtaagttcttttaaggccctctaattctatgattcagatatcctttactattttttataaacaaagacatcaaaattaaacatcataattattaaaatcttttgacacataacttacagaaacagagctctatcaatcaagtagagaataaggaaataccttcagttcatttgctttactagtccaactatgagagtcgttttaaaaatggatatcataagccacacagtgttatttatgttttgaggtggttcattttctgaggttgttaccaattttagacatatttagtacattgaaaatatttaaatatcactccttttcacgacttatctaagtatagaattattaacattatcatagatctctaaataatttactatccactaactggcttactatatcagtattcaaaacatttaacctaaatgtatacgaaagtgctcctaagaagtttgtaaaggttactgaaaacaagatcaaatgtattctagggaagctattatttaaaatgtatattagtaattcttatataagcataaattcttaattgtgcaaagaccacatccccatctcactttgtcaaaggccccttcaagttcagattttcccaaacatattccagttaaagcaaaacttaagaaactgtaagcattagcactaacagccagtttaacagagtatagatcaatgaaagcaaaaaataataataataatttccaaaaggactgattgtctgagcaacttcaagtatacatatacacatttgtgttcttgcacgtattgatctatgtaaatacttgtgatttcctatgagtctactttaaataatttgtaggttttcaaaaccagatgcttttctttccttttcttttctttttttttaataacagtgttagtctccttatgtgatataaaataatctaaaagtctgaagtggcagaaaagaggcagaaatggagacgactggctagagttatcaattgttatctgattggtcctctgactctcctagttcacagcttgtcagaaaaagatttgctagatgtcatgtactacatggtgacagaatcttttctcaatcttagggcaacagcaactgctttaaactcaggagcgtcagtcattatggctttgttactcttgttcttttcctgggtgcgtttcgctatctcttatcttttgcctatagtcacagtgcctgccaggcagaagagcaccccttccaggtatcagcacacaggtctgcctgtatgcatcatgacgccactgtccattcacaaagaagagaaagaaagccacagctttacccgcaggaaggagaggtcccggttgtgctcaatgctggttatctccaggttgcccatgacaacctcacagttttcatagtacttgcgcaaggctcggtactgctgttccaggtcagagagagagctcagtttattctccgttcctgcacacactgcaaagacaagaagatacacgtgaaattacataacctttatatgatatgcgcaatgataatatctttctcaaaactctctattccacaagcctatcccagttctctgaatataaatatttcgatcgtcattaagaggcatagacccacgcactgatgaacattttcacttttatattcccaaattacatgtgctaatcacagagagtaggaaggcatagattccacagaaatatatagcaaggagataaacttaatcccatttgttatgaccatataaagcaagtaaatacatttacttttatttaaacatttttttttttaggacatatgatttactctgttttctaattgggtaattctacaaatgtaaataaatcaaaatcaaaagatagtgaaagcaacaattttattttaaaatcatagttattatatcagctgttccagctgagtaaattttttactaaataaactagcacctacaagacctcaaacatgcgtttttatttttattttttaacttttattttaagttcaggggtacatacgcaggcttgtttacataggtaaacctgtggcatgggggttattcatacagattatttcatcacccagctattaagcctagaacccattagttatttttcctgatcctctccctcctcccaacttccattctccaataggccccagggtatgtttttctcctctatgtgtccatgtgttctcatcatttagctcccacttataaataagaactgcagtatttggttttctgttcctgctttagtttgctaaggataatagcttctagctccatccatgtctctccaaaggacatgatttcattcttctttatggctgcatagtattccatggtatatatgtaccagattttctttatccagtctattattgatgggcatttagggtgattccatgtcttttctattgggaatagtgctgcagtgagcataaacgtgcatgtgtcattgtaataaaatgatttatattcctttaggtatatacccagtaatgggattgctaggttgaatggtatttctgtctttaggtctaaactgaaatatttgtaaacatatactacaaaccagatatgtaaaaaatacaacttttattgttatcaactagagtatcactgtatatattcatgagtttctgaggtataatggactgataataaataatctgtctgccaagttctattcctatgtgagcacacaagtttacacaagtttttgttttgttttttaattttgtggctgggcatggtggctcacacctgttatcgcagcactttgggaggccgacgcagttggattacctgaggtcaggagttcccaacctagccaacatggagaaaccctgtctctaccaaaaatacaaaaattagctgggcgtggtagctcatgcctgtaatcccagctactcgggagcctgaggcaggagaataacttgaatctgggaggaggaggttgcagtgagccaagatcatgccactgcactcctagcctgagcaacagagtgagactctgtctcaaaaaaaaaaaaaaaaaaaaaaaaattgtgtgtgacttccagaagccagatttttagatactattcttatggtttatatacctgccagaacacaatcttcaccacttaatgtactgactctaatcctaagtagattaaaaatagatattataaatctattaataatggtatgtaaagaaaatggtttggtaagttacataagatatactgaatttaaggcaagatacaaagtggagactgcaaacatactaggaacacagcttagtaataaggtaatatatacattcatgtcttatatacacagaagtaaaaaagatgctatgatgcctgatgttgttttcaaagggatgagttcctgcagaggaaggaaaacacatctagatgggtatagcctaataattaggaccaccttaaagcctgtttttgcctatgaacacatcgaaaataacaaaaatcttaatccaaaaatcttgaaaaatagtgtatgtttgtaaccatagtggaaattcattataaaaacaaaatccaaacttttaaagtctggatttctaaagttcaccaaaaagtatattttctagaagtactctgttaccagctaaattgtgtgtcctaaaagacaagttgaagtcctaattcccattacttagaatgtgaccttacttggaaatagggtcttcctagatgtaaatcaaattaagatgaggtaggtcatttgggtgttccctaattcaatataatgataataagacaaacttgttcaacctgaagctatcaggccacatgtagcccaggatgacattgaatgtggcccaacacaaattcataaactttcttaaaacattatattttttgctgggtgcagcggctcatgcctgtaatcccagcactttgggaggccaaggtgggcggatcacgaggtcaggagatcgagaccatcctggtcaacacagtgaaaccccgtctcaactaaaaatacaaacaattagccgggcctggtggcgggtgcctgtagtcccagctactcgggaggctgaggcaggagaatggcatgaacccgggaggtggagcttgccgtgagccgagattgcgccactgcactccagcctgggcaacagagcgagactccatctcataaataaataaatatttaaaaaaacacattatgttttttgaatcagctattgttagtgtattttacgtgcaacccaagacaattcttttttcgatgtggaccagggaagccaaagattggacggccctgatataagaagaggaaaataccacgtgcacacaaagacaatcaggaaagaaagccccgtgaccagaaaggcaaagggtagagctatgtacctacaagccaaggaatgccaaagattgatggccaccaccagaagctagagagtggcaaggaagaattctacctggagtttcagagggagaatgagcctgctgtcaccttgattttcaacttctaacctccaggacagtgagagaataaatcgctattgttttaagccacccactctgtggtatgttgttactatttgtctctaaattccgcattaaataaatgttaaaaatcactttctctctctccagggtcctatcagcttataacctccatgctacacttccattgcttcctccaagccctttatacaccatgctggaattcatttattgcctttgagaatgcagattttgtagagtgatacggatggatgctatggtaaatacctctaaaatctttaatatccattttccaattccttcattgtaatagactgcacaatttttagctggacacatggtcacccaaaataaagattatatttctctcctccccttagaggtaagtttggccagtggactaagttctgacatgttgcatgacaccttcccagaacttggtttcaaacacggttgaagcctgactttgcctggtttattcttcataagttcttccagcctgatgccagaaatgcagatgtcatggctaaaatatgagccatcatcttggaccgtaagaatgagtgacacaccttagagatggctgagaactgagctaaaaggaagtaggattttcaagcaatagatattttacattgtcatattatcaataccatcaagataatgatgaatattggccccacctgctaaaatgttacacacagaaaggattaaattctagttgtgttatatgcttttgactttgagtaaatttaactattgtgcttggtttgactgaatttgctaaatatataatgaaattacagtatcattcctaaccataacgacattttattggctctgtggaatgttctcttattattaaaacaaacacccaggaagaaatgatattcaacataaggagaagaagaagaaaaagttgattcatgtgcatattccttataaatcaagatcgaagtccaagatatttttcattatatattaaaggcccttttggaaaaaaccttaatccatgatctttattttattgctcccagtaaatttatataaaatctttataaactaataaaatgactgttgagaaaaggtattattatatgggtttatgaaatatagattttaattatctcaaattccaatgaggatgaacatattttagtacaaccaattatggggataatataagcatccattaataaatttgctgcaccatttctaaagtatatccaataacacattgcaacctatatataatttatgttgtatagtttctctcaattggaaataatactcatactttaatattaatataaaaaatcaataggtaataatctaaatgaaaatgttctcaaaatagttggtgtattctgaccttttatatagaagcttaaacaacctttgagagatgcatctattactgtaactgcaatatctaggtatttttgcataattcccattctacatatataaaaaggtatacaatattatatccaatataatataatattatacaataatattcaaatctggatagttatatattcataagttctcattaatattcatttaaatatttgtatggtataaatacttaggattttgtttaaacttcttataatgaacatatgctaccctacattgcaataattcatttacttgatatcagaacatttataactcgtactcagaaaatggccctcaactaaaaaaaattgctattcctcaataaatgatcaggtaagttttgtatataccttcttaaaatggaaaatttgaataagtatgtttagaaatattttttgacaaaaaaagatcctccaaaaaacaaaattagattaatcacaatactctatttgccaaacattctagtctttgcagttttttttactacatgctgttcaatttagtagatatttttgtctcattgaggctttcatttatgtttgattcaaactatctagaatccacagtatattcatcataaattttatcttgaaagacacacttgatttttgaagaactggtttggataggctcatagaaatcatttgtagttgtttttgtggagcctccactgagtaactcacaactttcatttgtcaattgattttacaatcaagcaatgtatacaagacaacgcttaaaccatcaagtttcattgatttcacaaagctgtttatcaaaacacaattgaaaaattgtcttcagcagccaaaacaagtttaacaaaattcagccacctttgtcaatactattataaagtccttaaactataagcctacaatagttcaagcatcaaaaatccaaaatttacatgtgatccctaaagttttcattccaaatgtaactccaggagtaaagctggatgtgaggtcctaataaaatcctcaattattctatttgtattgattctgttacaaatgtagctatacttccaaacacaggctttttatttttcttaagatttatatccaacagcgtgtgaaccatataatcctcattcagtaaaaaagtaaaaagttggtagcaacataaaaaggttggttaacagtggattaatttgattcatggggaaatatattaaaagtaaaataatgaaaccttaacaatatctatattaaaactaaaaattaattatcgcctccaagcttgttctggctatgaaatcagcactctatttgcttacaaagaaaagatgatgggaattaaaaaaagagaattacctaactctcagatcaaatgcctattgcgagatatcagtttatcaattaagaaatgaataattatttatttggcatctactcgtctccaaatgtcatgaaaaaataattactgagaaaaatttccaagttgtttcataggggcttgtatagttttacaaggcacgtagcaaggaaagcagtgagcagtatatttaagtcatgtatatattgtgtgtgcataattcaaaggctggctacataaaatatggaacttgataaaaaattcttttgctgatttaacaccaataagtactttccttttcagaaatgttaataaatgcaccttggatttatgcatattgttgggcattaaaaaatctagcattgcagtaaacatcaaaatacaaaatattgaagaccacagaagaagcaataactatttccagtgactattaatgaatgctattatagttatgcagagatggcaagttttgttatctctatgttcaaaatacatccccaaatgggtccaaacttgtcacttccactgctatagtcatttaatccaaaacactgctatcccttccctggacttacacagcggcctcctaactaatgtccaggatttcctatttgccccattaattaattcgcaacccagagaacagaataatatttttaaaaatataaatcattcatgtcactaaaaacaccctttggcatctcattaaacttactgcaaaatccaaactctttagcttgtaagaatctgtagtcatcttttctcaaatgtcattctttcagaaaagccttctctgaccaccttatttaaataagtaccgggtttccaaacattgtgctctaccaggagacacaacagttattccattgaattggaagtgactgccgtgcagccactttgggctcctcattcctttgaatcaacaggcaaagaaaggaattgctaagctggctgggataattgatcctgaccactaaggatagtagcagattctatcaatattactactccacaatggaggtaataaggaagagtatgtctctaatacaggacattcctgtgggcgtctcttagtattaccatgcccagtgatgaaattcaatggaaaactacaaccacccaatcaaagcaggactagtacggtccagtgcattttgcaatgaatgtttgtgtcacctcaacaggtaaagaaccataaccaactgaggtgcttgctgaaggcaaagggagtatgaaatgggtagtagagaaaggtagttataaataccagctatgatcatgtgaccattgacagaaatgggtactgtaattgccataagtatttattccttattatgttatgaatacattttgtgtgtgggtgtgtctgtttcttttcctctcttatttccttatcatgaaacataagatgtattactttatgtcataatatttaagtattcttaattttacacaatagtatttaagttataggatatcaaggagaaaagcaaacatcaaaaaagacttcactttttcttctggggacaaagtgcatttttggttataggcataatagttgtaccatgttagatgaaatcatttaccttttattgtctttaattggagattaagtacagattaaggagatgcatatgggtgctatgctgacaagggatgggcctgtgatggttaattttatatgtcacttgattgggccacagcatgcccagaatgctggctaaacattatttctgagtgtatccataagggcgttttcacaaaagactaccattgaattggtatactgagtagagcacatggctctccccagtgtgggtgagtattatccaatctgttgcagtgcaggcacggatagaataaaaaggcagaggaaaatggaattttctctctgcctgactgcttgaactgtgacatagatctccagcccttggcactttaggttcttaagtcttcatatccaaactggaatctataccattgccactctaactctcaggcctttaaactacaccactagcttttttgggtctctagcttgcagatggcagattgtgagacttctcagcctccataattgtgtgagccaagactatatagtacattttaaataaatctctatgtgtgtgtgcgcgctatatatagcatatatgtgtgtgtgtatatatacttgtatatatatgctatctgtgcattccatggcccagacaaattgacatagaaaattaactatcataagcccatcccttgttaacgtggcacacatacacaacttcttaatctgtacttaatctccaaataaagaaaataacaggtcatacttccacctaacatgatacaactattgtatctacaacccaaaatgcactaactccttccttgggagagaaggtaaagtcctttcttcatgtttgctctttttgatatcctgtaacttaaaattttttggttctgtttctctggggaaccctgagaaacacatttatgtttattcattctccacacagaggccagaatgtttttttcaaaaatgtaaattgttcatgtcactcccctactgagaacaacccttggcttctaattgcactgactataaaatccaaagttcttatagcctataagaacttgtatttaagtatttgctcaaatgtcaccttttcaaaacagccttttctgaccaccttatctaaaatagacatcaggttcccatacattgtgttctgctttcttttcattttggtgttttttttttgttttgttttgtttttgtttttttttttgctatgtgaatttacattatacatctgcaagtttacctttttatgatatgtctccacattagaatgcaagcctcataagagaggcctttgctcagcacctcggaaagcaggcatatagcagatgttcagtaaacatcagtaaacaggcatagctgttcagtaaacatttgttaaataaatatatggacttcagagtcactgagaactagaatgaaaaaaaaaaaaggtaaagaatatacataaaggaaggccaggtgtggtggctcacgcctgaaatcccaacatttttggagactgaggccagaggattgcttcaggtcaggataccagcctaggtaacaaagtgggaccctttccctacaaaacctttttaaaaattaagaaaataaaaataaaagagaactagaatggagccagaatcaaacactggttcctccatttttaaaagctgaatgaacttgagcaaatcacttcatcactttgagtcttggtttccctgtctacaaagtaaggttttatgctgagtgttcttcataaatccagcttaactgttatgagcacaacatttctaggataatttttttcaattgatgggtaatagtcattcctatcttttttctaaccctcatggaaatgcttcccttaactcagcatacatttcatcatgttatatattctagaattctactttaaaactagggtttttatttcagacttgaatattgcaatttatcatatgcttttgcagttttgagaagtttttttttaatcttattagggtaaattattgataaattgcaattattaaaccatccttacattcttgaatgaatcatatacaatgatcatacattactctattagtataattctggattttattgctcttattcatttgtactggtatcttttaatataaaaaatttgtatcaatgttttaaaatatctttatcagatgtgattagggccaaaagagtttaaaaattgaaatgaatttatatttcagaaatttcatattctacataattaaatgtattaaagaaaaaactattagcaaaataggaaatgtgtttcataattttcattacataaaactagacataaaatatttttcagtgtaaaaattggtatccttttaaaaaaaatcctattatgtattatctgaatctttatcttctaccactgttttattgattcccaaagtgataaaacgtagactgctgaaattaactaaacactttctttttttttttttttttttttttttgagatggagtctggctctgtcgcccagactggagtgcagaggtgcaatctcggctcactgcaagctctgcctcccgggttcatgccattctcctgcctcagcctccccaggagctgggactacaggcgcccgccaccatgcctggctaattttttttgtatttttagtagggatgggggtttcaccgtgtcagctaggatggtctcgatctcctgacctcgtgatccgcctgcctcggcctcccaaagtgctgggattataggcgtgagccaccgcgcctggcctactaaacactttctaaacaatccttgagcctaatgaaaagaacttttggcattgtagacctttactaatagatttgtacctatggaagacataggtattcaataccacagacagatgaaagataaatcaatatattatatatactcctatctgctgatctatctaaaattgaattgatctgtactttacctcttttgttgattacaatagtctttgagagctctcaaaattcttaagtgcagctactatatagtgtgagggaaaataacctcataactgaaaactaaaaaaactgatgtacctcaaaattatacatgattgtcttctatgagtaatatggtttttgagtagtctaccttgatatagtcttcccaatataaacatttatctttgtaaatttttgtactttgtatttcaaagatgagcttggtaaaattaaaaaattgcaaatgatttttaatgtatcatatcaaataacaactaacttataactgcatatatatatattctgtctttattgtttccctgtcttcaaatattttttcttaatttttatttcataacatttctatgttgaaaataggaaaaacagaaaggctttacagatttagaaattacatttctgtcatctatacatacttggatgaaataataagatcacagaaatacaattgtcagaaatgtaatattccctttaccacattttgtcactattctctgcctgccctctttatccctccctcatacaaagtccttcttatttactttgtagtatttcatttcctgtgaaagtgctaggtccttaactttaatgtaggcactggacttgacaagcaattaaaacaaacaatttccactcatcaaggcttgccaaattagtcatctgccatctgccccatcatctggctctccttgaggtcttgctgtgaatctggatgcactttcacagattaagagggacagtgcaaacctccaagctggtaaaatgccagtgggagctaagtatgtaaacattagcaaacatctttcttctctagattatcatgccttcaaccatcccctcgtgtctaataaaaaccagcctgattgtgatgccttatcactgtgagacctttgccattcactgtaattaaagcggcagtgtgtgggatatttttcctgttaggagaatttacaagaaggaattagactagatgttcctaatatgatactatactcacatatcaaggtggatttcttaagcattgataaagatgtgcacattaagaaatggactatggcctttctcttgcattggtttcagagtgagacttcctttttcattcctttcatcagctaatgtttacttgactaataatatgcaataggcactatctagggtaaatgttcaatcagcttacactagaaacgggaaaaaatgagaaatagcaagagtgaaacattgtactattgtcaccccatgcttgtttataaggtctctcttccttcaaagcattctccaacccagggctactcttgggcaataggtaccttcatgcaaatgcactagggtggcactcttttaagtgaaacaaactccatgaggggcacatgacctggacatcacaatatacactgcattttatccccatctgttccctagtacatgagtatgcttgcagtggtgagcttgcataattgtaaacagaagctctggttcactccactgttccaagttatctgtccaaacttgctcattcagggtaaagttgtgtctaatttaacgacccttttaaaattaaaagaaaagtctgtgaatgttagacttggggtgagaagaaggggtgtggcaaacaacatttttgactgacagtctttactgttatcttcagatgatttacatataaagcctaatccaagatcaccttctaacaagttttcggggatgttttaaaacccaattcatagtcacattattctcttggataaaaaacaaaaagcacccacctgatactaatatagactagattataaaatatattattataatttattttaaattgttttcctgtgcccaaactctattattctagaaactagattctataatctccagtgggttggtctctctaaaacatttagatgagtagtgggttgttatttttacaagataatcatacttacaagtacagtcacaatcaactttcctttttttaacttttattttaagttccagggcacacatgcaggttttttacattggtaaacttgtgtcatgggggtttgttgtacagattatttcatcatccaggtattaagcttagtacacattagttattttttctgatcctctctctcctcccactctcacccaccaataggccccagtgtgtactgttcccctctgtgtgtccatgtgttctcatcattttgctcccacttataagtgagaacatgcagtacttggtttgctgttcctgtgttagtatgctagggataacggtctccagcttcatccatgtctctgccaaggacataatcttgttcttttttgtagctgcatagtattccatggtgtatatgtacattttctttatgcagtctattattaatgggcatttaggttgattccatgtatttgctattgtgaacaatactgcagtgaacatacacgtgcatgtgtctttataacagaatgatttatattcctctgggcatatacccagtaatgcgattgctggattaaatggtatttctgttttaggtctttaaggaatcaacacactgtcttccaaaatggttaaacaaatttatactcccaccaacagtgtataagcactcctcctgctgagcaccaaaagaaactatcaacagagtaaacaacacactttcaagtactaactgtaattgggtgtttgataaggagacagccaccactagagaaatatctgtcattcgtttattcgttctgtcacgtatttattcaataaatggttactggaaaacaatacatggtgctctgggttatctgtaaaaggaataataaatacaatctatgtcacagatttataacattttacattctaagataaatcctctgtagaatttttagaaataataatagtatacaaatttagttaagctgctaataaatatgaataattttatctgactttgattcactgctactgaataagacccacaatcaaagtcaaagttcattttacccacaataacatataaaacagagcccttctcgcctaccacacatacgaaatatacatcgttttgtataaaagttagacatcacttgtgagaagaaatttcctgggcataacagtagtcaatgatgttaccgatctactcagcagcatctacaatggaagaaatatcataccttatgctgtggtgtggatgtttgccccctccaaaacagattgaaacttaatccccaatggagcagtatcaagagtctgttaaaaattcagcctggcattctgtagccttcttgccatgtgataccctctgctgcctcaggacccttcagacagtctctaccaagcagaccctcaccagatgcagctccccattcttgaactttctagcctccagaattataaaaaaacacaattcttttctttataaattacccagtctcaggcattcagttatagcaacagaaaaaggagtaggataccttaacaaatgttttattcagttagccaggttagtgtatatcttttagtatatatttaactaggtcctcattcacttgtctaaaaggataaggaaaaattgctctgacacagaccggatacacacattattgaaaactattccatttcaggctgattttcaattaagtccccattctaaattacttaataacgatatgattgaacatgtcatgggtattgtttttagtcttttttcattttatttaattcagaaatttgatattatagttaatagctaatattactaccaagttccctactcacttcacactcctatgggtaagtaaatgggacttcagagatcacatggatagttacttaatttggagtgttttcccataaagtttcactaatctttggacttaaaaatctgatatcctattcgtgggctttattataatagagtagcatgttataatacaaaatctatgataagatattgaaagtaaaagtccaaccttttaatggaattcacatcattcactatgacacacaaagaagagccaaggtgacatttagcaaattttgtaagtattagagatgaactcagaaatgtcttctacatttaagagcaatatttaaaacaacacacacacacacgcacatgtgcacatacacatacatagggatacaatatttgctagtatacaatatttgcatttttatgctacagtgttaacacaaaaatgcattacaaagttccttaatttattttatcttagacaatttggcaataaaggtatcaaaaatataccactgagtgctaaaaatatctcatatcacactaacaataatagaagttctatagcatcaggttcaattttttaaaaagtagagaataattgatgatttttttccttatataagatatgactagtaacaagaaaaaatttttcaattgtacgttttaaattaatacttgcatagttatttttaaattaatgtgaatttctgagagtctaaattatatattttgtagctgataagcttcatatgtgcaaaacatattttctagcaggtaaatacaatttcaaactaaatcacttactgtttacatagagatacagatggaaaagaaaacacacactaacttctatttttaatcctgccacagcacgaatctgatcaatttttaaaatttgaagcacaccttttccgaacatgactcattttcagttcctgacacaaaaataatatgcactttatgataaattatataaataagtatcttttttattatagaattcaagtttctactgatattatttgccaggataaaatataatcaattagttgttacattctttgtaaatgttcatttcttttcagatgcatttaccacctgattataacttgtaaagaagacttaatgcaagtcaaataatgactatagaatctggttataaaatgtattaactgtttgagaaacaagatccatgcagttgcatcattttttattgttctggtctcaaaaactaaaataaaataaaataataacccttaaaacagtcaattctttgcaaagatactttttaagaatatatgggtttatgtaaatgcatatatacataaaaatattagctgggaagaaaaaacaataatatgttgcaaatggttttctctgatcaatagatttctgggtatgagacatataatatatatagtaatatctatatgtttatgtatctatagtaatatctatatatatttatatatatgttatatatatatacatatcatatatatttgtcctgtcatttctaaatttatactagttttaagtattgtaaatgtaaaaagtatatttcatttttaaaaatgttttttttttaattttaggaaagggtaaacagacaaacattctataatatgccatttctttatagaaatgtgtatgctaaccaaattactatcaatacttttgataattttgtaattttaatagaacattattttagataaaaatgtgaatttatttttgatgtaaacagttaagaaactttattttaaaatatctaaaataaaagtaaaaaagaatatattccttaaaaagttgagtgtaaactgatctactcatctataaagttgctctataaagttcaaaaacaaaccaatttcccacctgaatagactaggaaacatgagtgtgtgtgtgtgtgtgtgtgtgtgtgtgtgtgtgtgtgtgtagaggggagtatttaagttaataccataatttctgtgtatgctctaggttcttttctagttcatgcaatttgatatacaaaattgtataatattgtttctattttactaattatttatctcttctgatctcatattttaaattatattactaatgtctatatataactattatataactaacgtctataactacttgttttgaattatttaggttcaatagtagtatatttccgtcaagtaaaaatgccataaacaagatgaaatacttatatgctgaagacacattaccttttataaatttagaactacagcgttgtactcttaattgttatgcattatattagaagtccatgacagatgctatgggtgatagtcattaggtatttacaacacataaaaagaattttatagtacaatctcaatgagtaccaaccattttattaatgaagaaacttggctccctggttccctccatttgtgacccattcccttctcaatttttattccatactgtgtaaagaaaataggtgcaagtttctaaaaataacacttcttagaaatacaaataggcttcagtcaagtgagtgcatgtagaaagactgctccaacagtactatttttaagatagatttttttcttttttaaaaatagaaaaacatttctaaaagtttatccactccttccctccaatttccttcagcctccaatctcattttaataaatggcacccctttcactaactcaggcaaaaatctagtcagtcaactattctctctttccataacccagttataaaagccacaaaaccatatgcaaatccatcagctctttcttcagaatatctatcagctccaccttgctatctctatttcaagccacgaaagtccctatttgaatattgccatgtctttccatctgatgtccctgcttttcttcttgtcttcctcaagtatattttatatcagatataaaacaattttacatcttttaacctataaatcagatcactaatcttctttgctcaaatatctccaatggtttctcatatcaatcagaataaaattaaaagtccttatctagacctactacaaggcacttagaccatctatctgctacttttctgatatcatctcctaggatgtttcacttactcagatctggccacaggggccaccttacttgtctttgaacactgctataaaagtttcaaaatgctgattatcaatttatggatttatcttgtgtaccagtaacagactagcattgacctgtgtatgacactttgagtagcatcatttcaaaacattatattttttatcacttatcaccagctgccatattatatcttcatttaccatgtaagccctatgagggcaggaactctgttttgttcattactatatttatagcatttggaagtacttgacccatagtaggtactcaataaatatttaatgaatgaatggatggatggatggatggatggacgcataaatgaatgactgttgatattttggaattctggctagaattcctcattcattataacccaaatgttatttctgatgctcagaatgttaggaccagaaagatctttagagatcattaagtccagattatgcatatagatgagaaaacagcattcaagataagttaaagaactcagaaaaggtcaaacagttaaataaaggacacattatatatatatatataatattaaaatatatatataatatatataaatattatcctcaattatatagttatataactctaatatagaaatacagagaacatgaattctcaaacgttagagacagaaatggaatgagactcttcatttaggctatgttcacatggcacagtgcctcatgtgctgctgagagctttcatgaaactgtccacctttatggaaaggactcccaaacaaaatgttacgctgccagaagaaaaactgtattgtaaaacttggcagggtgcttaagaacatttggctaaacagcactagttgcctatgtaattggaaaatagatgtttaggaacatcttttttttttttcaagtcctggctgaagcaagttaaatgtgacttgttaaaaggaaactttttgaagagtcattttaacaaaagcatgtgtcatatgtatacagaagctaaccaatatcacatgataaacataatcctcaaaaattttcaaatcaaattacatatttcaagtcatattttagtgtactattgaaactttaaaaatatctcattgtgattattttgcaaacaatctttttgtaatggaaaaatcacctcataatttaactgttttgtcaattcagatttcaaagatcatgcttgcttaaatatattcacacctggagttgcacctaacaattgtatgccaatttactgtcagtgtattataatattaaattattgttatagctattattatggttaataataaagtgttgaataatttacaaagcagttttttcctgttaacttctttgatcctaaattacctaagagatggttataagagccaaaattattagaataattgccaggaattcaaattttgggtatcctgggaaaaaaaggaacttctgagaaatgttctaaaattcttcatgaattagcaacgaggtgatagaaattcccagaaatactagatagccttaccttggtatggctgtgactcacatagaaggaatactagaaatgggttaaataaaaacagattgattaagtttctatcccacagaaaaagtgggagtgaataatatcttcaatggactctactacaagcctcttccttttcgcactttgttccaatggaagttaattagatcggctggacatggtggctcatgcctgtaatcccagcactttgagaggccgaggcgggcggatcacaaggtcaggagttcgagactagcttggccaatatggtgaaagcccatctctactgaaaaaaatacaaaaattaaccatgtgtggtgacgcatgcctgtagtcccagctgcttgggaggctgaggcaggagaatcgcttgaacccaggtggcagagtttgcagtgagccaagatcacaccactgcattccggcctgggcgacagagtgagacttcatctcaaaaaaaaaaaaagaagaaacttaattagatctatgaaagtaaactagaaatagatcaggaatagaaaatggatttggctaccattgaaactgtggctgatttagtaagattgcacacagaattctgttggatgcatgctaactttttttcagtattgtgattttactttgaacgtgaattctcaaatgatatgtatactcacattaatacacgtatgaccctctttggcaattgtgttaaatattactaattcttcattaaccattgaatgaaattctagtcacctaactggtatttaagattttccataaatttagagatccgctacaatatcccttcacacttgatccaaagttattttttctggaaaatgttttaaaaataatcaaaacatagtttaaatatcatccaccattcaacttacccacaacttttcctatatttttaattcattcctttgaccttaccaagaatactttgaaagtatttgacaaaattaatatccaccattatcctcaactattgcctaaaggatttcattctttcagaaaagttctgaatcagttactcaatttacatttccctaaaatttatatgcaaggatttattatgtttctatttgcaaagttgttttattcttatgttccagtatatggatcttaattctccattagatgataaaccagctcatggagacctcaaattttgtttttatcatttctggctgggcaggccagatgtagttcttctatcgcataaaaagtattacagagatttgtacatgtaagcctagattagcttactgtaacccagctgagtagacagtataataaaattaagaggcaaaatttttaaaagatgttagactgaatatatcttaaaaccagaattttaaaaatataatttctaatcttagtatttgcctctgcgtgtttaacagttgatatctcacattcgtaaaccactttgggggaactaaaaaaagctttatgtgtaattgaatgtttactttgcagccttctacagaattaaggaatctgtgttttataagcttatgtcaaaacatttggagtatttctaactaaaatgtgagtacatacataaatgtttccattgcctttacatattaagtttaaaaattgtagttaaaacaaaaaaaatccatttgaaaatcaaatactagagaaagtttttaaagacagttttcgcaagccacagcactctgactcataaggcttggatagtatttttacttcccagacatagctagactagtggttgcataaatactattcattcacactatcagagcctccttttacctcatgattataccatcatattccccaatgactagtattttggtaccaattgttataaatttcagggttgtctagtataaaattagccctcttccagtatcaaaatatttcacatgccatcttagaataattaacttaccccagaaaagctaaagagaaagggagaaggcagttgttttaaatgaccttaagacttttctacatattgctattcagacttccagtgataaaacaagaaattgctataggcctttagacttaagagtcacccagtccactcactcttcatcttgctaagcaatgcaggtcacacctgagattcaacagctaagtgtacagccttggctgtgcccactcaacacggagtgaagcagccagcatgcagtaaaaaaaaaaaaaaaaaaaaaaaagccactggagttcattctgttgtactttctcatccttatcgtcttatttttttctctttgtcaatctgtttgagaactctttggtgtctattatctctcactttcctacccatccttcaaagcggctccccttctcatcaccactgtggaaaactctttcatttcatcctacccttgctcggacccagtgaacttacacccaatctatacttcctgtccccctaagggcccaaaggggatagtctacttatgcttcctggtgtgtctccactaaagagcctggttactcctccctttctcataaaagaggtctgacaaaagcctgcaatttcatttagttccatattatcctggcatcttgacattattgtttgactttgctgtggccagtatctccagctttcagcccaataatttagctgaggtaatgaattaaatatttagtgtttcagttatatgtttagattgggctcctcaataatgttaatgcccactatttctcttatcctgaatggtgacagactgcaaactgccttgctgggacttctattttctgttttattctgttctctgccttttgccgatgtcaccctgttttcagcctcaacattaaataaatagccaaatacacaagtgccaagaattgttgacaatataactctagaagcatatggtgctaagctagtagaaaaacaattcttagctcagtaagtattcttcatttgaaattgtgcactatttcttctccttctacttgaaaagtcagcaaacttgaggaccaagtgtcgcctggggatctaacttgcataaaacattgtgttggctctgaagcactgagattccatagcaaggccagcaatacataaactcctctggtactcctacattatttatccctgaacagctagggggctttttgcaaagacgtccctaactacggcaagcattcactctatttaatgtttatttaattaacagtgcacaaacaccaattctgtgagtgcagtggagtctgtgcacatctttagatttattttctcaattgatttggaaaggcagtagcagaatggtgccagacatttcttcccacccagttatcccttaacacccaagaatctctctatctaaaaaggcattggttaaaatagggtaaaactgatatggggacaagacagaagaaaggaatatctgggggaaaaagttggcagagagaagctctgttgtcattgttagacttttttttttttttttttttttgagacagggtctcactctgttgcccaggctgtcttgcagtggcaggatcttggttcactgcagcctccatctccggggttcaagtgatcctcccacctcagcctcctgagtagtggggtctacaggggcatgccaccatgcccagctaatttttttttttttttttttttttttttttgtagagatggggttttgccatttttcccaggctggtctcgaactcctgtgctcaagccatccacctgcctagcctccctaagtgtttggactacaggcgtgagtcatggtgccctgtctttacactttcaaaagaagaattacaatattattgtgaaataattgaatttcttcattatataaaatgtgaagatttaatccagcatcatttaagagttagataggatgatctgtaaggtcactgttattctaaaattctatgttcagaattacctagactagattgcctctaagtagcactcagaatgagacatcaactgtggatttttatatcctaaagcacacaggataaaactcagagatataaaatgaagcactcacaaactactatctaccacagtacataactctaaaaatctctgtaaacatatgagaaaggaaagaagcatcttctcagcagaattgaataaattgaggatgtatgtattgaaaatctactttagggtataagacttctcagaaataaaatcaaatccaataaaatcaaattttgttagtttgagaaacattgtaaagttttgttttgctgtcattatctgaagcctaccattaaccctccgtgaagaaactggctttctaaactgaggtaacataaagtttcttcatatttgcaattgtggggagttggaatccttatttttctcaagcctgtggtcccttttctgtgatttatccttctttctccatctttccatttctaagattggcctaataatcactgtaatatcagatgactaagttgtggatgcacactttttattgaattaccttttgtgcagactttgtgttaaattttgcatttattaatgaacaatatgttattagtaaacttatttaaaggttctattttattattccattcatcaccagggggcagcacaattcccaaagagtattttcttttttttttttattcagagtgaaaaagtacaatggcataattggtaccgatttctattgcagctagaggcatacacaggattattctacttttttatgcaatgaatatagactaaaaactagctggattcagaaaattgtatctacaaagaggaatatacttattagcagatacctcgcataattcaaaaaagaaggaaaaagtatcattaagtttgtgtgtttgtgtattatctctgaggtacaagaaaaataaaattattgttttctgaattcctttatggcacagaaaaacatataggatggcattatttccctttactatcttgggaaagaaacataagtaatacaaagccctaggtactttcaaagagctgaggatgaaagagatgggagaaatgtggagagatggagataaagggatatttcaaagatgagaaagacatggttggtttcctgaaagacttaatacatcaaagataccacagtttaagaatagtaaataaacaattatattttattttaaaataaaggactataaatcacgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaacatcacactctggggactgttgtggggtggggggaggggggagggatagcattgggagatatacctaatgctagatgacgagttagtgggtgcagcacaccagcatggcacatgtatacatatgtaactaacctgcacaatgtgcacatgtaccctaaaacttaaaatataataattaaaaaaaaattttaaaaaatttgattttctaaattcacatacatgagatttggaaaagtaatttatgatgaatttatctttcatgacattcctgtttataagcctccaattgctgcctggagtatcacctttaaaagttcacatacagtgacacagaactttcaaactatagtgctcgtcacatgtactcttttttaaaaaatgtgttggtttttatagatccataaaataaaatgggttataaagagttaaaagttgtagtaaattgaacatgaaaataaacaacttatgaaatcggataatatttgaaggcaacaagtctacaatattaccaaataaaaaagtattttgctaacttacaggaaggtagaaatagaaacagcggcacagtagcatatgcagttaaaatgtttcaaatatggtcttatttttaatgtgaaaaatgctcttatttagaaaaataaaacatgtacatatgcatacatacaacccttccattagccctgtttctccattaaataatgtctttcttttttcatcctcaaactgaattcattcattctttctttttcattcactaagcattgctttctgaactgattatgcacctgcccttaagatttctctattttgtggagtagaccgacatggcaacaaatgattctaacaaaattgaaatttgtgttttaagacaatacaaagtgtcatgggaataagaacatgcaagtcatagactataaaccccttgaggacagggaccatgtttatctcatcaggaacacttaactccagtatctaaaggaatcctaggcaagcagcaggcactcaacagatatttgttcatttataaaatacccatttttccagaatcagagtggaagacgaaacttgcaaaaccgggtattcatttcctaaggttattgtaataaagtgccataaactggtggcttagaaaagcagaaatttaccctctcacagttctgggggcaagaaatcctccaaaattaaagtgctggagacaatgctgcctctgaagcctctaagggaggatctttctttgcctctcccagtttctagtagccccaggcattccttggcttttggcaagataactccactttctacctccatctgcacatggtgttctccctgcatctctgtcttcacatgactctcttcctataaggacaccagtcatattggattaggagtttacctacttcagaataatttcattttccctaattacatgtacaacaacttatttccaaataaggtcacaatctacaatactagaggttagaacttcagcatatcttttacaggcacacattcgacctctaacaactaataacatgaatgttttcttctactcttttttccctcgatcctcctttgccttacttccttcccccaagatgagataattttgagaatccaatgggttaagaaacagtgtgctgaggaacacaggctgcagtttagactctcaccttttaagattatccattattttgccagactcattcttcttgtgcttggtttggctgtgcaaaattcctacaaattactctcatttataagaactgcttacattcatgcctaattatcatgcagtagaataacaattatgcatatcattaaattcatgtgagataaccttcaatgtaagtttcatttgattatggcactaaactctgttcatgcatgcttggccttcatagcaggttgctcaagaagaatggttgcctctgccacttaaaacataatgacagtaatactggccataaccctaaccttctccaacagaaatattggttccataactcggtacccaccttgcaaaaggttactgcaatcaagtctatgttaaatacaatcaatatttcatatattaaatatgaatgaaaatggaatattttatttaacataattaagctttctaatttgcttaaataaatgcatctgtctgcatcttttcccctcactaaaaatatacataggttaagagtataaaacatgtgatattattttttaacaaatatgttctaatctctttgttaagcattttagctgtagaattaaatatatatatttaatatatacattataggggtttaatatatatatcataggcatatagcaatatataagtgctttgtgttctgctttcacacatttttggagttacttttattcatttttaaagcatataatgtgacaatattatatcaaaccatcaatgttactgtatttatcatctaataggtacaaaaataccttgtcatgcactccatatatataaaacctcaattaaactcccccaagatttgagtgggaattttaaaattatatctaatttttaattataaaaataataaatatacatttcagaaaattttggaaatacaataaagtaaaaataaaaatggtccatggctgggcatggtggctcgcgcctgtaatcccagcactttgggaggccgaggcaggttgatcacttgaggtcaggagttcgagatcagcctggacaacatggagaaaccctgtctctactaaaaatacaaaaaccagctgggcatggtggcacatgctggtaatcccagctactcaagaggctgaggcacgagaatcgtttgaacctgggagacggaggttgcagtgagctgagattgcaccactgcactccagctaaaaaatatttttttaagatgggccataatcacatccaaaattgccacatttcacatttcataagaatactagtgttactagttttgcaagtcccaagttccactctttattctaggcaatcatgatcagttcattcaattatatctaattgggattctattttacaaaatattttgtagcataagttttacttcatcacattttcttttatagataagcatatttaatagatcataaggctctattgtttttttaaatatttaaatctgtttagaattctcagtttttataaaacatagttaagagttctggctctagaatcagagttcctgtggtcaaatcggtctccatcatctattacttttgtgatcttcggctaattattttactcctatttggtttcctttataaaagggagttattaataatgccttccagaattactgtgataattaaataaaatattctacataaagtagttgggcatatttaatgcctagcacatcccaggactctaatgaatattagctgtcaataatcaggtttgcagaatgtattattttctgctgccctcatttgttgactctcctcatcttcctctttctctttggactttccttctacaattcttctttgcgactctaccatagtcagccatttaaatatttgcttgtagaacttagtcccatttctcttaatctaaattttctccctggacattctcacctactccactgactttcattactttcttcatactgatgatccccatatttctatcttcagcccacatcattctttctgagcttttcacccatacatctaactgcctattgaatatctccactcataagtttaaaggcccttcaagtctaacaggttcaaaattaaagtcatccttttcccagaaggagcttctccacttgtgcttcctcattcagtgaatgaccaccaatagcacttagctactccaggaagaatgctgagttatgacatgatctggtcaacagaatgtacacagaagtaagagtgtgtagttctaagcctaggcattaagaggcatcacatgttccacagtttccacattttactgctgctaatctcacgggaacaggtcccagcaaaggtaagagacacttaaggaaaatgggcaatttgccctgactggagaagccaatctacagacatatgacaaagaataaaatcattgtctgaagttactgaattttgggattgtttgttatgcagcattactgtggataatgttaactgataggggaacctactaaaaatcttaagcttcatcgtcatttgcatcttctctataaatatggcatttcaaaaaataaatcttggcaaaataccaattttttctcatccaggttccctgtactttaaacccatattaactttccatagccaaaagtccttctgcccaaaggtaaaggagttgtttcacaaagtgagtaagaacacaagactgacaataggacaaagttctctactcctgcaagcttgccaaacagaatgcccagaaacatccttcagtggctacttactgactttaaataaactccatattctctgaaacacagaacatacacaatcatatgtaaataattgtgtctaagtaggacacttagacacattctgagacagagtacaataaatctcatggaaaggaaaatacagtgtgttatagccaacaccgcatattgttgttttatttctcttaaattcaaccataggttattacaaaagtaattgcgttttttgtcattgaaagtgatggcaaaaactgcaattacttttgtgctaacctaatattataatttgcacgcatgaatatgctacaaccatgtgacacagagcttttatgccttctaccatatattttgtggcactttctagttccagtgaagtttcattctaacatcatataggaattagaatgtgcgaatgttatatatgaaacctcacagactattctatcccagtaaaaatgctgttctatcccagttttttaaaaaaggcagattatgaaactgtaactattaacctcatagcaagaggttaagtacgtatggaaaatggttcactttaaaacacagtcatttgatatttaagaattatcagtgacctattgcttcaaatatctaacaatacctcgtatatgccccctaccccatacaacagctagaaaggaatctctttatgatattatttctagaacaatgactggcatttattaagcccagaaaaacattgatgggcaaatgaatgaatgaattctttcagcaactgcaattctactaagagttgtctcctctgtctttacaccaagttaaaagggaaataacttgtgtacagagaaggaagaaaatgattcacatggcttaaaggatatacacatattttaagctaaacaacaaactttgaccatgccagccctgccttaatatacaaggaaattattgatttttctataaattaaggaagctggggattttatctacaaatggcacacacacactggggaggtgtcctttggaataaaatttattttgataaaaacatatgtgcatagttttctgtaaatattactcacttgaatctatgtatcacagtatttaatatgctaggagtttaaaaactgacatgttaaaatagcacaaagacatgtctaggctagttactgttgagtggcacttagtgtggatttactcactgcaaaccgtccttgatatgccgcctgtctcttccctgcaagtggcagtgaaggtcagtgaatctaatttgacaataatgagcctgctctgcaatgtgttataatattgtgcctttatttctttttttaaaaggtatcaaccaatcaaaaagcctgttcaatgacatcagggaaaccccaggagagctggggagagttaaaaaacagtactctcttatttttcttttccaataatgaagacagcagaggttatgaacctgttcaatatgcattaaaacaaaacacagcctgataggaatgttttaattaataacaattatcttctgcagaattgtgattcaagccaggtctctgagcatgaaggagaaacttgacactggtgcttctttgtggacagagagattttaagcaaagttaatggaaactcagcggatgaatggtgccgcaattcaaatgtactgtaaaattactgaaatgatttcaatgtcacaggactacactgcattacatttatgattattaccacttgctacgctttagtgatattttgtcaaatgttttatttaaagcttgtcttaagaaaaaagtctgtctttcagagaaaaatgttgatgcgacaaataataactcataattatttacccacacaaaatattctatgcacattttaaatactgtatgtataacatatatttatttaaataataattattataaaaaagttcaaaagttggaatgttgacacaaggataatgatctaatagtcatatcccacaccccaatgtctttgcaaatcttattctatattctaagcttttatttctcaaaagatgattctagaacaagatttatgagaatcacatttcaggtatatgtttaaaatatatattctctggccccgccccagaccttctgagtcagcatcttctgggggtggaggcggcacccataattctgcattttaacaagttctccaaataattatcatgcatactgtaacccaagaagcgagaggttcttaaacggcgaccacagaattcaggggtccgtgagcttgagatgggaaaaaaatacaccttcattttcactgaactctgattgaaatttatcattcccatcagttatgaatgtagctgacaaatcagagtagttttagatatctgtgtgtcatcaataaataatcacagatattttcctatattacagttgaagctattgcaaaatattattgacattgatggctactttgaaattatattagttattaaatttcctgctagagcttttaattaattataaaaagaacacatatattacaatatcagaaaaaaattttaatgatatttcaacaaatgtgtttcaatataactggcttcctttgtaatctcatgcattttatttgatgtatttttaaatatgtttctggatggggcccacaggcttcaccagacaagcataagggtctgtgacacacacaaagtcaagaacccctgtctcagctctcctgggtcttgtactcattcagagggagaaggaaagagtagaaagagctaaatgaaagctgtgtctctgaatcaaataaaccttccctgacatttcctctgaaaggacatatatgtgggagcgtaaagaaaagtggcttataaaattccaatgtgtttaaaagtgggggaaaaaaaggaaaggaaagcaggaacagaaacacctgtcagtcatgaatgacttattgacccagttcatcagcaggggagctgaatttgatcagttctgccatgattagtgtcactacagtcaagtgtaatttctgtataaatagaagtggtggataggaaaataattcggttcatccctccaaattgtatcagtcagcacagacatcaaaaattgtcagcccgaggcggggaagcacgcatacccaaccaagcctataattgtattcagtattcaaatattttaaaccacaatatgatcttcaacataagacaaggaaaaatcactgttgattgtgcatccttctgaactgttgaaacagcatttctgtatttttcattgtcttttttggtaaaagtgagcaaatataagttcttgtatttgtcactttttcagtaacaggatattttcctttcaaacttgcctgtcttctagttccttagcttagtgtatgaacctccatccaatcagttgtccaagacagagacacactggcctcctttctctccttcatcaaatagatcactaagtcctgttgcttctatctccctaatatccgtgaaagtaattcacttcccgtaggcccactgctactaggttagttcagaccatcattattttagctagaattacaggaatggactcctaactggtctcctgtgcttaaaccctgtttgtctccaaacttttctccatatgttcatcaaaataatttattaaatgcatgtcttgatgtcattcccctgcaaaaacatgtctatggaattccacagctcttagactacataccatacttcttaaaatggcatatcagaccttcaggacctggtttacatctctggctttagcactacccctcacactacagacttcacatatactgacgttttccccagcatttctgggccatggcacatgctttccctctgactagaatgatctatttgcatgactaacctcagctgatgtctcttgtgggatgttatccctggcacctctaagtggggtgagatggcctctctgagtgtgggcctagtattcaatacttaccctttttattgtatttattagatcagactgtatttgcatgtttgttgttgaattaattgaattaaccagcaggatttatgtcactacaacatagttattgtacttaatctgagattaaacccaggatagttctttttgaaagcattttatatttacttacagcaaaatcatttttaggtattgtaaacatattactgttcaaaggaaaaaaagactgggtttttttgaaaccagtaagaaaattaattctgtatctgatgtctatctaatatttctcattacaaactaaaactatgctttagtaagttaagaataagaagcttgtttatgaagtttatcaattgataagtcttattcagtagaataaatccacatgtatagaaactttgtttagtgcctggcacaaaatagggctcaggaaatattcgtttaatgaatgaatgaatacatgactatcttctacttaagccagagctcttcctaagtctttggactagtaggcacttagactggaggtaagaagaccagaggggaaagaagcctgctcttaacagtcttgacactgttgtcagtgaaactaaatacacaaatctgattctgtcaccatgttgcctatacaactgagataggctcctctgaactacaggacaaatagtataatccttgggataaattaataatagtgataataaaagtaatatttgccgaacacttactgagtctggtccctgtgctaagtgttttgcatttgtctcactgaatcctttgaacaaattaggaagcaaacaatattatatccattttgcagacaagaaaagcaagattaagcaacttgcccaaagtcacatggatagcaaatgcaaaaatagaagtgaaccacaaatggtcagatgagcacacatgctgaagctttttactatataaatcatgaaacatttagttccaacctatctcactagctaccaacttgtgaaatgcccatctcttgacctcactgtttcctaatccccaaagtcccaccacactatactggaaatacttaaaatgaaccacgttcttataagacctctgtgaagtgcacatattacttcctttaccaaaagttccctaccccttctcatctacccaaaagtccctatctatccatcttttaatttcaatatcttatatctcctactctgaagagatatctctgactcgctcaaaaagataatctttttggacctcattatattttgtaccaaattattaatgactttattaagtaatcatgtctctctgggccactcacatccccaataaataaacagtgtattctctaaggaaagagacaatgtgcaattcacttttgtgtccaccacgagctagcccaagtccacaactcagcagaggctcattaaatatctgtcaatatgagatgaaggatgtgtgttttgagggagggtttgcttaggaatgatgatatgacaagaataagaaatgcctgtcaaaaagctaagaatgtaagagagagcaagatatgcaaagggtagatacaatattatagcatacagagtggaatgagaatattaatgtaggggaaaactagagatcaggactatatcactatttgatcattaaataatattgataatgttcttaataaagagtctacatgatgagtaaatcattgaaatgtggtcgatatgttgtttttgagtaggcaggtaagaagaatgcaccttggaaggtttttcatcttggaaagtttacgaaagagtaaaaatcagtcaataagagaattaagtatttattccacaaacacatggacttagaaacactttgctgagccacttgcagatcctgatcctcagaaactgtgagatcataagtgtttgctgttttaaggtagtaaaccgtggtgtgtgtttttgttttttttttttttttggatagaaacagatagctaatacagaccagaatcatatataattccgtgactttgttatctttcaagtatttccttattattgatgcctacactttctcaatgtctaaaatggacaactaaattgctactgtggatttacttcttaactaaaacagattttacattcgtataatgtagatttacatatgtattacttatacatttaaaataattagaagttcatatattttcaacaaaaaggaactcatctaaatgccagcctgggttgcataatgtggacctcatgctgtgggagttgctgctttcccaagttgggtatgacaggctagttgcaattacataaatgaattgttttctttcatcctcactggtgcattaatgaaagcctgcacaattaaaaaaaagaccacactgcttgaagaaagcaaggcaaccagtttaaattagtagatgaaattaaaatcattttactagtactattttccaatccagcaattgctgacactgttctgaaatgctacgtacatccatattcaaggatcttacatacctagagccaaacttatcattaaaaatgtgataaatggctaatatacttttcttaattactctataaaactgacaaactgaaaatgtacacaatattggaaaaggaaaaacattatttttagggttagtctaagtccaaaaacttaacttggcctcctttctttacaacaggtttctcaagacaaatccatggcaagcccaaatgcgttgtcttcaaactattcagtttctctcctcttgtcattaatcatcctattctccggctaaacccctattcttgattttagcataaccctttcctcagaagggtgaatatttcttatgaactttgggttcaacttacgcaggtaagacaagaaccaattagtgtcacagtaagcataaggaaccctggattggatgcttcaggcttgtccccttgcttgcaggagcctgtatgatagctgtaaactcagaaaggtaaccactaaggaagagagaggtggccagtgcctatttaaaaataaaaagtgaagaaattatttataatcaagtggctcataattgtccctataccacactcacttttattatttcctggtaaagagggtgaactctatccacaagtcctccatagttaaataaaacctttttttaaaatctgtatcacacacacaaaaagtcttataaatgtatatcagtgtgaatgaaaacaatgaaaaataaaatggctgttttctatgtcccattgtctctatgcccacatttttatgacgcagtcatggtgtggttacagtttagtattctatatgttcctcttagaagaagagggatgtgcatccaatgccaaattctactgaaaattcatgtgtctaggtcttagcgcttttctttttttagagaatttaactcttcatgaattctgttaatcaaattacttggctggctatttcctaccaaagcctaaggctccctgacacctgatgatctcttcttaattgatactttcacctttgtgagatatccgcacaaatgtagctctcactgagggtaggttggggaaggggaagcgcttgatctcagaagccattatgactgtgtgtatatttgaaagtacaaactcaaaagacaggtaacaaattgccaaagaagcactgcaaatgataacaaagtagagtgaaataaaattagaaagaaaaatatgcatcactgaaaagtgatatgtttaatatcccataaatattcataaatatgtcatctccacaagcttataatgctagagttttagcattaaaagatggaaggctgcttaaaataggagcacaaataacaataacaactcaaaaagtctttaatcttcatcagccacacaattgagatcagatcaaaatatatctgtacagtctctttcactcatctatcctcatatttaatattcattgagtacaaagaagtttctatgtaatttcctttattaatacttcactatgaagtgtccccatactaacataattaactttactagaaattattaccacacccatctgcctaaattttcaattatctttgcctctagacatgagtagctaccttgtgaaatgatatcaggataattccttcatattcataatgcctccttttctcccataggttgatgcagatataatgattaaaatgaaagagcaggaaaagttttctgctaaactctaaaaccttttgtattaggagtttatgtcttaagcctttctacctcaaaggcttcatattgttaaaaatctacagttcttaaaggatcaacttctactcctttttcatcaactatcttttagataaggaaaagacaacttatatttaaagtaaattttgaatgaaattataaggaaagtgcttattatttaccatctggcagtacactagtcctttgagttatatgaccatatatagtataagaattcaaaatacatgaacaaaaccactactaaatcttaacatttggtaagaagtgtaacgtggtgataaaaatattctcctatgaattgggactaatttttatcataacatatatgatctaaaaattccttattaatctttgcttccatttttcatcagttcataaatgacaataaatagcaagtgatggtgaaaatccagagcaagtagcactgttatatattgtgagaatataaagtgttgcaattactttgggaaataatagtctactaatttcacataaacccaaatactacatctcttctataacccagcaattctacttcttggtatttactcaagaaagtgaaacctatgtacacaaaagacatatgcaacaatattcatagcacattataaataacagcctaggtataaatcaaagggaaaattaacaaataaattataatatattcatgcaatgcaatactacttaggaatgaaaaggagcaaattactcatacatgcaccaacatagataaaccttaaaaacattatctttgaaaaagtcttatatacaagtatatagtgtatgatttgaattcaaataaaattctagaacaggcaaaattaatcttggtccaaaaaattaaaatagtgtttatcttgagaagtgagggagacacactggtgagggacatgagggaactttgtaggtgacatgatgtctatatcttgataagtatttgcactacacaattgcatgtatttgataaaacatagtgaatatgcacttaagatttgtacaataaattgtatataaattttacgtcaaaagaaaatgctgtaatcagatactgaactttatttagtagtatgcaagctaatgtatttctacatttctgatttctgcaattcatgttttaatgtacaaaaaatgaaacaggataatggttagagggcaataatgaggagaaatgtgatagcacaagtacaataaaatgtaatggttaaagctaaatgatggatatattgtttcaagtttgctctgtttagtaagtttcacaataaaatgctggggtaaattgcaatctgatttaccttctaatcttatgaattaaggaattaatacttttgaaattcaggtaaacaattttatagtaacagcaaagcagctcttaagtagttctcttggtcttctcaaaagatttctttttgtgtcttttgggtagcatttgagaacaggaatgccaaacttttttactcacatcagcattcttcttcaatttcaaactaggtaataattcagtttctctccttctgttggactctcagaataagagaatctcttatctatgagaaaaaaatcctaaccaattttatggcatgttttttgctttgtaccttcctgtccatcaaatttaatatcaatatgctaagaaacaaatgagccctaaatgctacctatctgtgtgtgtatgtatatatactttctaatctttcatgttatttccttcttaggtttcccatcacccaaaactgtgtttttccaaggttttcttttcacaggatatgacaattgaaaaaacataaatgatataaaggcactattcattaataagggtgaaggaactaaacaaaacattgttttccattaatttaacccagtcagtgctgcaaagcctagagccatttgctggtgttctaaaggagtctgcaactaaactcttgatctaacacataaagaattgacgtttacttttaaaaatcttagaacaggtaatgagaattctattgattagtctgtaataaactgataatggctcttagaataatgaataatttttactgagtcatgtcagctaatataatttcaggtggcacatgaaaaaattgaagcaattcagcattgtgcctttcctgtcactggagttctaccattaaaagccagttatacaaataagattatggtgcttttatatagcttgtgcctttccagatcagtattaatgccatatttttagaaaagaccttttgtgcatgacatactgatcaattttttgtttttgtttgagggagggtctcactgtgtctcccaggctggagtgtagtgatgcaatcacagctcactgcagcctcaacctcctgggttcaagcaattctcctgtcttggccttccaagtagctgagactacaggtatataccaccatgctagctattttttaaattatttttattttttgtaaagatggggtcaccctatgttgcccaggctgggtttcaagctcctgggctcaagtgatcttcctgtatcagactcccaaagtgctgggatgataggtgtgagccatcttgcctggcctgaacaatttttgatatcaaataggctgatgttagacatataacaaaggttaaagttagacacatatagcgctgcactgtccaatacagtagccactagccacatgtgaatttgacatatggctagtctgaattgatatgtgctattaagtataagatatacatatatcagatttcaaagacgtatgatatttttaaaaaaacaacaaaatataaagtatcgaaaacaacattttaatattttagacatatttaatccaagtatattactaaactaattttatctgctcattatttttaatgtggctagtaaaaaacttaaaattagatttgtggccttcatatttctaatgaaagtgctaatgtagaggtttctcacctggcaaaaataattttatatttaaatacaatgtatccttaactttgaaatactgtacaaacaaaaaaggggggaaggaaaaaagatgtgactaaatatgactccattttgggaaaataaataaataaatattatttcttcctgctgttaagcgtctatctatccatcagataggtctgatgcaattcctcattttgatttttaggtaaataatcccttttttctttcatctcagacaatttgaaaaatattgaaaaatggttttctgcctattttcaacctcttgtcatttctttaaagaagaattaaacttgatgaagttctaatttttgataaaatttaattttgccttgatcattttgaataaagaacctgcatccattttgcttgtgcttgagtgtgtatactattatttaagtgatgtaatctactattaagaactacttgcccttatggacaaacttgactttgaagaaatttttctttttcgcatttttaattgtcaagtaacttcaaagaaaacatgaagaaaataaaagaccatttttttaattaactgtggttagtcaaacatgctgcggtcgactttgtccatcccctcactaacatccgtccctcctgtcttgttccttcatcacccacctgaattttcctatttcattcctaataaaagaacctttatttggtcaggtaatcagctaggattaagatgaaactggttcaatgagtcatgcaagttgcgagtgggattctttctttacttagagtttttggtatcttattcatcatgaattttttaatatcaatgtcattttttaaattttttgcattaatatatatatatatttactgagatttttggcacccccgtaaattctacatcagaggcaaatgtctcactcacttcaccataatcccagccctgagggtaatgaaaaaatctctgatttgcagagagggtaaatcctttcatataccccaaaggataaatagtgactgatctcaacaaatcagggagatgtcattcctctggccagtgagatagaagaagtgggctgttcataatagcttctaagaaagcttttttcttttcttttcctttttcctgataaaataccacagaattggctgacacatccttaaaatttatttcatccttcccgcatctttataccatcaatgtggacatcacattgaatgtgcagcaaccatagaaatattaaaaggaaattttctaaagtcatccatgagcaactgcaccagccctggactgcacaccttttaactgcttgttagtggaaaacataaacaatttttgggttaaacttctgtagttggattctctgttacataaaacagaacacaatgccaactgtcacatatgaacaaactaaattcttctattattttaaactaattttttttcataacactttaatttttgctttaatcaaaaactgtatttgcaaaatagtaactatgttacaacaatatgtactgataacatagatctattgttttggtgacataattcttatttacattttagaaagttgtgctctgataacatcacaatcatttttttttcaaattctatttagtcctgccccaaatttagtttggttcaacaaatattggctaagcagctactctcctttagacactaaataaactattttaaagaaaatagacacagtccctgacctttggcatcttacagatcagttctgatccatctttgatattacactcagctttattattagggatcttattttaccagtctggaaatcactgaggatatgcttcttctcactacagatttagatgagaatatttcaaactaatatggttggaaattcatttggttgactgtgctgctgaaatgaatacaataacctatttgtttagtattttacattaacaaaacacttctacaaaattgtctcattttgcaggacacaaacaaatggaaaaacattctatcctcatggataggaagaatcggtctcatgaaaatggttatactgcccaaagtaatttttagattcattgacattcccatcaaactaccattgacattcttcacagaattagaaaaaaaaaaaactattttaaatttcatatggaatcaaagaagaccccgtacagccaagacaaccctaagcaaaaagaacaaaacgggaggcatcacgctacctgacttcaaactatgctacaaggctacagtaaccaaaatgcatgatactggtaccaaaacagacatatagaccaatggagcagaacagaggcctcagaaataacaccacacatctacaaccatctgatcttcgacaaatctcacaaaaacaagaaatggggagatgatctcctattccataaatggtgctgggaaaactggctagccatctgcagaaaactgaaaccggacctcttccttacaccttatacaaaaattaactcaagatggattgaagacttaaatgtaaaaccccaaaccataaaaaccctagaagaaaaccttggcaataccattcaggacataggtatgggcaaagacttaatgacaaaaacaccaaaagcaattgaaacagaagccaaaattgacaaatgggatctaattaaactcaagagtttccgcacagcaaaagaaactatcatcagagtgaacaggcaacctacagaatgagagaaaatttgtaccatctacccatctgacaaaggtctaatatccagaatttacaaggaacttaaacaaatttacaagaaaaaaacaaccccatcaaaaagtgggcaaaggatatgaacagacacttctcaaaagaagatatttacgtggccaacaaacatatgaaaaaaagctcaacatcactgatcattagagaaatgcaaatcaaaaccacaatgagataatatcccatgccactcagaatgccaattattaaaaagtccagaaacaatacatgatggtgaggttgtggggaaataggaacacttttacactgttgatgggaatataaattaattctaactattatggaagacagtatggctattcctcaaggatttagaaccagaaataccatttgacccagcaatcccattactgagtatatacccaaaggattataaatcattctactgtaaagatgcatgcatgcgtatgtttactgcagcattatttacaataacaaagtcatggaaccaacacaaatgcccatcaatgatagactggataaagaaaatgtggtacatatacaccatggaatactatgcagccataaaaaagatgagataatgtcctttgcagggacatgaatgaagctggaagtcatcatcctcagcaaactaatacaggaacagaaaaccaaacaccacatgttctcactcataagtgggagttgcaaaatgaaaacacacggacacaggaagggaaacaacacacaccagggcctgttggggtgtggggaatgaggggagggaacttagaggatgggtcaataggtgcagcaaaccaccatggcacacgtatacctatgtaacaaacttgcacgttctgcatatgtatccaggaactgaaattaaaattaaaaaaaaaaaaaaacttgtctcatttcccttttaaatctctattgttggaaaaactggtgaaaatcaagtctttaaaattacttctacttaagcagcagccacttaaactgttttcttttttataaatgaaatctttcctttttgcattcctaaattcctgggggaatacactggagtaattttaggcttgattttttcaagagtaaaggaaaagaaatatttcctctttgcagatttaaatgagtttcgtatacagtgtgttctatgaaatgaatgccaatttgttttcattagaattattcttcttgcatgacatctcttttcttcaatgatgcttatttatgtactgggcagtgttagacatgcatgcatgcactctttcttcaagagacagtttctaatggagggcaccatgctaagagctgtgggagagaaagacatacatttcataattccagattcttaaggaccttaaaatccagtaggtaaaattagatatatcagcaaattaggatacgagtaccctgtggagggaaaattaacgcaatagatgaagaaaaacaaaaactagcttcaacagggcttatcccagaaggcttcatgtagcacatgacatttgaaccaggtttgacaaatggctaggatttcaggaaaaatagtgaaaaataaaggacattcaggtaagagaaaactgcaaagcacagaaatgatcaagtggacttgtgctgctaatgaggcccatgcctgaagcacagaatctttgtaaagaatgatagagttgaggttggaattacagtaatgtaacctaaatgtcagactaaaggttttgtattttcatcaaatagaagtacctaaagattttagacctcaactaccatcatatgtgacaaaataaaatgagataaacaattttacctataaatagataaagtatttaaattctgatgctattcagtgatggtaaagacgtgaggaataaggtatagtcatttatacttggagaatatgcaaatcattgctttcattttgaaatgaaatttattatctaaaagactttaagttcacatactgtttgacctaggacttccaatttttgaaatttattctatagaaatgttggtatgagtacgtaaagaaatatgtacaaaaatatttattttaataaagatacattcctcacaaagaagaaaaatcttgcctacttatcaacagaaaattgaattagtaaagtataggaaatccatatagtataataatattcagatttaaaaaaataagtttatacatacacttacaaccatttgattttggacaaacctgacaaaaacaagcaatgggggaaggattctctatttaatgaatgatgctgggagaactagctagccatatgcagaaaatcgaaactggatttcttcctaacaccatatacaaaaatcaactcaagacagattaaagacttaaatgtaaaatctaaaactataaaaattctagaaggaaacttaggcaataccattcaggacatagatgcaggcaaagatttcatgactgaaatggtttggctctgtgttaccatcaaaatctcatctcaaattgtaatctccataattcccgacatctcaagggaaggaccaggtgggaggtgattggatcatggcggtgattttccccatgctgttcttgtcatagtaagtgacttctcatgagatctgatgatttatcaagagtttgatggtttctccttcacacagctctctctcacctgctgccatgtaagacttgcctcttctccttcctccatgattgtaggtttcctgaggcctcatcggccatgtggagctgtgagtcaattaaacctcttttctttataaattacccagtctcaggtatgtctttatagcagtgtgaaatggactaaaacagtaaattggtactaggagagaggtactgctataaagataccaaaaaatgtggaagtgactttggaactgggtaatgggcagaggttggaacaatttggagggcccaaaagaatacaggaaactatggaaaagtttggaacttcatagagacttgttgaatggtttttggccaaaatgctgacaatgatatgaacaatgaagtccaggctgaggtggtctcagatggagatgaggaatttattgggaacaagagcaaatatcactcttgatatgctttagcaaagagactggtggcattttgcccctgccctagagatgtggaaaactttgaacttgagagatttgatctgaaattggaacttatgtttaaaaaggaagcagagtataaaagtttggaaaatttgcagcctgatgatgcaatagaaaagagaaacccattttctggggagaaagtcaatccagctgcagaaatttgcttaaataacaaggagccaaatgtcaatggccaagacaatggggaaaatgtctccagggcatttcagagatgttggtggcagcccctcccatcacaggcacgtaggccaaggaggaaaaaatggtttagcaggctgggccccaggccttgcagttttgggacttgggtgcctgtcttgggacttggtgccctgtgtcccagctatggttaaaaggtgccaatatactcaggccattgcttggtcattgcccgagccttggtgacttcacatggtgttgggtctgcaggcacatggaagtcaagaattgaggtttgggaacctctgcctcgatttcagaggatgtatggaaacacctggatgtccaggcagaagtttgcttcacaggtagagacctcatggagaacctctgctagggcagtgtgaaagggaaatgtgaaattggaccccctcacagattccccaccagggcactgcctagtggagctgtaagaagagggccaccatcctccaggcccaagaatgatagatccaccaacagcttgcactgtgcacctggaaaagctgcacactcaacaccagactgtgaaagcagccaggagggggaatatgacctgcaaagccacaggagaggagctgcccaatttcatggaagcccacttcttacctcagcatgacgtggatgtgagacatggggtcaaaggagattatttaggagctttaaaatttaatgactgccctgctggatttcagacttgcatggggcctgtatcccctatgttttggccaatttctcccatttggaatgggaacacttatccaatgcccatacccccattgtatcttggaagtaactaacttgttttttttttaattattttacaggcttataggcagagtacttgccttgtctcagatgaaactttggacttggacttttgtattaatgctggaatgaattaagactccaggggactctttggaaggcatgattggttctgaaatgtaaaacggatgtgaaatatttggaaggggcaaggggcagaatgatatggtttggctctgggccccaacaagtctcatctcaaattgtaatccccataatccccacatattgaaggagggaccaggttgaaggtgattggatcatgtaggtgtcttcccccatgctgttcttataatagtgagctagttctcatgagatatgatggttttataagggtttgatggttactcctttacatagttctcttgcctgctgccacgtaagacacgcctcttcgccttccaccatgattgtaagtttcctgaggcctacccagtcatgaggaactgtgggtcaattaaacctcttttattacccagtctcagatatgtctttatagcactgtgaaaacagaccaatacaatgattaagtcaccaaaagcaattgcaacaaaagcaaaaagtgacaaacagaatctaattaaactaaagagcttctgcacagccaaagaaactatcaacagattaaacagccaacctacagaatgggagaaaatttttgcaatctgtccatctgacaaaggtgtgatacctagcatctctaaggaatttaaacaaattacaagaaaaacacaaccccccaaaaaagtgagcaaaggacatgaacaaatacttctcaaaaaagatatacatgcagccaacaaacatgaaaaaaagctcaatatcactgatcattagagaaatgcaagtcaaaactgtaatgagatacgatctcataccagtcagaatggccattactaaaaagtcaaaaaacaacagatgctgccaaggttgtggagaaaaaggaatgttttttttactgttggtagaagtgtaaattagttctaccattgtggaaaacactgtggtgattcctcaaagacctagaggcagaaataccgtttgactcaccaatcccattactgggaatatacccaaaggactataaattgttctattatgaagacacatgcatgcgtatgttcattgcagcactgttcacaatagcaaagacatggaatcaacccacatttccatcaattgcagattagataaagaaaatgtacatatacatttgtatatgtgtatatacaccatggaatactatgcagccataaaaaggaaggagaccatattttttccaggaatatggatggagctggaggccatgttccttagcaaattaatacaggaactgaaaacaaaatatcacgtgttctcacttataagtgggagctaaatgatgagaacacatggacaaatgggggtggaaaaactcacactggggcttgtgggagggttttggtgggaaaagggagggggtcaggaagaatagctaatggaagctgggcttaatacctgggtgatgcgatgatttgtgcagtaaaccattatggcacacgtttacccatgtaacaaacttctatatcctgcacatgtatccctgaacttagttggaaattttaaaaacaatggaaatgtaaaaaataggtctatagttactaatgcacaatgaaagtcaatgtatattattatgtgggaaatatccagttgcagaatcatatgtagaatatgggttcattttgaaaagttaaaaaacaaaggtctttatctacattaatttcttaaaaaacttaattgatctcttattataccagacatggttctgtatgccagtgaaaccacagagaacaaaacacaaatccctatgtttgtggattttgtattcaagaaagaaaataaaataattacaaattaggattaatcaccaggacacaaaaagaataggatagggacatactatgttagataaggtatacaggtgactactctgaaaaggcaacatacaacagaaacagaaagaagtaagccctgcagctagggaagagtaccccaggctgagggagtagcaaaggcaaaggccttgaagcattatccaggaacaaagagaaggtcagcctgaagggcccagtgaaccagtggaaaggtggtgggaaattgaggtctgttattacccaggaaaatttactgactgtggctagagctccctaaaacaataggaaatacctggtatataacgatatctactgtgtaccaggagatttcactgaatgcatgcacaacaccccttccccaacagaagcaattttgctttattgtcaggaaatgaatccttaaaccacttgacttctagcagagtgttgatcttattgtgactgacatataggcaaatcctcagaagagaatcagaatttccctgagctggatgaaaggaggtcagagggagcagatagagagaacaatgtcgtttgcacatggacaagtctgtttgaaatctcttgcatacagccaaagagataaaagaaaaggactacaaagtattgagccagtacagtgaaggttaaatatgagctcctactgctatgatttatccactgaaacagctgggaaacttccgaagtagttcatatatcacagaagtagaggaagtgagtctgactgtataaacacacctcagggctgctactgttcccattaactgtctgtctcagtaaaggtctgccattagacagattcctgctgcagctgaactgatagaaaactgcaggtacatataaaaattagagggagacgtatgtcaagaacagtcatgaaaaatttttcaggggaaaggagaaaaaggagttctatgatgtgactgttttaaaatctgacatttttggattttcatactctctacatttatgatttttcagcttaatgctatattcatggtttcagttaattatggcagatgtttattaaatatgtgcagtcatcaatttctatagcctatctgatgactgttttgagaactttctctaaattcctcttacaatcaacagggaaaaggactgaggctacaagttaagatacatacattaaatgctatttcagaatagcatcaaacttctaaggaccaatttatatgaaatgtgacaaattacccaatatggacttgcacttcctttcagttgagaaaacaaaagcatgatgtgttcaaatgtgttattccttctaggatgattcctctttgaagatccatgctactcattctacttgattaaaacagaaccaaagaccacatttgtggacatatttctgcttgaagcagttcatctttacacagggacttattgtttggtgaaatatgaggaagctagtttgttcatacatttaatctagtaataattttgatgtctatcatgagtacaactttcagttttttcttatcttggatgggaaaaaggagtattataaacaggacctcaattcccaacaccgctctcttaaagaatttaaattgctgctgttgactaaggataaattaaaaaatcatggcattgcatacacaattttataattcgatctaagtctactatttacaggttcatctcttgccattctacctaattcatcccaaactacagttatatcaaactggtctggtctaacatttcccaaggcaaactcctggtttttgcctatatggcttttcctctgccgtttctttcaagaatgcctattttctttgtctgaacgtttcttattctttcatcaagatctggtgtaaaagtcaccatatcatctctaaaactttcttctaatttcagagacagaattactattttcttactttcaactccagaaacaaggtcctttcacgtttatgttaacatatcaccagcagtcaggatagtatctagcagataaaaagcaggcaataaatgttgaatgaatgaagctcacttcttttaattcagacaataggcacatagtctagaactatacaataccaaaggcttattgagacagctaaatcctctttcctctttatgtcactgtttctctctgctttcctttctccctccttctgtgtgtgtttttgtgtgatgtgagggtagtcatggttagaaaacaatctgacttatcattaccatgtactagattttctatcattaagaaggcaagaacagagaatttaaataactttcaaaatatttgggtcccaaaacagataattttcgcgctatgtctaatactacctcaactacctggaacaaagctaagcagaatatgtatttttttttttttttctggtaggatggagtaagtaaagagagaatgacatcatggatttacttttattaagcttccaagatttattcttagtttggaggatctgaaattaaatattttacctctccaagtacatcatagaataaaattgaggctcataataaacattctcaccatatttcattgttaaagcctttctggcagttccagggtacttagagatcatctataagtaaatcccttcttcttctttcttgtcacaatgctgaaccccagagaagtaaagtgaatggtttgaggtcacccagcagctaagaccaattgcaagtcaaaacacaaagtttcctcatcaccagttcttatcattttataaagttgcctctatcaacaaattgctaacaaattgcttttgttcttaacagaacacttcatttccctacttaaaatcatgcaatagtttccagttttactaagtttagagtacaaactcctcagtagaatttcagggcatgttcatgatctagtctttgattatagctctaacctcaggctaacccttgctgtgcttgcattctatgctttggtttctatcttaaacctctgtcctctaaagatagaagctgttataaccaaatgtttatgtcctccccaccccaattcagatgttgaagccctaatccccaaagtgatggtatttcagggtggagtctttgggaagtaaataggtttagatgaggtaatgagggtgaggctctcaagataggattaatgtccttacaggagaaaaagaccagagcttactcactctccaccctgtagacacgcagcaagaagctagctatctgcaagccagggagagggacttcattaagaacctgaccatgttagcaccctgctctttgacttcttggcctcaagaactttaggaaataaatgtatgttgtttaagccacccagtatatgttattttattatagcagcctgagcagattaagaagcaaaatattatgtctccctttttcacctacctaatgctgattcatccttctgtttttaccttatttacacttattctaggaaatcttccgtaaagctccaagtctggaatcaatgactttattaggtgtccctataatattgaacatctccttttataatgtgtatgtcagtgtattatgttgatccatctacgtgtatgtatacttcgaccaaactacaggctccatggaagtaagaactccatctgctttgctcagcattatattctgagcattatcatagaggctagcatatggcaggtactcatgaagttatgaagatctttgagataagcatattcttaaactaaaataattcttttttctttatatacaaatgaaattaaagtagagaaagagagaggaatttcagtattactttatgaagcaacatcttcaaaaaaaattaaatgaaaatacccataagtattgtgattaatatgattatttcatttgtaatcatcatattaagtgctcaagttttcagatttgtattgtcagtctatttacaactaccacttaagaattatagaatttttttgtaaggtaaaaaaatgtaaataaggatcatctaatggattgttaattatactatatatatataaaatccctatggtgttctcattttttaaaatttgcaatatttttttccaacaatttcttagcggttgtgcctattacactgtaaacccactaagaactatgcatcaaatcaaataattaaattgaaatttatactttttaatatttcagctgaatttagatctgcctagcaaatttagtacaacaataataattctgaaataatctgaactttcaaagtatatagcagctttctagctttctttttatattcaatgctatttgagtgccaacttagggtaatgcaggagatataaaccatcccctactctctactcctttttcccttaatacaagctcatgctgaaggttcactttttaaaaacatttttcaagaagcttatcaattatatagacttcacaatacaccagctgttcattcattctttcattcacaaatgtgccggcactatgctggatgtgagggagacagttgtgagcaaatcatatcatatgttcttagacatactctggaaagacggatccatattagttacactaatgaagtttaattgccacttgagataagtagtctatgagaatgtttaacaaggaaagctttgctcaattaggccagaagagggggtcatggaggataaagcacttaagctaagttctgaatgatgaaatcaagttaaaaaggcaaagagtgtttgtgagtgtttgtgagtgtgagtgtgtgtgtgtgtgtgtgtgttgggaagagggttgttcatggaggaatgtttcaaacagtgtaaaacagtatgtgcaaatggtctgtggctaaagagggaatggaacagtccagagaagggtaaaaagtggtgatagataaggccgaaatataagaggatgcttaagaaatatcaagggtcttattgtctatgttaaagattcagccttaccttaaaaacaatgataagtcactgaaggctgttaagtaggggtgtggaaggtgatataatcatatatcaatttgtcaatagtaaaaagattgctgtaacccatattggaggatgtttaaggttttattttggaaaagcaattaagaggacactaaaggatttcagacaagagatgatgttagggcaagatgatgatgccctaaaaatgagagttatgtaaagaaggaggaaagtggagagatttacaagatactgaaaatgtaaaatggacaagacttgatgatgaatcaaatatatctgggggcattagagtgagaggtgtcaatcataaccactaggtttcagtaacttttataatttatttcatcctcttaaatacatatgtattagaggtagtactgaaaaccctaaactcaaatatccctaagcttcatgggtaaaaatatatatcatgaaattcattttaaagataaagtaagactttaacatcctagtatggcggaatgaccactaaactttaaactttcattctggtcaccatttacatatcaagattgatagtcagagatttgaagataagagcaggtaatttatatttgtttgttcgctttatgatggaagactctcctccatcgccaaaacattacaataatttaaaaatacataaaaaatcctcttgcttagaaaaaaaattatagtctagataaaggtattgcaaactgaatattggcttttccatagaaaacttactgtaagagttaaatatctgaatcaagatttaattctaatctttttatagaaatggctagaaataccacaatcaaatatacaattaatatataaaagtaatactatatctttttagcagtgtctcttaaattacattgaaatgaatgaaacttttactaaacatcatatttgatttggtaagacatagaatcattatactggagtatgtaaagctcctatgtcttttgaaagaaataaatctaaagacaaaatatcagggttgtgaaatcaaaaagcctgttttgacattgttgagtaaagttcaggggagatagagagctacctgatgactcttcgaggaggacattacttttgttattttcattttctcatttagaaattcctcctgcatacacagtccaatccagaaaacattgagagcttttttttttttgtatgactatactaagcactgagagtactccaaacaaatagtaaagaataggctatagttcttaggtttaagaatggtatattctaaaactagtaagagaaaaaacagggacatactgaaagaacagggtagataaattctaggagagaggaataacaaagagctatattaacacggagtagaaaagattaccatgggttgttgggtgtgagaattagagatcatgttgctcaccctttagctgcatttgtgcccagattaacttcctcaaaagtgaatgatgatttattttaatttgtaaactgctgtttacaagtgctaatatgaatgtaactgtggatcattttaagccaagttgctataaatcatagatgatagatatttgagctagaaagctcctctccaaggaaaatgtaccaattataaacacactttatgatgaaatatttcattaagttgatcctattgaattactgggaatggtctcccaaatcttcatacatttctcacattatttatttttcatgatattgagaaaagcctttacaaagtgaagctaatggcacatgtgtgaggagaatgtgaataatagatgataaaaaataaatctctggcatctagaaaactggcctattggggtacaattatttgatgcatattatcataaaaattttatgtctaaaaaatggtaatataaagccatgcagatccttttgaaagagaattgtgataattgccgttgcatgccaaaataattggttttgctgatcaaaaacttttccattaggtaccaaaatgtaacatctgccagtgatataatggaccaataattgaagcacatagtatatcctcataggggctacactgctgttttatttattcttgcccaactgtgaagataaacttcactaaatacatgtgatatcctgtcaattcgggataagcatatttttttcttggacagatagctggtaagtgaaacacctggatcaccccagagctgcaaaattacaatcatagcggatatatgatgtcagaaacaagtccacttagacagactaaaaacattcaaatatgcagaggcaataactcctctccctttccagtttagctgtaagctaacattgtttcatttgcctttaagatcactctattccaacatgacaggtttatatttataggtcaccccattacagatttcttattctgtctgaaactttattaatcagaaacaaagcattatgctgaatcgggtatttgcaatggaagattcaacttaaaatacggaatttctatcctctaggacattttctctaatgtcaccaatttctcaactcagtattcaaacagtgcagatttattatttcctaacaacacacttttcatttagaaacgtatatttctaattatatcatctgcctcatttgcaaattcaactgtatgtttcctaagattctttgattacactcttggggacatttagtgaatgtttactgacaagtagttatggccagttaaataatcatgccctctatagttgcacttctgtacagtaattccattatactaattactagtacttaactcctagtagtgcttttattttatgatctagagtctgttctaggtatctcccatgtaataagccatttaatgctaacaactgttgatgatatcagaattgtttttatttcaattctatagataactgagaccccagatggttaaacaacttgcttaaggtcatgtagtcactaagtgtagacccataaccagagcctagggagtctttctccagatcacctgcctttgaccactcttcatcactgttttcctataacttgatgtgatttatgataaactttaaaccttggttttatattaatcttttctatttttcagatgtttagctttatacacatcaaatagccatcacagagattttttgttgttgttgggctgccaatattgaatatgtggtatataagatacataatacatatttatgtgtgaatatgtacgtacatatttctgattggttgccacaccacagaattaaataacatacagtattatgtaaaatgcagatctttatcacttactcttgaaaacctataaataatttcaatatgaaaattttattgactctgaattacaacacatattactaataatcatatacatatgtttatcacacagattttcagcttatattacagtcctgcactcattcagcagaaatcttctgcttttactgcaatgcgtagcagttatgcttcatgactgacaattatgtcatataaaaaataagtcacaattaataaaaatcaaaactaatatgtgctacaattatttaatgatttaataaactaggagagggttttatgaaaagacttatacaaacaagagacccaatttccaattagaatcaacacttaaaattcttcaagttcctaagagtgaggcaacacctaatcagtttgttcttcacatatccctctacccacaaaggggcagttactttcaaagaaaaacacggttaaaatatctgttccctccacatgggttagaaatacttttgtgagataactgatacactacaaaaaatgctgcaagtgtaagatcagaaattatttgtgtggtaaccttaccacatttggatatcaggactataattatagattcacaaggaaaaataaattaacttaataactaaaatagcccttaaatgaatagatgtatcataataatagttaacattccccaagatttcactacatgccaggaatgttctaaattcctaacatctatgagttcatttaatccaaatactaacactatgaagttaatactattattatttccattttaatgatgatgaaataagtacaaagaagctaaataacttgtcccaggtcatttgcaaatcactggggatggtattgaacccaactggtatcccacaagaacctgcactcttaatcacaattcttgacagtttttttgatccatcttatttataaacaattagcttatttcaaattttgcactatttcaaataatgttataataagcatgccagtacccacacctttttgagcttgtcctagtatttttagagtaaacttcctagggatgtaaatgctgaatcaaaggacatgaacattcatcactgtcaggtttgtaggtgaaaaatgatgctctgaactgttgtttttatttgcattttttattagtgagcatattttatttcagtggtgtcttagaaccagctcatgcaggttttgattatttcttcccacccgactccaccttcaataaaatgaagttggtagcttgaaattaaacataggtgggagttttcacagctttgaaatcagcacagtataaaaattagacttgctttgtttgttttgttttgttttgctttggagagttgcttaaatgttcaccttcacaggccattatgtttctgctatgaatagactactcatcttctttgctcaggtaaaagttgggttgaggtttttttttattgatttttaagatgaatattttaacctaataaattataaacaagaggaaaaattttgttattaattctagtaatcatgattttggtcacacaacttagccatttgttcaaaaataatatagataaaacccaaagtgaaaaaggttatgagtttcaatttagaatctgctataaaatttaaataattattaggtctccttaagttaaaacgatgttttaagtttgacttaccttattttaaaataaatgtatgtatataatctatgccttttagaaatgctataagatagaggttggtgaatacaccctaaagctctgaagtaccatagacacttgaggttgtagtaataaaaaataaaaaagaaaacacttgagattgcaattttactatcataaaactttaaacttctatggattttatatgctaatgccaatgttgaagcattagaaacagagggctgaaccatgggtagtctagacaatttgctatataaatttaactagcaggtaacttcatagttactgattttcaaacaatagcaatgttcctggaactgcatataactagtaaaaactgtttcagttaaaaatcaatgatgagatatcactaaattagtggacataaaagaaatagggtttaaactgtattcttcaaacaacatttatcttgaattttgaaaggaatgtaattgttatcattttcatataccttttaactttctattcaaatacactgaaatactgcactatggagaagtttttttgctacactttcagttaatttataaaagtagactatacaagatgtatagtccattgtactaacatgaaagaacatttttcaggacaaagaaattaaaattgtttcaacaggaaaatctgccaaaccaagtgaccatgaaattcatttacacataattttactattgctggtcaagaacaatcagaaaataagctattcttcatctatttttccaaagatatttttacagattaactacaagagaaaggtctattctttttcattttgaatttgtgatttaagaacctgacacttttgaaaaatgccttattactgctttaagcatgctctgttcccattctgttttcaaaatcattaaatcatatttatgaagtgaccatacacatcactagcaattttgataactgcttttctcctgccttaggtcattagttggactgaatgttttaaagtgaaataaaacattttatgcgtcacagagtaagaaatggactgaatcaaggggctgtggttcttggtgttctctgctgtagcctggggctaattcccattttcaaaactttgcttaaatctcgatccttccctgaaatgacctggacctcttttccccaccaaatcttaacctaatcatgttctaagaccctgccgaaaaccctgtgttcttgaatatttcaactgttattaatcacccccttctcaccttgactccaagtactcaaaggtatacgacaccctttaatacttatatatataaggctctgaattggttgattttgttttagggtcatttaattaacaaatgatcaattctattaatagtaggcagggattatgcttatatatctttctaatagtcctaatcacctacctggcaccttcaagtacagtcaaacacttacatctggccctagcacattttggagcatctagtaaatactcactaagagctcaatagattgaataaaagtaaacaaaatgtctttgtgttcgtttgtttttgtttattttacctactatgcaatttcattgcagttacaaaaatattacaattttaggtagatttggaaataataataaaaatgtagcatagagtaaaaattgatattcaaaatccaaaacatttttatgaatgcctccaagaatcagttcatttggctttcttaaatagaggtcaggttaatttcacaagaaaataagtattttttttcttagattctagtctcctggcttctttgcaagctgacaaaatattaggattaacaaggaccaatctagtgcaccttcacccacggtcctctgttcataacacatatacacaccacgcatatgaacatccatgtccattagatatcacagttacttttttttcttttttttttttcttttgagacagagtctcactctgttgcccaggctggaatgtagtggcacaatcttggctcactgcaacctacgcttccctggttaaagtggttctgatgcctgtgcctcccgagtatctgggattacaggtgcacaccaccacattcagctaagtttttgtatttttagtacagacaaggttttgccatgttgaccaggctggtctcaaactcctggcctcaattgatctgctggaattggcctcccaaaatgctgggattagaggtgtgaaccaccacacccagccaacacagttatttgttcttggggtatgtgcttggtagacctcagaaaaagaaaaaaaaaaggctcatctgcttggaatcacttgaagattacagttttaactatgggtttcaattattttgatattcagaaatcacgtgcaattaaaatataaataaccctcaaagagattatttttaaaaatctgttaacacgtaagtacttcagatctttcctagagtgtcagtaagctcagaataacttgtagtggtcatggtcactgcggtgggatgcttagggagaagagatcttaagtagggtccacattataaattcctgggaatataggaccattctagggagattggtttctcagactttagaggaataataagtaatgatggaatttgggagaagtctggcccaaagaggacataatagaatctaaaagtaaaatgtctcagttgtagtgtaggtatgggggacagggaggggaagaaagtttaatttacaaattacaagcatactttggaaaagtttcatttctcttcatgcacataaagtacatatttcaatattatagaattttttccattgttctaaaaatgcaaatacataaaaatttcttaggcagttgtctaatgaatgtttaaacagtaaagttaattatcctacaacttaaagtaatttgtatttgatcaaaacagctacgttagcattgaattcaaacgtttgcttacaagaaatacattgtttttaattgtctgtcacctaacaaaacccaaggcattttgaagtaaaataaatttgtatctcccatatagatttttttaattacgtttcgactaaatgagaaagacaggattggaaagtgcctccagaggtcatttagtccatttccacttctggcaaacttcgcctaaatcatttcaaacatatggctaactaccttgtgccatctttgttaagcaatctccgttcttggctgcccacattaatgatgtgtgtgcctacaaactggtttaagtgttctgtgtgatttagctagtcaagagtgtctgataatctgtctagtcagcaagatatctctcagttaaatcagtctaactgaaaatgtgttcattaaacttggctaattttttatttacttcactggtaaatacaattaaaacactcaatcaagtgtagatgtcagagacaaccagtaaatcaggatcttccttaatctaactaaattgttcccgacctgattttaaccaaattttactcaacctacccaccctggagcaaaagactgtcaaactatgttcctgttcctaaacgtcttcaataagtcttcttttctctgccacttttgcaggcaaataaactaaagagtcaaagaatgaaacagggatcagaatgagccaaccaaatttataaggaaacccaaagagaggtttgttttattttttttaaatgaacatactcaacaatattcaaaagactaatactgaaagatagaagtatgcagcgataaaatacgtcaacatgtttgctattttctctatattatagcagttatttctaaaaataagaatttcagactatctccaccattattttcttttcatattcctctgaaggtaatgaactaagttttaaatttgcctactttttgaagtagaacacttctcccttaaaatcaaatttaaatatataatactaagacttacatttttcctctgccttagactaagatcagattttacatattgctcagaggccgaaccctaaggtcaaatacagttggagtttacttgactctactgttaaaagggaaaacagaggcatatagactcagatgacagtcaaagatgatctagacaaaaaatgcagaatcacaatactatactataatacataaaacatttgagtactattattaacattgagactgtcatttaagatattgtgtcacaattaccagcatgtgagatgattcttcggtttaagatttcaaccagaaaatatacctaatgctagaggatgagttagtgggtgcagcacaccagcatggcacacgtatgtatgtaactaacctgcacaatgtgcacatgtaccctaaaacttaaagtataataataaataaataaataaataaataaataaagatgttaatcttccattataattatacaaattatattgacatgtattgacaatacatgttaataaatactccaaactatggaattgctgaagtagcttacattagaaaatacaaaagtaaatttgaaaacaagaatatcagtcttaaatatcaattttttaagagccagcatttaaaaatattcaatactgaatttgttactaatttgtagaattaatggcatgcaactccaaaggaaaagagacatttaagtgactcagatttgggataatatcataaattcctttcagtggctgtagctagtgttttagagggtaggaaataatgatgcaaaatcagatacaaattatttcagagacatgagtgatcttcaaagtgaaatattagaagtgatgttatgaaatacaagaaatgtgactgagagctcctaatctgatatatggcaatatgttaccactcattaaagcccaattttaatgcgttgacagctaacctcgagaaacaagacatctaacttcaatcctataatattatttggtgatatatcctcacaatatcgtacaggcaaataaaacgttcaaatttgaatttagcacttcttctcctgacagctctagaattccttaacttagtgaatatagccacaatcaatccagttgctcaagtcagagatcaggtagccatccatgtcaaatcccaaatcctgtcagatctcccttataataccttcaggtctctctctctctctctctctctctctctctctctctctctctctctctccccccccctctcaccccctccctccctccctcttctctccctccctcttctctccctccctcttctctccctccctctctatcccgctacccactacaactctaggataaactcttatcatctcttgcctgtattataacatcctcttaaatggtcagggtacacctccctctcccacccgacctcctagacacctcacccctaggtttctcgctttctaccattctgttctctccactgtaaccagaatgctttttaaaaacagaaaagctaatgatggcagtctcctacataaaagtattcaaaggcttcccgtggttttagtaaacttggcctttaatgcaaagacaattttgtctctgcatatctcttttgcttcatctagtgccacctttttctttgttcaatagatttgaattggatttcatctagctgtgtcttttacctggaacaagctttctccctcttcctactagatccttcagaactcagtttaaatactatttattattttaggtcatcttccttcaagattcctcagactaggtgaatattgtctgacatagtcttccatagactcaacatacttataatgtattcattataagctacatgagaacatgagaatagagactcaaagcctgtcactattcctgacgaatatgttcttattaaatgcatgctgaacattcattaagagctaaaaatatataaacaggttatttttctatacatgtagtcaaattagtgctcagtggctgttctgattattttatcattacaggttgagtatctcttatccaaaatgcttgggactggaagtatttcagatttctaactttttttttgggggggggggtgatttttgaatatttgcataataccagtttagcatcctaatctgaaaatccaaaatgtaaaatgttccaatgagcacttcctttgagcatcaagttggcattcaaaaagttttgaattttgcagcatttcagattctgcattttcagattggggatactcaaactttatttgaaattattagtgacttattcactgttccttaaatcagttgagtgaatgagggttctctttcctctacaatattcagatatctactgttgtcatttcttctgcttatcctctccatcactaattattcctggtgtcattttatttcaagacttctgtcagcctcttttcttcattattagaaataaaactgtgaagtcctccaaaaactctgatccaccttcaaatgatcctctttttcattccatcacattcaatttttcaaattctttcaaggctctttcttgagagcgacatatcaaagagctagtaataagaatcttcaacaccccaaattataaacaagtttcatgccaataagggcctagtgcactgcactaaatgtgtaacaggcatatatactacaaaaacattaaataaaatattgccaatttgaataaaatggtttattctcttattacaggtctttaacctcacatatctgagtaccatccataagattcatatcgctttgtttataatcagtgattagatagatggaatttctaacctccatattttacatgctaagattttaaattctgacttcaaggagttaaaaaaattatgctcacaaggaccaaaatatgtaaaccaattataagatcatctttactgttagtcaaaccattttatgtataatattattcaccatattggaatatgtctttgtaaggttaatgaaaacacacctttttataataaagcctactttaccagacataatgaaataaaatttccataggcatagctaccttctaagtgaaagttctatgttactttttagtcattgatagttattacattctaaaaagttttacttactgaactagaaaaattttcaaatttcaaattagattatctttgttatactgagtcagcattatcactagagagttctttagatggtgcaatcaacttagataatttctatcttttaagaaatgggggcagctgggcgcggtagctcaagcctgtaatcccagcactttgggaggccaaggcgggcggatcacgaggtcaggagatccagaccatcctggctaacagggtgaaaccccgtctctactgaaaatacaaaaaaattagccgggcgtggtggcaggtgcctgtagtcccagctactcgggaggctgaggcaggagaatggcgtgaacccgggaggtggggcttgcagtgagcggagatcgtgccattgcactccagcctgggcaacagagcgagactccgtctcaaaaaaaaaaaaaaaagaagaagaagaagaactgggcgcctttgatacataagtgtattcattaggtcttgaaaattattcacaccaccatcggttcctttgcagtgaatgttgcagcccttagggtcagtgtcaaccaattaaaattcaaacacatagacctgagagaagaaaccctgttaatctatttcacatcctaatgatgaaaacctttaccttaaatgaatgtattttggataaagtaggccatatttttataaaatatgatatgcctatttcagatccgagtattattttaggaattaataaactaaatctagttcccattcattctgaaactattttcagaattgtattttgaaaacacacatacgctcacaaacacatataatatcctaatgcatctcaattagactcagttggctaataccaagtttccctaaagttcactacccctccttgaggatcagaatactgatcaacacagccctaagggcatttttttttttttagataaagataaaccactgtataactaccaagtttaatagcaagtataaaatttcactagtaaatgtagtttcataaaacaagggtttaagaaagtgattctcaaattttacactatataagaatcatggacaagacttactacaatacatattgcatgtcatatcccctttttctgattctgtgggtctgctcaagaatttgcatttctaaccattccccagatgatgctgatgctattggcctggggactacactttgagaaccaccgatttaacgaatcatccattttttttaatgttactgcaaatgagttttaatgttacttttaaaaaaatgtaatgtgtattaggaaacagaaaattttacaacctagttgtaggtatatacacatgttatacatgttatacctgttatatataacacatgtgttatacatgttatacctgttatatataacacgtgttatacatgttatacctgttatatataacacatgtgttatgcctgttatatataacacatgtgttatgcctgttatatataacacatgtgttatgcctgttatatataacacatgtgttatgcatgctatatataacacatgcgttatacatgtcatatatcgcgtgtgttatacatgttacatataacacgtgttatacatgttacatataacacgtgttatacatgttacatataacacgtgttatacatgttatatataacacgtgtgttatatgttctatatgttatatataatacatgttatatatgttctatgttatatataatacatgttatatatgttctatatattatatataatacatatgttacatgttatatattatatatgatacatatgttatatatgttatatattatatatgatgcatatgttatatatgttatatatgttatatgttatatatgttatatgttatatatgttatatataatatatgttatatgttatatatgttatatgttatatatatgttatatgttatatatgttatatgttatatatattatatatattatataagttatatattatatattatatatattatgtgttatgttatctatatgttatatatattatattatatgtgttatatattatatatataatattagatatatatattcttttttatttccttctttggcataattctaatttctaaatgctaatttcccctatactctgtctgcaaactcaagacagactagttatgtgaggtactattcaaaattgaaatagaactttttaaattcttcatattgattcgggcattggaaacagcaattcctcagttttcatagttatttatctcagttgtctttctcctgagtattataatcataccatcagcccatgtatattgagatcatatttcagtctatatttatgttatgtggttttccatgtacattttgttcatttagtcattatcttttctcagaattagctgaaaaaggctattgggcaaatggtgagaaatgaaggaaaaaaggacaaatagaaaaatagaacaataatgcctttggtcttaagcctttccttatctttcatggtcttatcatggacaaaggccacatcttttaaaggattcatactgagatactcaggaggtctcacaggagtcatatactatactcagtagagtggctttatttttattcccagctagtccacctgatatctgaaaagtttgcccagttacactgaggaccgatcaatagtgtgatatctgaaaagtttgcccagttacactgaggaccgatcaatagtgtgatttgctatccatagggaggaggggaacaccctctgatatttcctgtttttaaacaactaaagttgttttgtattccctaaaccgtattgatccaagaagctaatgatagtttttacgaaagctcccttttgtaaactctgtcacagaggaaaccttggaaaattacaattaacggcaggaaaaatgttggaaatctattttaccatgtaactttcctgccagctcctgctatgtacaaaataaagcaagacccacatgtttttacctcctgggtttggatatagctggactgatgcaatggcaatgaagatggcttatatttataactccagggtgcttttactcctcccaactaatttgccatcttgtccattatgtgaataagctgtaacggctgaattggcattgcccccacttttccatttcagcagaaattttaaaaggaggttgtcactctgtaggctcaagtgatgccatctgcttttccatttggggaaatgcacataaaaatggtgggggagatgttaagtatttaattaaaggtagactatctgtttccccaattttctctagtttaatacctgctgggtcacatatagaatacaaataagaagatagaaaacagttcatgagatcttgtgggagaaatactaaaattaggttgcccattaaacataacaaatgcacattttactagtacattaaaccaaacagaaaggtttttttttaatgtgaaatacatgagaactcttagaacactataattgcagttctaaagaaagtaatcatattactcatatatgaatcttgatttctagacaaatatatttctgaaactgtatgatgaaattcatatttaaaatggaatttaataattgtcatcaataatggatatcttactttaatctatcaataaaatcacctacctagggatgtatgtagatgagtaattcttcaattagaatactaaaaaatatgtcattacaattacagcttcaaggggccagtaatgtttgtggtagactttcaagactgttgagtgtgtagtttatctaaatactaaggttattttttccttgtaattctagagccacaccattgttttgactatggcacaaatgtaatgcacatttcaataaaacagtacagctgggaattaacaggctaataaaaaggactttaaaggtgcattaaattaggatttaagatgtctcttgcatttgcagcataaatgctaataaaaatataaatctgttattaactttttatagtcatgcaaagcaataaaagctgaaaatattgaagatttatcagcacatatctgcaagacggacagaatagaacaaaggtagagaaagagagatgttaggaaaagggagagaaatttttagagtagaaatgaggagaaataatttatatatagtttaaatagtttatacacacacacacacacacacacacacactttgtttcctttctaacataatcatttttattttgatcctcaagaaagtttgggaatgttgtttcatgaaagtaaaaaccaagaaaatattttctatcatttaaatgactagagcattaagctaggagattctgctccaagggcaatactatgttacctgttactatttcccttagctaacaatataccacttgtgtcaaatgtgtgctgacaatacaggcttgttcattagaatcatacaaacagctagctagcagtttgcttaataatgcactaacctattcagaatgcttattgcttgagtcataattgcacagatctaattgttaaatgtggctgggaaattaaaatggtagtccttagagacagctctgtttcaaaattaatataatcattaaagaaaaataaaaacatatatttttgctggcatatctgaaggtttttaagaatttcttatgcaaaatgtaaaagagaagtcatggttctcgaaaacaatattaaaatgatatacttccatctattaagccacatggaagataaaagttttggggttgtagcctcagaaaggctctaaattcttaatgttgataaacaataaacaacaatcatttgttttccacattggttatgattaattggtatatactgaagtttttaaaaatgcattaaaaatataatataggcagtccatggattgccctcatgctactttgagaagctgaaaaaccacaacacattaaattgcagtaaaattcaaataaagttttataatttgtatatagtgcataaaaatgtttatataaattcgccattaactatataaagtattatttcattgtagatagtaacaggatcctcatttgtcagaacaaattataaatttggtgttattactcttttctctctcctttaaaatatcaatttgccagtattttaaaaaattctgaatagcaacagttgttagctacaatttgcattagacagctgacaattactcaaggtgttactttctaagaaaatcaaacaaataaatatgctcagattttaaaaaaagacttgcaaaatacttaatctgctacttatagtgtatcacataacaagttagacagtcacagtattatttttaaaactatttttaattaggctatttttaaatttaaattaattaaataaaatatgcacaccttttaaaggcataattgttgttcttataatatatgtaaatcaatttaggcttcctaatttattaaaaatagaggtggttagagtacgtaagaaaattctctggaacataatttttaatatggcacaagcataactcataagttcaatattgtcttcaagcacattaactttatataataaaaataaacaacaaaaacatggcttaccatatccctatacttaatctgtataaataatattaaaagcatatttcaaagaactcatttcagaaatgtttatgttgtgagttaccaaggaaacattaaacagaccagaaccaagggaatacatgattgaatagtcctggtttcctttcgttatagagttctttcctttatgtcataattgaggaataggagtagtttaggaaaatggaaaattttctttttaatttaagatagtccatcatgcattcctggaaattttcatccaaaaataaaattatgtagacacatgtcaacatctggttagactaacaaaagcaattttaatgtgcagttgaccctagaacaatgcagaggttaaggatgccaaacctatccccaccaccggagtcaaaaatctatgggtaactttcgattcccctaaaacttaattactaatactctactgctggctggaagctttaccaataacaattgattaaaaaacgattttgtatgttatatgtattatatactttattcttataattaagacagccagagaaaagaaaatgttattaagaaaatgataaggaagataaaatatatttactatattcattaagtggaagcagatcattataacggtcttcattctcatctttataatgagtatgctaaggaggaggagcaacaggaagcattggtcttgccctcttagggatggcagaggcagaagaaggggaggaggtgaaaggggaggcaggagaggcaggtatactaggtgtaattttatagaaaaaaattcatgtctaagtgggtccatgtagttcaaatctgtgttgttcaaaggtcagctgtaatttataatagtaaagtaatttagactgaaaattctaaatgatgcaatataattatatattgtacaggaggtaaggaaagaagcagaaatctcataaaagtactaaacctgatggaatagtactgtttactgatctgacataatttccatcaatttaagcgattcctttgactataccttaaatgaaatagtatggtttcatcctaaattcaaactctcataactgcccaaattaataattatggtagctaaactaaatgttgaataagtatgaagtattttgttatttttgatatacaggaaattcttggattgacatacgtgtataaatccagaactttcagattttggataaggaaatcagagcatataccatatgtcacgcctcacccgtgctgggtagcaacccacatttgaaaccagcctaattctcccatagaactgatgtctacgggttgtttttttctttcgttttaaataaacatagaaattgaccagttgctgcctgctgaccaactcctttatacacccctaattttagtcagctgggggaagagacaaatttgagaatggcctgtagtgtcccagctgacatcctccaaattaaagcttttcttccctggcaatactcattgtcatgactagacctaagccaaactgctggtatttagaaacatattcaattgccttaattattatacaataaaacttatgaagattcgcaataagtgggaacaataaagacacaaattattcttaagtcagcttaggtcaggatttttcactaaataaattttggagccaatttagaagaaaactgttagcttttagaactttgtggattttagaattgtgggtaaatgattatgggcccagttttctcatttaaccctaaccacacacttatgcaaaaggtaattttattatcattttatatatgaggaaactgaggcttaactctcataaatatcttgctcaaaattatttggctcgtaccataaatacagaactatgttattaatcaagaagtctgtctctgaatcccacaataatttggagaactgcccataataggtttgatagtgtcacaaatgccactgtgtttataactccagattttgtattgccttttgtgtttaaagccatttcctgttttagaagggtgagctggaaatttatgtttgctgaaagccctgtaactatatagctaagtagcatttttgaagggtctatgaaaaagtgaattagggagcatactctgaaattcctatttattcctctaaattctaacttgcaattgttgattaaacttactgttataactagagcattttcagtcaagtggagaaaatctgacagagaaataagcattttaatttttaatttcatgtagttaagacagatcccctcaagaaccaaactatgaggctgctaaatggagaacacacttcatatggggattcttttgagagctgagcaaataaactcaagtgatacataatatgccgtaatgtatagaaaagaatgctcatatgagaatgtttaattgatagaaacaatattcactatcataagggaataatgatctttatactactgagattgtctgaaagttaacttttgaaaaatgtttgattttagcaattgggttttttaaattgtgatatataaacatatttaccattttatccatttttagatgtacaattcaatggcattaagtacattcaagttattgcacaatgataaccacctttcatttccagatattttttatcttcccaaactgaaactgtctgcctattacaaaataacttcccattctcattccccacagcccctgacaaccactattctattatgtctttatgaatgtgactagactattccaggtaacctcatacaagtgaaatcatataataatatttctcattttatgactggcttatgtcttaaatggtcaatcgtattgtagtatgtgttagaattcaatccttcttagggctgaataatattatactgtatctgccatatatatagtttttagctggagtcttgctctgttgcccaggctggaatgcagtggtgggatctcagtttactgcaacctctgcctcccgggttcaagcgattctcctggctcagccccagtagctagggattacaggtgtgtatcaccacgcccttttttttttttttttttttttggatttttagtagagatggggtttcaccatgttggccaggctggtctcaaactcctgacctcacgtgatccacccacctcggcctcccaaaggctgggattacagacatgaaccaccacacctagcctataacacattttttatcccttcatctgttgatgtttattgggattgtttccagcttttgactattatgaacaatgctgctatgaacattaattcacaaatatctgttcgagtctccactttcaatgctcttgaaatagaagtggaattacggtaattttatgtgtttaatttgtttttggggaatcaccatactgttttccacagtggttgtgtcattttaaatccccactcacaatgcacaagggcttcaatttttccacattctcatcaatacttgttagaaaatatttttataattttacattgtacagggaccccaaactatttacaaccattaactcactactgatcacagatacgtactttgacttctgtttactttctttcatattgttctatttatctatttcacttccagtgtattgtacagtacccattacattaaggtaatagtagcagcttcttataatttgaatgaatgagtgagtgagtgaacctcattagtgactttaaatattttaaaaataatctacctggatccccagaacataactattacatcataaattatatcacaatttgtagtagatacagaacaaactttgaagtctccacaacttacggctgcagaggaaggagactctaaaccaaattactcaggctagaggtctttcttaagctaattgtcagtatatcatgaatgaatattcttaaggttataatgcattatagagagcctggtttatcttgagaccagctttatctgagtaagcagctatacttcagaattctacgtttcctcagtacttaaatctgctcatgaaaatattcaccagaatcattaaatttttaatttattagagatgagcaattcacaatatccagctcatatttaaaaaaaaaataaaaacgattctcttgtctgaaggactccagagacagccaatgaaccaatcagaattcattgactgccagtctgacctatgtccctagcatggagtcaggccagtgaagtatgaaaagatattagtggacaacaagcacatagctaaatagtaattcatgaagttaaactgtatgcagacatgttacagtactaggtaactagaactgaagaatttttaataaaacaaaagtttactgaaaatcctcagctatctagattctccttgtttaaaattctgttaaaggtcatggcagctggtaattataggacattaatttcatctcacaaatcagtaatggtctccatttaactaagaaccccttcttccagacaacataaaataggaaggatctatttaatatcattctactttgaggaatgaccctacctatataatattcagaggcaaaatatcatataaaggaatataagggaaaaggaatatgaaaagaaataggaaaagttacatatgtaaacttacaatctcaataataaagactgtataatagtttttcctaacagttataattacatctttagacaaaatatttatcttgtaaagtttttcagaaattaaaaatggaaaactatccagatgactattggttatttttatttcagtataaataagcttcagtactacttaacaggaaagctgtattaattaaagttaagcactcatagtatttacatcatagatttattataaggattaaaccaggtaataattgtaaaaagcttggaacactgtatggctgaaatgtgtttcaccacgtaaatataaaagtagtgctacagtaggccaactggatagcaactttgcaatacttgttagtcaaaaagtgtaagagagtttgctggcatgagaagcaaacagaattcaaaaatgattattatttattgatattcctttcctaatagagaatatcacatttcctccataggaaaatccaaaaggaaatattttcacttaagacaattggggaaggtgctagctaattagtatcacacaaccaattaattagcattccacatacctataattagaaagtgttaaatatggtctacatcagagtgaatttataaaccttgcctgaggaatcagttagtcagtagggtagtgcttgtttctgagtttgaaagtagcacttgtgaaaaacatttccaggaagaatttccacgaatgtctactcctttaaatccaagttgaaagaaaacccaacaaaaattcagatgaatacatattacatttctatttttttagaattagtcaattagatattaagaaagtacatttaaaatttaattatgcaagttttccttcttttataacttggcctgatgcttaattaccctatatttgttgattattttccatccttcttatgaatatattagcatgcaaccataactatgttaaattacctttaaaaacacataaaaactagtggagcatggtgttttcctcttcatagtacatgaaatccactctaaataaattaggatattttaacagagtttgggaatgtttattttagcattgattccaaacagctctcccgtggattcacctgatagtggatcctgtcattctcaggatggtattctggactgttataaggtggatcctgggtggattttatttttttcacgcttgctttaatcgataaatattttcagaaatgatgagaaaaatgtaagactctaattattttctctaatgttctttaaataatattgattcattcagaatatagctatgtcaaaatatttccttcatttaaaaggtacattggaattactgaagcatgtcctatattttaaaattcatctaaaggaaattattttttgatccattcttcattctgtcctctctggatactatggtagacaaacttacatctcttaactggtccttcctctctacagttatgacttgctgtctagaaagcagtggcttattaagtagactatcaattctttgagtgttgtctctcttgtggaactgccatgactaccataagcttagtcatatagccctactattattccttttgttttgttggcacttatatgaattattttatttacatatatgtattggtatgtttgtgtatgagaaagaaaaattgtgagtttgaagggaaaaagatcacagtgagaaggactttgccttattcattctgtatactgaacaataatagcaacattcatgaaatgtttgctaaatgaataccaattcggttacaaagctaggtttgtagtatggattgcatttaaaatgtgataaatccatttaagcaaatacatcattctccctcccttcatttaaatggatatttaattttatttaaaatggtggtgcgaaattttataagtgatagtaactttctttggttttatcaatagtgcatattcatcatttctatgttcatttattcactaagtatttattgaggacctactatgtatcaggcatacataggcactgaggatatgttttgacatgaaatattaattttttatttttatttttttgagatagggtctcactgtctcccaggctggaatgaagtggtacgatcatggatccatgcatccgtgacctcctgggctcaagtgatcctcctgtctcagcctcccaagtagctgggactacaggcatgagccaccatgtctgggtattttttgtagagacaggggtctcgccatgttgcccaagctggtcttgaatccctaggttcaaggagtcctcccacctaagcctcccaaattgctggaattacaggcatgagccaccacacatagcccaaaatatttaaatatatgtattaagtttatcttcatgatacaatacagattaatctaatgtggcagtattaaaaagtctcacttcactaattaatccaaagaaataaaacttcaatccaggaaagactgatcactgtcagaaatctgattctgaaacatggagcaaccatatgttttttaaccaaaataaatgactattgagaagaaaatcaataaaaactattagttttatgtatattagtttctggtaaaaagtttttacacatcggctaattatattaatagtattacattaataacaaaaccataataatactatacatttatgtaatatatgttatataacttattttatttacatatatgtatatattaattgaacatctacaaggtgctaggcacagaagatacaaaagtgaacgagtcagaaatctgtcctctttgagagcttacatttaggggaatcaactagaaataaaaattaacacggacattgtacatatatgttacagtaatatataataaggagaacaaatgggagaagagatacaagagttgaaattctagataagatagcacatggtaggctctcctggaaagtggcttttgagtaaaaacctaaaaccagggaagaaattagctatacaggtgtaagaggaaagcacaatgcaagcagagagaagagcaaaagaagttcctaaggcagaaacatgcctgccctgataaagagacatgaagaagctgatgtagctgaagttgagtgaaggagaaggcagagtaataggagatgagctcaagacacaatgaaggcccaggtcacgtagaaactttcaggccattatccagattttggcttttacagtgtgaaagatgggaaggcactgggaaagttttgaaaataagaataacatgatctgaacaactttttaatgaatcattctatactttggaaaataagatgtgtgtacatattttggcatcacagaccaccacatcaatactcatgaaaaggacaaactagtaattaaaatccttgctaaaatcttcaagcctaaacatatattttaatccaatctctgtccacttcctatctttttggaagaaggcaataagtcactaatcaaccacttagctgtttcccaactttacctgtcattcaggtggcacaaagataacaccattgctttcatcttccatcctccctgacactaggaataaaaaaaatgaagatactctttttaactttgtttctagataaatgaccactgacagtcacatactaagtcacttgactgaaaagttatttgctgtagtattcatcccttcttatttttacacattatttgatttgtcaaaagttagtcaaacatgcatgaatgttctaaaattataaagattatcaacttaaaacattaaatcactttaatttaaatattgaatatggtaagctgttggaaaaattactcagatctattttttctctacttgtaaaataagtcactgatttgattttttaacaatctgattcttggagcattttgccctctacttactaatgattctattatcgctagagtaaattatttctcacattgctaattggagattggcctttcaatgaggcaaaagactctgtttatttttccatttcctttaaaaaactttacaaaatattattttgttttaaacttaatgtgtcttttttgctttcattctgtttgcacatggataaagaactgtgaacttctgacttcttaaaatatcagtatttgtgggccaggcgcggtggctcacatttgtaatcccagcacttcaggaggccaagacaggctgatcatttgaggccaggagttcgaaacaagcctgggcaacatggtggaaccccatctctactaaaaacacaaaaattagccggcttcatggtacatgcctttagtccccgctacttgagatggggaggtacaagaattgcgtgaaccttggaggcagaggttgcagtgagttgagattgtgccattgcactccagcctgagtgacagagtgagactctgtcccccacaaaaaaaacaaaaaaaaaaacagtatttatgattgtcttccagaaataagattaacatcaagttggaacacagttctaaatctttgtctcccaaaagatattatttatatgaaaactttttttttttttttttttgagacagagttttactcttgttgcccaggctgaagtgcaatggcatgatctcggctcaccacaacctctgcctcccgggttcaaacgattctcctgcctcagcctcccgagtagctgggattacaggtatgcaccaccacgcccggctagttttgtatttttaggagagactgggtttctccatattggccaggctagtctcaaactctggacctcaggtgatcaacccgcctcggcctcccaaagtgctagaattacaggcatgagccaccgtgcctggccaacttccagacagagacagacagacagacagacagacagatagacagattttgtttgttttgagacagagtcctgctttgccactcaggctggagtgcagtggcacgatctctgctcactgaagtctctgcctcctgggttcaagtgagcctcccacctcagcctcccaagtagctaggattgcaggtgcgtgccaccacgccagccaatttttgcatttttagtagagacggggtttcaccatgttggccccaccaagtctccatagttttatttctacttttgtttctagacaaagcagaaaaaagtaaaagcactaggtattataaatttctacactttcctccataaaaaacaaacggtcattttatgatattatagaaaccattttaaagaaaattatactttaaaaaataatttttactccattagtgaaaatcatggcatttactttctgaattccaaaaaatcctcaaatattaaaattaaaattgatgcctacaaactgactccattcaattattaaagaccttatctttatttgtcataagcattgttacatatcaacaataacaaatacaccatcttttacatgtaggagggtcttatagaaataagtagtcagatacttaggtaaatcatagagagaaaatttgaatttttaaaatttactcactgggcataaagaatcatgttttaaaagcaaaatatgtggttagaagtttctgaaaaccgagttgataaagtaccatttcaatctgatgtcagatgtctttgttaaagagctttctgagtagtaatcttaacatccaaaaagtaaagctattttggtttcttcaagtatcctaacacaggggagagaatttcctcttgtgagtccttataatacctatgataattttatttatatctttataattagtggttctgatttctcataatttgtgttggtattagcagggaaccaataaagatttgcaagttcacccagtttttatatggccctggttctactgacctgtttcatggttacagaccctcacgcatagccatgaacagttatctcacagctatcctgtataccactgtaacctcagcccctagcacaggatctgacacaagctggggagggtgctacttagaggcagtcaaatcatgtttgaaaaagtgatatcactagaatcaggttatctgggttcaaatcctaggattgcccttctagctctctgaccttaagcaaattatgtagttacatttgtaaaatgttttagtgttggttacaatcgcatgggattggttactattgcatgggattaaatgatgtaatgcatgtatttcacggtgagccttttatttaaaatctcattattattataaattgaattttttaaagataaaaaactagggatagcttaggtctaatgacatttttggttcacaagcactatgaactgtctccgtctgttctgttcttttttttttttttttgagacggagtctcgctcttttgcccaggccaactgcagtggtgctatctcggctcactgcaagctccgcctcccgggttcacgccattctcctgcctcagcctcccgagtagctgggactacaggggcccgccactgcgcccagctaattttttttgtatttttagtagagacggggtttcaccgtgttagccaggatggtctccatctcctgacctcgtgatccgcccacctcggcctcccaaagtgctgggattacaggcatgagccaccgcgcccggcctagtctgttctattcttaaatgtttcttttactcataattttaaggaaccataagtagcatgatcaattttatggactgcaattaaccatgttggtttctgagaagtttcaaaaaaaaaaaaaaacttttgatgagttttttgtaagcacaattaagtagactgacatttataaatgcttatagtatgtgaattcataaactgaaattgtgtataaacatattccagaaaagccatctcctcaaattctttcattttgtttttgttcaaagtaatcataaatgatcagtgatggtataaagaaaactttttattaaggataaaagagcttcattaaaaaaatcctgtggtaacaggtagaataagaaatctagccagttcagtcacattaaagagataagaaagtggagtcaatataagcaatgatagttgatcacaatttatatgaaaaaggcttttcaaataatggaattatctgtttgttttccagtaaataatcttatgcatttgcaagcaatagcatctgtttctatatgataatatatgacagaaggagaattaatttgtctgtcgccatgtgctacacaacatattaagagtgaactcaaagaacagtgaagctttatttcaactgcagtggaatctgatctaagttaatgttattcaatcttacactaaatataatatatcaagaacaagtataagcagtgaaaatttgttagggtttttttggaatagcattgcttatgtataatgtcataaacaaattacataattatgaactgtgtaatctgtataatacgacagtgttaggcttacaatatattacttttctaattctgggcaagacacttgaactctctacatctaatgtcctcctcttaaaaaggatagaattttacctgctttatagtaggtcatttacttaaagagtttatagactaggacctaattttttattatataattaagtatgagttcctttctttcatactgccattcttttctaaaaagtatatgatcttctgcaattttttaatttgtattaaattcaataattagaaaaaaagtaaaataaactgtgctaattaaagccatatactttttaaaatctgactctcagaagttaatgtgtgttattgtaatacataaaaaacagctactgaacaaagactttaaatatctgcttttgtatttctatattatctatttacctttggagttatatcactttatttaaggaatatctataaagcttgaaagagaaaaatgaactaattgaggattagtcgcttgtttgtgccaggagtatttctgccttagggtcctgtttgccctggactgtgcttccctcttacgcctgcaaggttaatgccttttattgctttaggtttttactaacaagtcactttcccaatgaagctttccacatgcccataaaatttcaacccatatccttcttttctcattatttgttcttcttagtatataatactataccatattatataatatacttatctatcttgaagaaagattcaatgaaaggaaagagtccttgataaaagagagacaaagcttgaaagatataaacagggctaaggcaagagattatattggaataggacacaactgagaatttagagccagaggaaaatagttatgatgatagggaagaaacttcactagtcttgaaatgcaacataataatgatggatttaaagtgaagatcttgaggatgttaataggtggttagaggcagtgggaattcaaaacattaagaagacaagctttagtgcttgctgaatttgtcaggcaaggagaaactgccaaaggatgccaataacaattatgtcaatttaaacaatcctgtaacacttccagccttaaatagacaccagatcatccaaggcaaagaacgtatctaaccccttattccatactttcaactaaatgaaaaataactctgtataaggaattaaatatacagcttaaggacctttattcttttttattcttttatactttaaggaaactattcagagtttcaaaaaatcttttaaactgagaaaaatgctctcccgatttatctcctatgtattttattggataaaacttaaatcagcttgtatctcagaacatacaagaaaagatgtagaccctcctttccattttctcaactttgatagcatctgtgctatattagagactttctgacctcataatttcttcacatgcagactcataatcctttctatggaaataaaattaatgtcagacacttgaaatgtccaacttagatgaactctccataactgaatttgctgcatatgaaacattctccttacttaatagcaatatagaactgaatggtaagacattaatcacagccattttaaaatgcatattacttttttcatctcagtgtatatatgctcttttttgataggcaaagaaattaagttacaaggttattatcaaaatggctaatctaaaaacatattcccctcaattttaacattacttttgtttgttctactactgcagtgaaaatcctgatcttatgatatactcctgacattccacagtgggtacattttgctcgtctactctcagtgatgcaccagagactagaggttgagagagtatctactagtaatgtgactacttgggctaaaattctgagcttcttgcttattagcagtgttatgaactgaatagtgttcccccaaaattcatatgctgaagcccaaacccttagagtgactacatttggagacagggtccataaggagggaattaagattaaatgaggccatgagggtgaggcactaatccaataggctggttttcaatatatatgatttttaagaataataataaagtttgccctactaattgcacagtgttctcttttagagaaactaaaatatggcaaaagagtttcattgggcaatatgtatgttgtttcccatccaatagtccagagtagagaaaagacaccctttcctcattcaaaccagtcagcctatttccttgtcacttgcttgactgacctgcattgtttttcagctgaatcagattgtggatatggagatagaataggtagaaaagtcagcatggaaaagataacttgctcagaaaggtcatttagcctctggctaaaaggacatactggacactcttgggagcttgaggcctaatctcatcaaataacctatcataacatcatgttgtgcatagatatgcataaagtgatgagagataaaagaaatgaaagtaggaagttaagaaccaagaaaagagaaagagcagcaatgctagtgcaaaaaaaaaaaaaaaaaagaatttagaatttaccttgtaagtacaatgaacaatttcccatatgatctgatattatgttaatttagaaataataaaggagctcttccaaaaatacatttaaaagtaatgaaactaaaacagtaaataaaagaaaaaaatgatggtaactaaagagtctcacttgtcagaggctttgcctatgactcttgaaatttcctaatatcacatttactggcttcaagaaatcctctgtctcctataagattttcagtttcattttgtagccacttaatattttatttataatatctagtttatgatatccatcaatcagagaaatagatgatccaaaagtggattgaatggatagggacagacagcaggtgggatttgaaagcagaattattaattattactgattagtgaaattttggtgtcattttgatgcctgctttttcatgaaacaagagaatcgagagtcagataatggatattttgattaaaagttttcccttcaccacctactcctcaatttctgctctaagttttctcttctgtttattctggaaatactctctgagggatgtcatggtttcatttatttttaatgtattgaaggctcttggttctatatctccaacctagacaatattgctgaattcacaatttatatttcccagtctgtagaacattctcacttggcatctctctctctctcatgctcaaaccaaagtccattatatctcctctgcctttgcatttgtgtttgtttttccttatgcactccttgtatacataactggcatctctatccattctgttttccaacccagtaagctgatggtcatccttggtttttctcttagtccccacattaattactcactagtgctataaactctacatagtaaacatctctgcatccactcacttacttattccactgtgtcactcaaggctaccatcatctaatgcttgcactactgtagcttccatgagtgtctctgcttctcagtctttacctgacttccactcatccctccagtttccatttaaacacatctactgaaaacactttctggagagaacacacacatatgcgtgaagacacatcgcacacatacatactcaggcttctgataacatcctacatagcacctgtgctgcaaaagactcagctttcaaggttgcaattaatatcagccttctctgaaaggctataagactatttttctgatttctgtgtccttagtgcttagctctgagttagacatgtagtctacactttctaataaaatagttacaattcacttagtgaatgaagtaacaaaacctacttgtgagagagatccaaagtctaaacagcagaagtttccatttctttcttttttaaaaaatttatctaaaaaaaaaaaatggatacatgtatagaatgtgcaggtttgttacataggtatatgtgtgccatggtggtttgctgcacctattgacccatcctctaagttccctcccctccccactcataccccaacagggcctggtgtgtattgttccccctctctgtgtctgtgtgttctcacttatgagtgagaacatgcagtgtttgggtttctgttcctgtgttagtttgctgatgatggcttatagcttcatacatgtcctcgcaaaggacatgatctcatttctttttatggcaacatagtattccatgttgtatatgtaccacattttctttacccagtctatcagtgatgggcatttgggttggttccatatctttactactgtaaatagtgctgcaataaacatacatgtgcatgtgtctttacctttgaatgatttgtattcctttgggtatatacccagtaatgggattgctggatcaaatggtatttctggttctagaaccttgaggaatcaccatactgtcttcctcaatggttgaactagtttacattcccaccaacagtgtaaaagtattcctatttccccacagcctcaccagcatctattgttttctgactttttaataatcattattctaactggcatgagatagacaagcaaagagtcaaatcatgaatgaactcccatttacaattgctacaaagagaataaaacacctaggaatacagctaacagggcatgtgaaggacctcttcaaggagaactacaaaccactgctcaaagaaataagaaaggacgcagacaaatggaaaaacattccatcctcatagacaggaagaatcaaaatcatgaaaatggccatactgtccgaagtaatttatagattccatgctattttcataaaactatcattgacattcttcacagaattaaaaaaaaaaaaggactttaaatttcatatggaatcaaagaaagacccctatagccaagacaatcctatgcaaaaagaacaaagctggaggcgtcaggctacctgacttcaaactatactacaaggctacagtaaccaaaacagaatggtactagtaacaaaacagacatgtagaccaatggagcagaacagagacctcagacataacaccacacatctacaaccatctgatcttcaacaaacctgacaaaaacaagcaatggaaaaagcatctcctatttaataaatggtgctgggaaaactggctagccatttacagaaaaccgaaactggaccccttccttatgccttatacaaaaattaactcaagatggtttaaatacttaaatgtaaaagccaaaatctataaaaatcctagaaaaaacctaggcaataccattcaggacataggcatgggcaaagacttcatgacaaaaatgccaaaagcaattgcaacgaaagccaaaattgacaaatgggatctaattaaactaaagagcttctgcacagaaaagaaactatcactcaagtgaacaggcaacctacgaataggagaaaatttttgcaatctacccatttgacaaaggtgtaatatccagaatttacaaggaacttaaacaaatttacaagaaaaaaacaaccccatcagaaagtgggaaagggatatgaacagacacttcaaaaaagaagacatttacacagccaacaaacgtatgaaagaaagctcaacatcactgatcatcagagaaatgaaaaatcaaaatcacaatgagaagtttcagtttctatatatgagggtttagtggtaaactattgtcttagaaatgagtagaagtttaacaggaagttgtcttaattttatgcttgtaatgaaagcacagtttttaatgtagatcttatgcatttatgggggcagctaaaagatattggaaggaatggctaagccctctcacatcatcccaaagtgctgacataggatctacatgttagaaaatatttacgtttccctatgtgattgatattagtacaatgctaaagtaattttctgaaaaaatacaaatataaatgcactcattcaatttcttaagtcaaaataattttgctgatctaatggcaaaggctcttcaaaagcagggtgaagggcataatcaccaggccccaacttgcctgatatagtaactccataaccactcttaccaaggtctataggctatttaattgctttctattttaggttgtagctgtattctttagaatttcaaataaggttttcaggccaaaaggcaatgggagtggcttatcaaaattcagagaattcagatttctttggtgtttgcaggttaatccctttgttatacaaagttgattgacacggaggattttccttaaatcaccaagccgtgcaaggacagtgctaggactacagttgaggtattcagaatccaagaacacctcatgctgacctttaattcctgatccttacaattggttgcatgctgcattttatctagtttcaaaagataataaggcaataaaattaaatattcaaattaacacagaatttttacacatatgggaataattttttaaagctacttaatagaatgattcaatacatcttcctgtgataatggagatgttctttatctgcactgcccaatagagtgaccaacaggcacctgtggctctcgcatgcttgagatatatctagtgcaattgagaaactgaatttttacttttaattaatttaaaatgaattaaatttaaagaaccacatataactaatggctactgtattggatagcacagttttagaatatattttgggacatacactacattatcttgaatagtttttatacttcatggacatcattaggagattgcaaatttatatttccaaggtccataattacataaagagtgctatatttcattaataattaggaaaatacatttacaaatatatttaaaaccacaataagataccatcacacacctggtaaaatcaagtattggccagaacatagagcaagaactggaatttccatacattgctgatggaagtgtaaatttgtacaatctttttggaaaaccctttggcaatatgaactaaagctgatcatatgtaaaacttatgacttaataattccactcctatatataatccccaacagaaatattctatatgtgggcgccaaaatacacgtacacaatgttcattgctctactgtttgtaatagcccctaaatagacacaactctatgtttattaatggcagaagtgtaaatagattacagtatattcatacaaatgatacgacacatcaaggaaaatgattaaaatactggtacttaatctcatgaacataaatttaattacatgaagccagaaacaaaaaaatgcatactttatgaatccctgtatataaagtccaaaacaggcaaagttaacctataatgttaaggaatcaggttgtgataactttgaggggaagaggagcaagcaagagagactttacaggtgcttgtatatcctgtcacctgatttgggaggtgattactgtgtatacagtgcctcctttgtgaaaattcacagcattttatgcttaggatttgaacaatcttctgtccatatgtagtagttgaaataaatggtcaaatttttcatagaaattctattaaatcacatatatttgtcacagcttaaatattcatggaaaacagtcactatataattatgtacattgaaaaatttagagaaaagtgacaaaagctgaaaagtctaagagaatcattttttctaaggctcaaattgccatttttcatcataaaaattcttgctgtgtgtattgtgcaaattttagagaatgcattgtataaaatgagttatgatttcttaatatttcaacataagtctggtatattttatatagcatgaaatagaaataataacatgaagaataataatttcagaaattcaattcacaaaacttagtttttgtgtttttatagtaattttccatcttgaaggttaaaaaggaaaacaagctttagaaatattacttattatcaagctgtgaagtcactaacaaggacaatactttgctaaaaaaaaatcttgtgaaggaaatccctattagcaatttgatgcaagtatagcttgcatatattataattatctaacatttaaaatctctatactgaatttttgcttttcctttggctatgcgcctacttttcttaaattgatttattaatgtccaaggttgctttgcagttttatccttttagcaataatagatgcaatagatcacaaaaacaaatttttaagagaacatcattagagtgatgtagcactggtaataaaccccttcacacttggatgaacttaaatcagtttctctttattgatttttggtcataacataattttaaagttcaactcagttaataaaaaaagatttgcgccggtgttatgggcaaaatacttgcgttgtaagtttccacatcatttgtggaagaatgttatagttgtatcatatatggatcttcgatagatatagcaatgagcatattattttatgataatccttatgtttaatatctttccctctccttttattgatgtgaatctttcaacatccttatcataagatccaatgacaccattagtattcacttcctatttatgcatacgaatgtgtgtgaaagatgtaaaaaatgcaatatgtatcaaatatacacacagtaaatctatttaaaatatttatcttatgcatatcatggcaacattttaactatttttactaataatgtgataattttctttagaatgattttacatctttatgcaggattgtcactcccatgtagagagtgggttgattttttatcttgtagttcattcaaaaagtgtcaaaaatcaattaatgtaacctgtttttaacatgatgaattacagacttatgaagggtctatgccatcaggagaattaatatcttcatccagaattaagtaattgaatatacacaaaaaaagaaaaaaataggttaatatgaactcaaatatgagtgtcaaacttctattgattgctattcttcctgtgaagctgttatctactataattgttctcactttctcctcactacaacatagcagattatatacataacatgttgcccggggctcactcagatatggcccacagcatttataaaattctcagctctcaaccgtaattcctggccttcagtttttcacacaaggaaacctatcagaatgcaagagagcaagagtacactctaatataatcttatatccattctatagtttaaaaaataaattatgcacaaatttccccacttcatttttaaacattccttgcaatatccttcacatgtatgtgttaagattgcagatcaaggcatctggtctgtaatgccttgagcacacaataaagagaaaggtagcatcagacaattagcaaccaatggcttgaggagaattaaaagataattttattattagcttggatgctagaatataattttcattgactgttgttttgacagtgaaaaaggcaatggatacttgctctattttgcagcagcctaaaatgtacaagccctatatcacaatttatctagcaataaaagggtcttctgtggaactgatcagagccaaaaccaaaatttgtctccaatatctttgtgtcatcacccaccaaagcttcttaacatctttgcaagttcaaatgttatttaacccttaaaactgaggttaaatgtgttcattcattcaacaaatattaattgagcaaggcattttatattagagacttagaagaaaaaaaaagacatgaaactttcttccaaaacaaaagggcagacaatttaatttgaaggagacatggagagaatttgttagtataagaagctatgtctctagagggtagccagggtaaggctaggcagacaacatatgtttgagtaccagtttccaaaggaaaaagaaggaaacggttcgatttctcaccgtgacaatctattgtcatcagaacacatcaagtacattcagaggtaatttaaacagacccattaaaacataagctccagaatcataaagaactagtttcaaattcaagtttaaaatactggtcattttgttgagtcttgatagtttttataatttaattaagcttccgtatattaatttataaaatgagattacaaggatttttgtgatgaccgaacaagataatatatgtaaagcccttaggtcttagaacataataaatgcccaataaagtatatatttcttctggtgcacttaaatcttaagacagaatgttgaatcagcacatatcatgacaacccaaagatcaataactatttgtaaattagatgagaaaaaagtatatttattgaatacctaatactgtctgcttgcttctgtgacatcatgtgacatgattattatgaaaagtaacataataagaataaagtagttctttactatagcctcaaagtctccattgctaacgagagctgctttagaaatattggcataaaaccttttttataagttgcacataattacaggatcagctttgggtttcaattggtaagaatttcagttctgtgcggccttaatgaataatatctgaagtacaaattaaattttttctatcaggaggcttattcagaaaattataggccatttattccttccataatatatgagaaagataaatttttccctaactctattcttcaaagagtaaaacatcctggctacagcattcatccctttgttttgtctgtctgtttgtttgtgtgtttgtttgtttgcatccttgcttactattaaggaagcctagatggtaagacaataagaaaatagagggcaaagccaggccatgttctcataagatttaagcctgtgagagaacatccagaattaataatgtgtgaacctggagctagtcaaccagctaattgccttcaacactgttcatcattaatccagagattgccattccattttagttaaataaggaatttcacattggcaaaagtgagtctatagtattcatatctcactctaggttgactgcacaacctcacaggatgccaatggctcatgctggcacatatcaatatcatgggatttatcctggtaacctaggtttgtgtgcatcagaaagatgagtttcatgtatgtttcttaatttacacataatatatagaatggggatattcagatttcccaaagatagccatgtttactgtttttaaagtctcaaaagatgttttaaaagttcaccatatgtactagaacttttatccttgaatgtatatgccattttttttttaccactcaaacgtaaatctacagggaccacacaatgattcgtgtagattccattcctttttatgatgccaaaaatgttttaaaatagtattttctcccccgatttaaagaaaggaaagaatagagattttgtagaatcataaaatcatgaagtgtcagagtttacagattacaatctaactacttaatgttaaaaatgaaaagaatgagacccaaagaagttatgattttaaaaaattggtaaatggtagaactaaaaccatttcttattttgtcctctaaacattattgcatttctgaaaagtatacacatatgaattataaatggtagggtgaagtttgtataatgtctttttatagcaatcaataaataggtgactatgtcacatttatactgtaattctgatgcacacataatactttaaaaactgctaaacaagcatgtcagaaagacctaaattataacatttttctatattatttaataaaaaataataagatttttaaagcaattccctccacttgtgattgacaagatatactatgattccaaacagtccaatttttggtcaccttctcccacttgtgttagttaaatccagaatggggggaaaaataaaaaatctaattatattattcatgctagccttgtatgcagcattcctctgccccttactgagcctccctagaagctagaaagagccaatggacaactacatcacacacacaccccatatcctgatcattcatccctgaaattatgtattctttactcctataccttataaacagtagtgtaaattgtgtgcatggccaaattcataacacaaaacactcttaggagcaaaatagaaacctgcacaaaccctctggttttgtcaatgaaaacaaccttttattataaagtgacagttttataacttcaaaaataggctttaatttttatagaacatttaattcaggaatgaaaaatgtatttttatcaacccgcaaaaaaaaaaaaaagtgggatttttcatcagtgttgccagaggtgaaggaaatttacatggtgaatgaagtaaaaagcctatttcaactatcacagtaccttaaggatgaagaaaatagttttaattttggataataaatcacttttgtagcatttcaaagatcaagaaacttgcttatcaaaacagaatgtagtcatcataatgcaaagtcctcaggcaatgagaattgcagtaaaatctttttctccttttataactggatcaatatttttgagtatataagaatatgtactcattaaatcactttcacctactatatttcatatttgctacaaattacttaatgtcacaggagactggaagatctattttaaatctaaacacataagtacactatcaagtggacacaaataagcatacacaaagaaaaagctttttattcgccatcccaaatgcccagcattgctttgacctagttataaaaaccagagatttggttttatttcccagcctaagagttaattctgatgattttagcagaagggaatgaataggaatatagcattctcctaagacctcttgttcctgggataatatatagcaggtgctgacttcttgtgtgtatccctagttcccatcttgtttgagatggcaacagatgatatgttaacaatgaccaaccatttgccaaaatgtctttgcacatatttttctctggctggaaggtccttccctccctgctatattcaattaaggctttcttatccctcagtgttcagtcaaataataatgctggggtaaaattttctgaccaagctatatctcccaatgatatactttcattgttccatgtacctctgtacttatcctgttgttaatgtgtgattgatgaattaatatcttacttctccattatgatctccatcagcacaatgatcatatttatttttgctacttttgaggtctctggcttctataaaaggatgtgaaaacctagcaggtgttccatatatttatttgaaaaatattaaacatccaattcctgacattttgtccaacccagtatgtaggtgacttccacacaacctccctacttagagacttctgaaagagcaattgtatctcatactctgaaccatggatcatgaaacagggggtggtttttgagtggcagtctccagttgcaaatatataaatctaagcattacaatgaaagtgcttggagtttatagtgttaggggccacagatctgtaatgcaatttagatgtcagctgctagaatcaatatgaatgatcatatgctcaagagactcatgtaattactaagcattaaatgaatatgtaactttcatcaatatacattgtatttctttagcaacaaggatgttcttgttaaaatttacattcaaaaattgctatgcttgccatttggcagatccacaaagagaagtataaaatcagagacccacacataaggtataggtatcagtcacctaatggtatggcagcagtcaggtttgggaatacagacatctcactgagtttcagaaaggtgaatgtaactttcctccaatagctttatttatgccaaagacatagataaatatactgtatcacttaacatcctcatttaaaggtcctccccctgttgccatgaagatttgctgagcaaagagggaataacaatctgtgcctgtcaaaaacaaaatattcctgggaaaaataatccatttgaaaatcttatcctaaattttatcataaaattctttgcttgtttagttttcctcttctgtaggagagtctcatactactactattccttgatgctaacaggagacccaaatgtgactttcctcctagcaccaacactataattatacctcacctatgcctgatttattacttctatatcctccaaaaacggttctctatctcttgatatttgtaaagaatattatataaaaattataaggtaaggccagcttcttaattctctttttcaaagtatccacatctacagtatccgtatgcacagtgtctgaagcatagtatgtccctcataaatacttgattagtaaattgagtaaacaattataatagtagctttttagtttataaattcctatataaaggaactatatgctaagtatataagtggattattttttaggattatcatatgtgtcatgttttcactatctttgtattccagcagtgctgaatgactatattataactttctgttgctattaacattaatgctttattatcaggaaattcacaaccagaaatgaggagtacgggttaatggtcaaaatcagcagcaaacatttttaccattctaattgctgtcaatatattctgcttccttaaaagctctcattcacatttaaaaaattacacagtatatgaattttagtaaataaaattaattccttaataaatgaattagaaaaaattaagagaaatcaactcactccagtctggtattagctccaacactactcttgcttaagttatcaatgacttttttactgccaaacctaacggaaacttttcaattcttaacctacttaacttttttaaagcagcatttaacacaaacactcttcttaatatactatattcgcctggttttcatgacaccatattctcttggctttttttttaatcatgatttcccactcttgctcctttgggtcccagtttaaatgtcacttttaagtctttcctgatggccttgaactaatttgaattttcctctttaataaaactgcagtttaccttcatagttgttactaatatttcctaattttgcatattttggggggttgttacgtgtttaatgtctttaccccatacataccagactgtaatctccagaagagatagtactatgtttattttgttcagaaggatcttgcacttaattcaagaatatttgttcaatgattattggatagataaagagtcacattcctgttagtgtctttaaagatgcatatgcttttgctttttaaactcattaagtgcctcttatatgcttctctctacttcatgccctggcccctaaaccctgaaactggtttaaaataactcttagggggctagggttgcaatatttggggcatgcatataaaaacacacacttatacacatatatacatatatccattatttatctgaaaatctaatttaactagacatactgtatttctatttgttaaatctggaaactcatctgatcccatttactagtcaagtaatgtttccctaaaattgtgaaaatttggcttgtttcttaaatacaatactgtttcacagctctatagttaccttgcatgaacctttattttagcaatatccttattaagcttatatatatatatatataaaattgtcttttcagcaagatagatatatacctatatttatatcttcatatatatttatcaaatatatatatatatattttttttatttatatacatttcttgaaggtacttcttgtcctcctgaaccaaaagttcattactctctatcttgttcagccacacacagattcaaattatataatggataaaaattattcacatgtttttcaatgatcaaatcctcaaaatattgaggaaatgatttagcatttaatttggaaagccactgtgactccatgtttgtaaatgccatagttacctcaaatctatctttgtgttgcattctttctagctttccccttaagactttaaaaaattgttatttactctcttcttaaaaattatttttaattaatattacattggtaaatcactgtcatctgatatataagcttttatcacccaatgtaacactatcacactgaactagaatatttttcattctctcattgaaccatcagtgtttgaatttagtcaaagcctggaaaatgaatcctgagggaataaatacttcgcatagattaccttccagccaacacaacgattaacagacataaggcttgtagttacataaaacatctgtaatagattgcaaaatttctgcatttatccagtagtattcaaaattttacaaaatttttattttatgcatataagcattatctgaatctgttatatttatggatcaaaaactttaaatgatataatcaatcatgtttattctcatacaattaaatgcatttttgctatgatttttgttatttaaatgtaaatttacaccaaataaaaagccagttcaagaattttatcaatttcttctctctttttcagtctatatgaacttcattgttccaagacttgtaaaataaagttgaagttaaatgtatcaagtcaagcaaagtcagcgtactgtgactttatatttactatcctgtagttctcaaataaaggtattttcatttggatcatgagtttgacatctagaaataatgtgggtgggatgaaaaaagctatattatatttatttagggtggggagtgaagataatgaagccaagattgctggtataaataaaaatgaaacccaattaacttctgctgccagctgagcaaaaaagggaaaggggagggaaaaacgtattgctcttttgcttacccatttattcttcacacacacaagaaaaggaggagatatattaaatatgtctatcacactaatatcttggcaacaaccctaagagaacaattaacccccttcccactcccagctgaaaggaagaagcaaacatcatggtggcagccaacacgtagcttaaaaaggcatataacaacgaaaaagtaaggaatttaatgttactactctcttctaatgtgaatttggaaaagatgcaaggaagggagcacagaatgatgtaactgaaaatttactgtctgaacaagttttttttaaatttgaaatattttgaatttgcatttaaattttaagaatttgttgagtcatacattttatgaaaatataaaataaaattttaagaatgtgtattatcatgctcttgttctttatactgttgaataataattctaactagcacactaactaatgtcaataaaaattcaattttttcctgaaccattttttattaaattagctctatatttgctatatgccaatccatttatattttgggtttcttttagaagttatatgaaagtttttatgtcccctttttcctcctaggattttaatacactttactatattaaaactttcatcctaaaataatttttacagcttctctgcttagaaaaattgtaattgttctgttaataaatccaactaaaattagaaagtgaaaaatttaactaacaaataatttttgttactagttattttgagaaagcatcaaccctaagagtttacaaaactaaatatatgataaggaaaaaaatgttttatcagcgttggggagataatttcttcattgctaccatttacatgaggctggaataaattttctggctagaatctgaaaagattcattctatcataactgtgcttgatctttcgaattatgaaatgcctcattttctgtcaaaaataagtttgaatcattttattgtcacaaaagtaaacaaaaatcactagtattttgtcattcggcatgagaatatctatcctatagaggtaattaggatttgctgaaaacaatgtatttaatgtgtagatatataattttcatatgtaatatttatatattatatcacataaaatatttaataattaaattcatatatattatacaataaatgggaactttacattcaatgttttcctataggacacttttactattcttccctctctcactgcttccttctttctttctctttaaattatttccaaagttacatggtccctataacaggctgaatcctcagatgacccccaagaatcctgctctgtgttcaggctgtgtgtaatcccctccccttgagtgggtatgggtcatatgaatacactgtagtttcattcccagaagtatgttattttctgctgtttggaagatattttgcagatataattaatatctcaaatcagttgactttgatgtaatgaaaagggagattatcctggttgagcctgatctaattgggtgaatctttcaaaagtcagagagattcaaatcggcaaagatgctcttctgttggcctggaacaaagcagtcatgttgtcaactgtctacggaggaagctatatggctaggaccccagaatggcctctaggtttggagagcaaccccaggctgttggccagtaagaaaatggggatccttgtcctacagctgcaagaagctgaattcttccaacaacctaactgagcttagaagaggacatcagtcaccagatgagaactcagcactggctgatatctcagtttcagttttgtgagacactctgagcaggatctagccatgctatacctgtacctctaacccatgggaattgacatagtaaagacatgggggggggtttgacccattaaatttgtgataatttattacacagtaatacaaaacaaatacaatcccaatgctttatctaagtcatagaaattctgttctctaggaaagaaaccataattatatagttttaggaaaatttactaattcttatttctatccaatggagaacaatcactgataaacttgttacttgctgaaagacagtgataactttatactactcctttatatcagtctatctaaataccctcagagatatgtcatattagtctatgttatatagaacataaagttgctttttttaatctgtcttatcagtcttatcatataactgtcatatgcaaaaataaataaatggaacactaaaaagttaatgcaggcaagtcaagctcctaaattcatagaggttgaaattcctaaaaggactcacacattcacagcaatcaggaatatcatatacctcctttaagctatttgtggatttccattaatatgagggaacctagttcccacatggaaatggagatagattctaagaaatattttcacaggcccgggtgcaatggctcacgcctgtaatcctagcactctagaaggccgaggctggcagaacgcttaagattgggagtttgagaccagcctgatcaacatggtgaaaccccatctctactaaaaatacaaaaattagccaggtttggtggttcatgcctgtaatcccagctacttggtggctgaggcaggagaattgtttgaacccgggaggtggaggttgcagtgagccaagatcagaccacagcattccagcatgggcgacagaatgagactccacctcaaaaaaaaaaaaaaaatcatatagtaaaatggagattacaagcagcaataagcagcaatatgaacctcaacaaagcttcaggaagaataatctctacacatggaaagcagactcaaaacctgagaaagtcatgattcccacatcccctttttgttcagaaaaggggatatatgacgagctcttctatattcatgaggtgttaatctttcctgaacaaagctttgctaaatacatgtccacctcagtatttctttcagcttgtagataatcaacgattaatttgaatagttactttatatattgagaaccaattccttcaaaataactgctttcttactccttttttctcctcttaaccaatgaacattaattgagcatccagacactgcagagcaccataaaaatagaaataaagaaatacattataagtaatcaagtctttgaatggtgctatgtgctatttccttacctttagctttaaaaatccaaattgtttttatcaatatagacttttataagattaaaggccgtggacaaggaggagagtttaaatgaaacctgatagattactgtccagtataaaaaaaaaaagtcttatgggaactcactttgaatgaaaatcaatgcacactcacatagcataaataataatgagatttactgtgatgcgacagcatgctttggcattgtgctgtcagaggcggagagaactcatggctttctgccaatcaagctgagcttaaagggcatgtcgcaatgttcagatcatgttacattaatgaaaagattacacaaaagagaaacagatatccctgtttcaatattctatgaaaaattataaaatactccttttcacctccccctccttggtttgtgtgatctttcttctgatttctatatataaagctagaaagcaccataaagattttaaaaataatcaactttggcaactaatcctatttaactaaaataaaagaagtatagataatcatctaaaaacttctgatgggaaaattagaagaagatgacaaaaccagtgtaaatttctgtggaggttttcaaaccccaaacctgaactttagatgatttgagaattataaagtggtgaagcctcctcagagaactcaccctgtatacacagtattgagttatgatatatcttagagtacaataccatagagtggaggagataatttataattaaaatcacatatttccaatagaattatgaatcttcaaggtcttcaatggatattttaattcacacattcattcagcaagaacatttttatgggactattgtattcatagcactgcccagaattataatattggagggaggcagaagcagtaaagactattttcatcctgcagagcctaccatgtatgtgagatggcagataaaaaaaatatataaacaaaaaatcagtaaaccccaccttgctgctacagtgcagtggaaagcaaatggagaataagtgtgtgtccgtatagcaccagttatctggacagacaaacaaaacgtcacataatcaaccagatgatgatatatgcaatggcaaactgccacatgcaccaaagcttccaaattgtttattttttttctgtaaagtttagagtcatctagacaataaatttcaacaaattggatcagctaggctaaaaatttatgtatatgtgaagtatgctggcaagttaacaatgcctgtcgtaaaagaactggaatctctgtacttgaaaaatattgacaaaatgcccaaggaagaaagggcagcatgagctctgtgtattggcttggaattggacatatcagtatggattcatgggaagagagagagacagagcactgtaagtgtgtgtgacacataggtgaataatgtacagtgttgcaattaaggaacacagtctaatgtggaaaatataatgagggaaaccttaacaataatagagaatgacaaagttagaagagagggaaacagaaagcactgtagaagcagataattagaacaactaaccaagtaaaaggggaaaagagggctcagggatcattcaaataaaaaacaaaaagatgcctcggtgaagtctggatggactcaagtcagagctgagaaatggttggggatatttgttgctgatgggcaatggtgctctaggtagaaggaaacatatatgcaaaagtgcatagttaatgccatagcctgttccatttgaaacactgcagaaagggatgaaaatgtgggaagaagcaacagaaaggtactaaagggccagtaaatcaagctcagtatttaacttttccagtgaagtcaaagagggtcataagagtactgaagaaggggtgtgtcatagtcaggttcaattcacagacatctctctggcagcagaggcttagaaagaggtaagactgaagctagaagggaagtttagggctgttacagcttatccaggtgataaataatgaggatctaagcaacaataagtggttctggaatagaaaggagagaaggagagacttgctatatgtattattttacagtatttaatgtttgatttcatgtagaggtgagagtcaaggaatggaaaacgagtcccattttcctgactcatgccattctttggatggcggtcctattaaaatgataaagaatgtagagaaagaaggaagttataagaggaagattatgactgttggccaatacctaagcaaaatgcgatagaaatgcacagaatgaacagaaatcagaatataggctacaaccgccaggtgcggtggttcacgcctgtaatccaagcactttgggaggctgaagcaggcagataacctgaggccaggagttcaagatgagcctggccaacacggtgaaaccctatctctactaaaaatacaaaaattagctgggtgtggtggtgaatgcctataatcccagctactcgggaggctgaggcaggagaattgcttgaacctgggaggtggaggttgcagtgagctgagatcacaccactgcattccagcctgggcaacagcaagactctgtcttgaaaaaaaaggaaaaagaatatgggctacaacatggaagtctaagtgtaggtatgctgcaaaactattactttatccataataaaatatgctactatctcagttaattgatttccaatggattttgtattgtaacagattcaaaatttaaatgcaaaattggctttcagaggctattgaggtaaaatatatttttgtcaaattgccaaattcattgtcaaacaccatcacaaacatcatcaagaatattccattttcgaagtaattactgttttaaaatgttaaaatacagaaaatatgtaccacacaactgtgtctaggattcagatgaattcccctacttaaatgtatgacagtgcgtatggttttctgaacatatattttacaaaatctacgtctatataatatgaatcatactacttattcaggttatcttttatctgtctctccatctgcccattcatctatctactgacataactatttaaaatcaggagttataatacaaaagtttttcactaaagatcagcatgataaagagtctagagtctcaaaaatccaatgagcagtaccttcccaggaatcatagggaaatgatgtacttattatggaacttttaaattagattatacataagttgataccattaaataaactaatttgattcactgatacctaaaaaactttgcaaaatactgtcatatttacccaaatttaagaaatgttgagttatctttctcttgaatcttcgaaatacagttagagtatagttagggtgtagatatgaacaatgccagaaatgtttacctaaataccttatttcaatgatttggtcttccaaaagtaactactttgttgtttcagaaattttttcaagaagtgttacagaacatcagagataactagatatttcattacagacatgttttgaaggaacgatttcacactaagaatgaagaaaacaaaaatccagtcatctcaaacggacaaaacctgagggtgtccgaaaggaaaaaaaaaacaggttataaaaccttttcacttcatttttgacatgttttaagtcatttgtctggactcctgatgggcttaaacctaaggagacctggaactttaaaaagaagaaaatatttttctttccatctttcattacttcagactgaaacggcaaagtgcccatgaaggtgagtgccagaagcagcattaaaaaattggctcttgttaaatgccttcaaagaaacctctgttttcatcaggaaatggcaattacatggataacatggactgccaaggtttattctgaagaagagggatggtccatattgtggatattttccttatgtttattaacacttcataaacagtcaggtctgatagaagcatatgacaaaaattaggatagataagacccagaactatacatactgctgtttttttatccctatagtttttactcctcctgtagtaacacaactaataccaatatgcatgtatttattttgacaaagtcttgcaatcaactaggataaaaaaatgctttggttcatttttctactaacctttttcttcattatttatttaacaattcatttttcaatctcccttttaagtgaatacaccaactgtatgagtgaaataattttcttcatttaatctgaagcttttacttattgtttttatgaccctgaatgatcttagacatgtgtacttcgcctcagatgaaaggcagtatagcactgttttagattcgaatttcctgtattatctgtgtgacagtgaagaaattaattaaactctttatgcatcagtcttctcatctgtcaagtgggtttgataataatagtactttttttctcaagggctgttattataatacaataaattaacatatttatcaatgagttaatatatgttgtttttatatgttataaagaaacattatgaagactacataagtgtttcataatgcttaaatattctaaccttaatgggaaactcagtgtttcctgctctttgattccattttcaaagaagaaatgctgttaaataaaggctttgaaggaaaacaataaatctacttaagtagatataagagttttcaggggagtaagtaaagattttactttttactattattattattttgagacagagtcttgctctgtaacccaggctggagtgcagtagcatgatctcagctcaccacaacctctgtctcctgtgttcaagcgattttcctgcctctgccttctgagtaactgggactacaggcgcctgccaccacgcctggctaactttttatatttttagtagagacggggtttcaccgtgttagccaggatggtctccatctcctgacctcatgatccgcctgcctcggcttcccaaagtgctgggattacaggcgtgagccaccacacccggccgggagtaagtaaagattctaaatggaagtgaacagaatctcacttttctttctcttctactcacatagatagcatggtaacatgagacatagcagtgcctccctttgggaattgtccccatccttagaagaccaagaagaaaacagggtaagatccctgaagtatcatttgtcccttgcgctacagagatttttaatgcaattattaaaataaaattcaaaagcaacaaaagttaaaaagaaatacttactgtaaattctagacagaattggaagagatcttcagggcaatacttattcctgaatgcattgaaaagtccacaaatattataagagatcagaagaagatacaagttgggtaggtccaaaagagattggaatattcaggacatgctattggattccttttttaaatcactatttttgagatccacttttaagaataatattaataatgatataatgaccatgctttacacctgtagaatgtactttctagcaaaatattttacaaagaaaatagggttgagagagtttcacttcagggaaattcataaatcttgaaatccactctaaccccactcatttaggagaccaagacttatgtggtgaggtaggtaggagcaaaatttcatttgaaataactatatatgtatatatttgaaagctttcctataacacttataaagctcattctaagttatttttcatactattttcaaaattttaattcctgaaatgattacgttagcctccttaatggatatgtttttactgagtattatggaaaggcaaatataaccagtaagttgatattaagaaacataaggatctgagttctaaaataacaccttaaacatgccgattagacagatttatcattatcacacgtttatatttacttttattaaacactcaatttctgttgacttctttttaaaattttgttagaaagtaattcacataagagaatctcattgagatgcagcctcttgtgttctataatatgttggttttatattcccttttaattttatagcaggtttggccaaattatgagcaagtcaaataatttgaccaaagccaagttgagttggtaattctgtctacttacacttttgtgcatgtatttatcttatttgggagtttgcttctttctacatttgacttttcatttgtgattaaaagttatccagagttctgtcctaaattaacagtatttctctagatgtttttgtatatgtctctttgcattatttattattattattattattattattattattattattatgctttaagtcttgggatacatgtgcagaacgcacaggtttgttacataggtatacacatgccatggtttgctgcactcatcaacccatcacctacattaggtatttcttctaatgccatccctcccctagcccctcaacctctgacaggccctgttgtgtgatgtttccctccctgtgtccatgtgttcttattgttcaattcccaattatgagtgagaacatgcagtgttgggttttctgttcctgtgttagtttgctgagaatgatggtttccagtatcatccatgtccctgcaaaggacatgaactcatccttttttatggctgcatagtattccatggtgtatatgtgtcaccttttctttatccagtctaacattgatgggcatttgggttggtttcatgtctttgctattgtgaaaagtgctgcaataaacatatatgtgcatgtgtctttataatagaatgatttataatcctttgggtatatgcccagtaatgggattgctgggtcaaatggtatttctggttctagatccttaaggaattgccacattgacttccaaaatggttgaactaattacactcccaccaacagcgtaaaagcgttcgtatttgtccacatcctctccagcatctgttgtttcttgactttttcatgatcgccattctaactggcatgagatggtatctcattgtggttttgacttacatttctctaatgaccagtgatgatgagcttttttcatatttttgctggctgcataaatgtcttcttttgagaaatgtctgttcgtatcctttgtccactttttgatgggtttgtttttttcctgtaaatttgtttttctttgtagattctggatattagccctttgtcagatggatagattgcaacaattttctcccattctgtaggttgcctgttcactctgatgatagtttcctttgctgtatagaggctttttagtttaattagattgcatttatcaattttggcttgcgatgccattggtgtttgttgttttagtcataaagtctttacccatgcctatgtcctgaatggtattcactaggttttcttctagggtttttatggttttaggccttacatttaagtcgttaatccatcttgacttaatttttgtataaggtgtaaggaaggggtccaatttcagttttctgcatatgactagccaatttccccaacatcatttattaaatagggaatcctttccccattgcttgcttttatcaggtttgtcaaagatcagatgattgtatatgtgtggcattatttctgaggcctatgttctgttccattcatctatatatctgttttggtaccagtaccatgctgttttggttactgtagctttgtagtattgcttgaagtcaggtagcatgatgcctccaggtttttgcacaggatcctcttggctatccgggctcttttttcgttccatataaaatttaaagtagttggttttaattctgtgaagaaagtcaatggtagcttgatggggatggcattgaatctataaattactttgggcagtttggccattttcaggatattgatttttcctatccatgagaatggaatgtgtttgcatttgtttgtggcctttcttatttccttaaacagtggtttgtagttctccttgaagagtccttcacatcccttgtaagttggattcctaggtattttattctctttgtagcaattgtgaatgggagttcactcatgatttggctctctctttgtctattattgttttataggaatgcttgtgatttttgcacattgattttgtatcctgagactttgctgaagttgcttatcagcttaaggagattttgggctgacacgaaggcgttttctaaatatacaatcatgtaatctgcaaacagacattttgacttcctctcttcctatttgaataccctttacttctttctcttgcctgattgccctagccagaacttccagtactatgttgaataggagtgatgagaaagggcatccttgtcttttgccggttttcaaagggaattcttccagcttttgcccattcagtatgatagtggctgtgggtttgtcataaagagctcttattattttgagacacattctatcaatactagtttattgagagtttttagtatgaatgggtgttgaattttataggaggcctcttctgcatctactgcaataatcatgtggtttttgtcattggttttgtttatgtgatggattatgtttattgatttgcgtatgttgaaccagccttgcatcccagggatgaaaccaacttgattgtggtggataagctttttggtgtgctgctggattcagtttgccagcattttattgaggattttcacatcgatgttcatctgggatagtggcctgaaattttcttcttttgtggtgtctctgccaagttttggtatcaggatgatgctggcctcataaaatcaatcagagaggagttcctctttttcgattgtttggaataatttcagaaggaatggcacaagctcctcttaatatctctggtggaatttagctccgaatccatctggtcctgtgccttttttggttggtaggctattaattactgcctcaatttcagaacttgttatcagtctattcagggatacaacttcttcctggtttagtcttcggagggtgtatgtgtccaggaatttattcatttcttctagattttctagtttattagcttagaggtgtttatagtattctctgaaggtagtttgtatttctgtgggatcagtggtgatatctcctttatcaaattttattgtgtctatttgattcttctctcttttcttctttattagtctggctagcagtctatctattttgttaaccttttcaaaaaatcacctcctggattcattgcttttttgaagggtttttcatgtctctatcttcttcatttctgctctgatcttagttatttcttgtcttctgctagcttttgaatttgtttgctcttgcttctctagttcttttaattgtgatgttagggtgttgattttagaaatctttcctgctttctcctgtcggcatttagtgctataaatttccttctaaacactcctcctttggaggagaagaaatattatcacttttggaattttcagcctttctgcgctagtttttcctcatcttcgtggatttatctacctttggtctttgatgttggtgacctttggatggggtttttgtgcggacatcctttttgttgatgttgacgctattcctttctatttgttagttttccttttaacagtcatgcccctctgctgcaggtctgctggaatttgctggaggtccactccaggtcttgtttgcctgagtatcaccagtcgaggctacagaacagcaaagattgctgcctgttctttcctctggaagcttcatcccagagggccacctgccagatgccagttggagcactcctgtatgaggtgtctgtcgactcctgctgggagatgtgtcccagtctggaggcacgggggtcagggacccactgaggaggcagtctgtcgcttatcagagctcgaatgctatgctgggaggtctgctgctctcttcagagccagcaggcaggaacatttaagtctgctgaagctgcacccacagctgccccttctcccaggtgctctgtcccagggatgtgggagtttatctataagtccctgactgtggctactgcctttctttcagagatgtcctgcccagagaggaggaatctagagaggcagcctggctacatcggctttgcagggctgcagaggactgtgcccagttcgaacttccaagtggctttgtttacactgtgaggggaaaaccacctactcaagtctcagtaatagcggacgcccctcccccaacaaagctcaagtgtcccaggttgacttcagactgctgtgctggcagcatgaatttcaagccagtggattttagcttgctgggctccatgggggtaggatccgctgagctagaccacttaactcctgggcttccgccgcctttccagaggagtaaacggttctgtcttgctggtgtttcaggcaccactgaggtatgaaaaataattcctgcagttagctgggtgtctgcccaaatggctgcccagttttgtgcttgaaacccagggccctggtggcataggcacccaagggaatctcctgttgttgggttgcgaagactgtaggaaaagcatgcatttgggccggaatgcaccattcctcatggctcagtccctcatgattttccttggctaggggagggagttccctgaccccatacactgctgtggtgaggcaacaccctatcctgcttcagctcacccttcactgggctgcaaccactgtctaaccagtcccagtgagatgagccaggtacctcagttggaaatgcagaaaccacctgccttctgtgttgatctcgctggaagctgcagaccagagctgttcttatgcagccatcttgctagccacctgcattattatataaatttcaaacttaaatagtttttaaaatgaagagcttgattgaaaactatatattatattaaaactaaataaatttataacatagcttttccaaagagaatatggggctatatctcacattttcaaatgagtctcagaaccatgagtaataagaaataaaaagatttcataatttttaagcaacgagtttaaaaattttaatggtaaatgatacagctatcagcaagacttttatgttgccagcaattttttttttgtttttgtttatttttcaggcttcctatatctcatgtcaaatataatggcttaaagaatctgaaatgtaatattcgggtcttatgtagagtgctaagtatacttactcccaaaaatcttcatgaaaagaataattgaaagaaaactgaatttggagtctgggcttcaagttctggttcagttcaaacacttattaattaatggcctttattaaatcccttaatatcactgagatttaatttcttttttaaaattttttaaagagatagggtcttgctctgttgcccagcctggagggcagtgattcagtcatagctcactgtagccgcaaactcctggatgatcctcctgcctcattctgaagtagataaaactacaggtgcatgccatcatgcctggctatatttttttatttaaaaggcaggatcttgctatgttgcccaggctggtctcaaactcctgggctcaaataatcctcctgtctcagcatcctgagtaggtgagatgacaggcatgacccatcacacccagctagatttaatttctacacatacaaaaaggagtaattgcatatgccctacatttctgacatggttgtgtgaatgttacatggtacaatttgtagcaaagtgttttgtagggagtaaatcaccatccaaaatattatcaaaatagtgatttctacctcagtcgtgttcctaaagctactcctgaaggtaattttcatcatcttcctctgaactagtgagaaatttttaatgtggcttccagtcccactgctacttattactctcaagctatctgactgagctgaaatctattcaaagtacttccttgctggagaggattgcttttattcataatctcaggtctgtctccacttgaaagcacaattcaactttattaggaggtttttgtaatgataatgtggtatattccttcagacataaagaggtatgaaatagaaaattatgctaatatataaaaacaaaagcaagagaaagacaagaatgtttttatcctgtcagaactctaatcctaaaggaattaaataacaagctttttagagggggaaaatcaagttaaatcgaaaatattgttatacattaagaggcaaactaatacacaaagaagtaaaaatgggaagtagcaggatcacctaacaagaggttctaaaatccaaatcttagattaaaatgtgcatattgttacttctgtagctatggttagacacctgagtcattctgaggtgcttattgtgaaatcttgtactgatactcgtagcaaattaaatgcgtcttatttgatctatttgatcttccatgaggctagggtaagattaaataaaaagaccatgaatgtttgcttttgatggggttcagcaacactatcccaaaatatggtaccttggctttttagaaaaccgcagaagcaaaaacgtcactctcaccttcccctcacctttctcctttgaagcagatcataacacacttattggagaggtgcccttcctattctctaaggaaaagaatatccttatctctaaagacgaagggggcaggagctatggttcacgtctgtaatcaaagcaccttgggaagccgagatgggcgtatcacgagaccagcctgaccaacatggtgaaaccctgtctccactaaaaacacaaagaaattagccaggcgtggtggtgcacacctgtattcccagctactcaggaggctgaggcaggagaatcgtttgaacccgggaggcggaggttgcagtcagccgagccgagatcgtgccattgcactccagtctgggcaacagagcgacactctggctcaaaaaaaaaaaaaaaaaaaaaaaaaaaaaacagaaaaaaaagaaaaaaggacagataattaacagaatcaacaggctgtgctaagttccccccagtttattgccattagatcatatcgtttgcctttcagtaatatttgtccacaactgtcccttctttatcaaacctaagcataaaatacacaagttcacatctttgggtcttgatgttaaaagccttccatgtcttgcaagacggacatttctcttattagtctgcctcttgttatagggtcctcaaccatggacatagtaatggataaggaaataaattttttcctctcctatacttcaaattatctaaccatggagaaaattggtgatgggcatttgaatgctttcttgaaatcagatataaaaatgtagatttatttccaggaaataactagaaattaaacttatttccaagtaattaataaaattaaagcattcagggctatgcatactgcctcatgcctgacattccagctctttgggaggttgaggcaggaggttcgcttgagcccaggaggttgaggctgcagcgggctatgatcatgacactgcactccagattgggtgagagagtgaggccctgtctcaaaaataaaaaaataaaaaaataaaaaaaattttaaaaccattcaaacagtagggaagagaaaaccttggaaatggattcaaatctttatactacatctttatataacatctatatataacatcatcaaaatgatcttaaattgtataaagcatgtatatgaaacaggtccaagattttattaacttacccacactatattaagaaacatttaacacaggtaataaccacattgtataatttcatctgattgttaatattagctattatcttagaaactaataataacaatgtttctatccacagaaagatgtaacaaattccagtgcatgattctgttgcttttcccatcattggctttggtgtgcaatatttttccttggtaattattttagttgagtattttcaatatttgcgaccatatcttttagttatttgacatactgtctaaaatcagtaattttattgctttggtaaatctacctattatttctattttccatttaaaacctcaacaaagtaagtgtttgtatggcctagagcaacttaatcttattttcatcatgtttctatttaatgtgtatatgtattttcatgtgccatgtgaattgattcaacatattaataacaagatgatctaaatttattatataagtaataaaggctaaacatttatcaacacaaatgagtccactagaaataggagtcataatttgatgaatgaaaaaaaattcaaatatgatttttaagccataaacatttttatactaggacattttatatgctatagattaaaatatgaataatcatcatcatattggttttacatttccaagttaaacaaacctcaatctcaacataacaagatgtttagcctaaaaccttacaattttatatacctgatttaaatcagattcaagtaggcaattttttccaattatattaaggaaaacattcctcttgttaaagaagagaaagcattaatatttaaaagacatagaatattttattgatttgatcaagtagttccgagtcctagttataattttaaaatatcttagtaacattttattaaaattcacctagcatagacatatgaaactaattgatactatattttattaaaacatgtacaactttacacagtccctatgaaaataactttagagtcataaagataataatggtaattataataaacaatctctcatctcaagaaaatagtttgctttaaacccatcaagatcattagcccataaacttgatcttattggtagaaatttccaatgagaggtgaaaatgtagcttaatattaagcagggaaaaataagtgaaagtgtattgataagttttgtcaatttaaaataacacagagataatccttattcagttatagcatgttaccatgagtgaaaaaacaaaaaaaaaatacactgaattctcaaatttgtattaaaggtggcacagcaggttgtaaattttaacataagctggtactgcatgttttgttttttagcatttaaattgtggcactacaatttggaagctgtgcagcttgttactccaagacaaatctcacctaagaggatatggcagccttccacactgtggtctgattgcattagaccaagtacggctaaagaaagaaatattttgacaggggagattgcacttgaacacatcaaagtgtcagttcagatatgtggcatctgaaaagcaccctccccttttccccattgcatgaaatttgccacctctcattgtctcttccagatggtgtactgagttctcttcagctttattcctagagagctcaagttgacatcaatctgttatgccattttcttgtaatactaatgtggcttatttatcaatgccaattaatcaatggcacagaacgggttcttccttagcagctaatgttgtttcatttttttaatattcaaaaaaaattttaagggcagcgaccagattgggaagccacgcatctggcagactgtggccacttaggaggcattcaactgatgtaaagatgaagccatttatttcaaaatatgattaagaagcatattgggaggttattatttctagcagaagggtgagagtaattctgtgagataagaagaaatttaattgttttgtaataacaaatcatgtctgtcttcatgaccttgtatcaccatataaagaaaaagaaaagcctatcatatctgtaaatttttagctttttattaatcttactgcagcatcactgcacaaaagatataaagaagtccccacatctactacagttatactttatcactgtgatcttctttttttcagagtaaatatactgtaggataggacttatataataagagatacccaaaatgttataatattttcaggcaatctagattactgtaatagttgctctgaatttcagttctgggggtcatatcccaatcacctactttgtgggccctagaattagggcaaaaattacataagatatcaaatgatgccaccatcgatggaataatagctattgagccagattccccaattcaaacaagaaaaagaagaagaaaaaattactatttagcatcagtaatttggatctaataaacaattataaaaatgatcttaatgatccctagttccttcaagtagcttatcaacctcattatagttgtatgaggaaaggtgtactttgaaaacattagaatggaatatggtattcaagttaatttagtgtaagcattctaaaatcaatattttgtactatctacttaatattgattatgtacacgatcttctaggggaggtcctagcagtgtaaaaaccttacggtttcaacaatatgataaagaaaatatgagagaaagagagactggtataattcattaataatgaataatgggcatattaacaaaaataatttttcatgatacatagacatttatgaggtatgtggaagaaaataaataatgaaatcattttttttccattgtaaatcaacctcataagtccatcctttttacccctgacttccaaaggcaacacggaggaagtctagccaaaagactgttagttttactctagaatttgacacaaaatgaaattcacgggtcatgacaggagcattctgacaagacatacaactgtgatcttgcctttgaaaaactctgcaaggcagaatttgagatcagaattaactaaaaatgttaaaaagttggggaatgggcattgagaaagtaatttctgctttacaacaaccatgcccatcttaacctgtttatattttcgagcacttatataaagagagacgtctaggagaaaatatatttctctaaaccttctatttcaccatatgttttatttgacccataaactttccctttctcaaactttatcatttccctcatgatttgccattcctctcaccttgcaccaaagcaaagaaaatatcttttcagattttatctatcttctacagtctggtttaactttcaattcttccaaaaccttgccagagaatcccaatgatctcatcccactttctaaatatgtgccttgtttccttcctctataataattaatatgttctagctgacattaattaagcacttaccacgtgccagacacacattcttacaagtgatttacatgtatttcctcatttaatcctcacaacaacccaatgaagttgggttactatcatctcccttttatagatgttaagggagttttccaatgttatacaagtgcagagccaggatttgaatcacagttattttattgtagaaccataaaaaaactctcagaagtctataaattatttcagtaaaactgtgctttaaaaacagtgtgtatattatcttttcaaagtaacattttcctgattattaaggaaacacacacttatcatagaaaatttgaaaacatctgtaaaaagagttgaaaaaaaaagtattttataaatcctcctcctgactagtattaggtcagagtattttttgggtgtattttgaatgtggatgtatatgtgccaaaagctttgtaaaatattgatcacattgaatatataaactggttttctacatttcctgttactatctcatgaaaattttccttatgcttgaatagttttgaaaaataattttgataatcgaatggaagctatcctcctataatggtaagtgagtaactcaaacagttctctatgtggttgtcatatattattaataacaaaaggttatatcagatattgacgttaatattattcatattgtcagtgaaatcttcttgccaacactgggatgaaactgtagagaaggtttaattctactgtaaaaggtgaaattatatcacagaatcacaaatgattttcccattatggaaaaacatcctgagaatgtcacgaaggcctgatatcaactgctgtttccaagagtttagaaaacaactgtcaatgttcctatccagagagaaatctggattgtgctgccaatcttataacctggccctcaccttgcttacagcggcttgtcaaggaaagagaaaaatcccaaaagagccctttgctctttttcttgtgctctctgagatactcccctttccttctcactatttacaaaagggagatgggagaaaaattcagggataatgtattttaaatgatttctatggctaagttaaatgttgtggggggtgtaattttcaaaggatgtaggcatcctgagtcaacaggctttgcatctgccagtgttcctttgaaaacctcaggagagtctttaaaagcaaatagatgatcctctatgggagccggcttagatatgtgctgtctccaagagctctgtaaatgtagattaactgacctctctgggtccttctcttaatcccatgctctgaatatggaaatgacagttcacgtgtatctccaatgcaacagtcaaataaatttaacttaaaggaattaatttatgctaataagactttcagcaaagatgagaactgtaaattgctttgttttaaaagcttgaattaattggattaatatttcattttaagcagcttgaatacggccacatgactaataaatgtgcatgaggtaaaatctattcactgagtgtactattccttctcaaaaaataactagcatgttatctacattttaataacggaaatcaacattgcattccatttatttattcaacaaatatgtattgaatataattaaatgaaaaagctctgttgagtttgcaggagatgagaaaatgaatatgatgtaatcaagtagcttacaagttagtgcaagaatatacacaaaatacaagttagaaagagatgtcatgaaagatgtagcttaaaaataagtggtgtgcagaagatgagaaataattgacagctctagaaccagaaagggccttatgaagaaagtaatattccagctctgtcttgaagggaattagaaacgtgatgctgaggaataagtactcaagaagagaaaaaaataataggaagaaaggcaccagggaaggaaatctttagtgtaaatatagacagcagcacagcttctttacttcctatgtgactaaatttcttcaggtgcacagtaagttctcccagtatttaccatctaagttatttcctgaatttcattcagtgtttttgggaatgccttatgtctcagtttcctcaactgaaagaaacctataggattagatgatttacaagttctttctggttcaaatctctgaaaatgtgagtcattcaaaaatcatgttgattaaattgataaccaaatacttaaataattttagtatcaataaattataggaaataaaattatttaccaagagaaggcaaaataaagtgatagtttgagaaaaggcaaaatagagaattattgtgtcattgctgttcatttaaattctgaagagatatggatgccttattgtatcttccaattagtatctgatatttaccacaacctatgattgggacctgaactaaagcatctaagtagatataattcttctgtagaaaacatttagaattgcacctttatgccctcatctattacctctagtggaatgttatttgtgttcccttttcaaaaaaaattactgctttatgagtaaactattaatatttcaaaactatttctaaagttttccccctgatatttggggttaagagatctgtggctgaaaatttctaattaatgttgtcatgatttccagcatatttttatttagaaatataagtttgtgtggtaaaattattagaattggttgaaaatatttgatgtatctacttgcaggagccttcaacatacattcaaaaatttgcttgtctagaaagcaattaaaaccaaaaaactagtttgttttctcatttaatattttatcatagtactttagaaataatggtgtattaggccgggagcggtggctcatgcttgtaatctcagcactctgggaggccgaggcagacagatcgcttgaggtcaggagtttgagacctgcctgggcaacatggtgaaaccccatctctgctgaaaatacaaaaattagctgggcatgttggcgggagcctgtaatcccagctactaaggaggctgagacatgagaatcacttgaacctgggaagcagaggccgcagtgagccgagatcacaccactgcacaccagcctgagtgacagagttaggcctcatctcaaaaataaaaaataaataaaaattaatggtgttttaaagcaaattatctacagtgattatcattgtggtttgagtttaagaaatactggagatgttaatttaaaatgtttatagtatacacttctgcatggcttgaattttgtttttacttttgtgattaaaaaatcaataaaattaataattaaaataatttaaaatatagatcaacaatttaatgaaagaaatatgtgtttagtgccttcataatcatcaaaattaaagaatttacttgaagactttttgagcctatgccaaatttttgcgtttacatacatgatcattttaaggttccatgtggtagagctttatatgcacctaatatgccttttccttaatttgggctttgctaaacacaactttttgtgtcctctgacaacaggtaagtgttcttgtctagaaagagtatatacttggtttatggcatggctataataaacggctgagttctatactgtcaatgataaaacttggtctcacatcaatataatggccatgctgtatatgattcttaactgtgatatactttaacaaaggcatctacctatgctgcctcaaattaagaagttttcccaagtccagactacaatcttggagttatcctacctaggtcaccacaaatttaatccgccacgttaagagaaaatttaagatgtgagaaaaataagtaagatatatgtagaaaggtacaggtactcagcattgtcatcaaaattagctagattagtactaaacggttgctcaaaatgtcaactatttcagctttagattggctgactgctgctgattcttaggaaaaaaaaaacaggtttattgatacatgattcttagtaaacatccttagatgactgagtttctttttgctcaccaacaggagctatagtatctgaagccacctattaaatacatttctattttctcctgaatcttttggtcatatttatctttttcttcaaagtaaaatggactatgcatataattttgggagtggggtattccattacatagtcaaatgcctgatttctacaatgtaattatatcgtttctaatttatatttggggttattttaacaggaactagaccagcaacagaccttcattcaacttgctattagcactcactgacttggcttattgtttgcgatgaagcatagtaattaggtaaattcactgtattcctgataatcatcaaaatattggtgggctttgatttcctgctcagaaaagcaaggaaggtacaaatctcccacatatgactaaggaaattgtgtaaactgtattatttattcatacatatatatgtatgtatatgtgtgtatgtttttatataataatggagaatggaatgaaatttaaaatgtaggaagactctagataattaaatttatatagtaaaagatattgtgacaatcaaaaggaaaaatatcattcatgatatagaaaagataggttgaaacatacaattagctagagggaaaagcaagcagtttttgtctatctttttagcttcatgtcattttagtgggagaacagtaaggcaataaactaaactgacgacattgcaagggagaaaagtttattaaaaacaccatagaattaaaacaaggatgttttaaacagagaaaagttactgagctgctgaaagctgctgcccccacctgggcattaaacaacaagaacttcacaacttaacagctttctctatatttgtaaaattctaggatttctcatttatgggttaagccacaaactaataggaagcaaacattgtattatgcttgtcaaccaatatacaagctgacctcagaaacactgcatatgaaaagaaatcagccgacattttttcttatttatggcaaatcaaatactgacttatgtatatgaatatagtaaagaagcttgacaatgtcaaagagcttatatgcaattggcaagggaaccaaaatcagttgcacgatgtaaaggtttgagttgtagatacccacctgataccgtgtatatgtattgcaagataaatatgcataccattatcaatttaatcattgaacctaaatctaacttctgttcatacaataactaattaaatttattggggcttaattctttcaacatcactacttttaagaaaaatactttagatgtttcctcctttgttgtatcagctgtaatgtctctaagctttagttttctttttattttcatgtctcacaattatatttgttatgggtttctatttcattcattgctacctgctgacatttgtctcagctgtgaatgtttttacctatgaaagataatctccttaaacatctattaatttacacttccaactgggtgtggagtttccaaccttatgtaattgtgagcaaatctgtaaattagcactaagacaactgttacaagtataaggtgtttgaaatttctctcaatgactttttatggtagttttggctgctcaggaacctccttatttgcttcctcatttatactctgttctagataaatgagattgcgagatatttaacttcattgagtaatgaaattatattttaaatttgggacacaggattaataacaggaaacatcagacaaatgtaaaatgataccatctgaattgataatattccaataacattcaatctaaattcatgcattcacttattcttccatgttagacaaacaatttttgaatgaatgaattcaaacatcttcccttcacgttctaggcagaccacacagagccctgttgttttctgtttttagtcaaaaataaataaataaataagattatggtgaaaaaaaaccatgctatcagttcacaagggtaaaaagtaaaagaggaaaagccctgctcccctgttttcttatttccatttgtcaaaattaaatactactaacacagttatttttaaaaagattttcacaaataaatagtggtgtgaatttctgatattgactgagagattttgcaacaaggggaagttttaaaactctggcacacaattatggagttagtttgtttatcaaatagtctagggctggcaatagcaactaagcttcaagttgatgggtacaaaattatttcaaattttctgagttgaaaacttgttattctattgaggatatacttgactcaatctaaaatgtctttacatcctgaattccagtaagacacaaaatttctattaggaagaattatatatacagtttgctttttatttacaaaaatgctcttattagaagcttattgaaaactgccatattagtctaagaagttaaaagcatccagcatgtatacattcatttatttattcatttatttgataaacatttattcatatttaatatgcagcaggcatcattctaggcacttgaaaaacagcagggaataaactaaaaacataatccctgtcctcaagtacctcatatcgtagtgagaagagaaaacagacacgataggtaaaacataacatgcttttgacagtagtaaggaataaggaaaaaataaaaagcaaaaatgaggatcagtagctttcaggaacttacaagttttgattggaggacttttgggaaactagatgaagaaagtgagagaggaagccatgcagacatatgacagaaaactatacaggcaaaaggaatagcaaatgcagatatcctgaggtaggggtgtgcccaatatattttaggtattttttaaaaaaaaggttaatacttcagaagaaaagcaagcaagggtgaaatggtaggaaatgaatttagaaaggtgacaggtggtcagaccatgtagttatttgaagatccattgctggctgttagtcaaaaagatataggaagccatgggaagttaaccactaaccagaggagtgccatggtctgatttacattttagcactctagcttttatactgacaatggatcacaagggtaaaaacaagactagacagaaagccactgcaaaaatccaagcaagtgagaagggtagcttttacaagggtaatgacaatggaggtgttgaaatgtggttggattctagatatatttttaaagtagaacctcaaaatgtttggcatgtggataagggcagtgatgagaaaaggtcaaagatacgttccaggtgtctgacttaagcaactaaaagaatctatttgcaatttactgcgatgacatataaatttgaggggtcatttatatacagcattaaataaatcacgacgatggatatgactgtagatagaaaaaaggtatcctagaattaatccctgtggggaactccaacatttagaggtagaggaggtaaacacaaatgaatgaaagagattaagaagagcagaaaggtaggaggaattttggtgtcatgaaagccatgttaagaaagtgtttcaaaaagaagagaatgaccgtctgtgtcaaatgctgctgatagatcaacgaagactaaaactaaaatgtaagcatgccatatgaaggtcattttggactttggtaagagtcattttagtaaaatggtaaggtccactggctgactggagtgatttcaagaaaagatggaggagcaaaattagagatagtgaaattcagctagacttctaagacttgttttttcttggaaaggaaagaaatcaggatgtagccaggggaaaaattggggtccaaagaaagtttttaaaatactggataaatatcatccttttatgctgatgatcatagaggaaagaataatgagacttttagacagacaggtcatctataataaaaagagagaagatagcatatagagtcacagatgctatcacttacacatgtaggtgtgatggcagaagcttctattccaatgcagacatatgtattgtaaaaattaaaagttgaaaagtgacacatatctttagagtatcatctacagacattagatgctcagacacataatcaaaagatacattacaatgagtgagcatcttgtgggaaaatttgcataacatcatttgcatttcttctaatattcatgacagtttgacatctacatcctatgtttacattgagaaaagtcgtcagttatatattacatgcttcattagcttacttttcttagaatcaaatgtctgtagatttattctattaaatgtgaataaacatcatgagtagcagtcgccaaagtgataccacataatctgtaatcgttctggggctccttgactaacatgttcaattaaaagttgttacaaatttcctggtaaccctcttattttgtatatgaatttaacaaagcaataaaagtgagatgggattgaagctgtaactacaaataaaaattaaatatttaataatgctgaagtaaatgaaaattgagtgaacatctcaggtagttattatatgactacattttggtgcatttttcttgatcttatcagttttctcattactttttccattacattaaaaaaacctataataagtaaatttgcttctcttcttcatcaaaaccagttcttctcagaatttcatgttcataggaatcacttaagatcttgttaaaatgtaggttctgattccgtagtctggagtggggcccatacttttgcatttctaactagatttcaggttttgcccatgcagctggttagcagaacacacttggaaaacaagggtctaaaccactctgttcttggcatttgtgcagaggttgagataaattaatcatttcatgcctaatttttgggttgccgttaaaaagttagttaagtagttaagtaaagtcatatgccagttaatgaaggggatatgttctgaaaaatgtatcgttaggcattttggtcactgtgggaacatcacagagtgtatttacacaagtccacatggtgtagcctactacacacataggctatctggtataacctatcactcctagcctgcacacctgtatagtatgttactgtactgaatactgtaggcaattgtaatacaatggtatttgtgtacctaaatgtatctaactaaacacagaaaaggcacagtaaaaattcagtattataatctcaggagaccgctgtggtagaggtggtcagtcattgactgttattatgccacacatgactgtaaaatttaaaaaaaaaattagttgattatcaatatgtatattcctagaagaccatataaataacatacaattttaaatcctacttaaaatattatggcctctaactaaaaacaaataaatacattttataacaattcctcagtccaaacgtatttgctcattattttatttaccaacccagtgcctaatttcataccagcccactcactaaataacaaaaccaaaggaatgaagattaagttaaaatgcggacagctatgttgaatctgacacactgatcacaccacagaggaaacaaacaactcgaatagtgttatttaaaattgcaatcctgtaagtggcaatgaacattttgctatgactatgctgtgctgttttccccacacctactcccacttgccaggttagactggctcaatctgctctaccgtgggatcacaatcatttgaacaaaccccctcagggcagtaatatccaggcagccagtgttgtctcagaagagctcctgacaccattccccacgaatccgtaattttgtttatgtatagcaaaagcatggcataggaaaaaagacagcatgccactgatgggaaaacttcctaacctgctttcacaaagcactaagatctctctgaaatattgtgaatattcaggatgtgcagtgtttatgcattaaaagaggataagggacatgttgtaaaggtctgatttcacaagagtcattctagatggctagttatacaaaccactcttacagtttaagatttaaataacagatatactgtaaatactttgttatagtgtgagagatactctctgagaaagtctaactttttcaaaacattcagatgtcacctaagagccgagtaaggagtaattcattctacattacattatttcacgggtatagtgttatatcttaatccacctttatacacatgtgcaaacacatctacttatgcatctatccatattatttagaccatcaaaggaggtagaagagagttcaacattttataatactttcatccttctcgctgttgtgcattaggctgtatacctgaaaatcttcatattactgaatactgtactattaagaggaaaaaataagaataatattttaccacaatgactatgcactatagcaattttttaaaatttgaaaaatatatgtgtgtatatatgaaagacagtaagtgtgctgggggaaagagtcattcaaccctttttaaagtggctaattcagcaaaatttcattttctaactaatgtaactccaatttaaaaatccataatattatactacaagggcacagtttacctaatctgccaattatgtttgttgtacaaaagagaaacccagggcaaatatataaataaaacaatttgtatttttaagaccaaatagtctatcagttcttgctgtaagaggtacaggtttagtgttccttaaccaaaatgcttggggctggaagtacttcagagcttcagattttaggtttttggtgtgtgtgtgttttttttaaatatttgcattatatacacttactggtagagcatccctaagctgaaggtttgaaatctgaaatgctgcaatgaccatttcctttgaatgtcacattggtgctcagaaagttcagatttcaaatttttggacgtgggatgctaaacctgaatttaaaaatatattaactctttcaaatcactgggtaggtgcacatagaatactttgtgtcatttttttaagggactgggtctccctctgttgcccaaggtggagtgcagtggcatgatcatagttcactgcagcctcgaactcctaggctcaagggatcctcccacctcagcctcctgagtacctgggactacagaagcatgccaccattcctggctaagttttatttatttattttttttttacaaatgggggggggtctcactctgttacccaggttgttcttgaactcctggtgtcaagcagtcctcccatcttggcctcccaaagtgctgggattacaggtatgagccactgtgctcaggtttgtgttgtttaatatagattacatttatttattctgccaaagacaccattgatttttgccatatatttctcatctgattctcacaagcactttaataacatagtaaatgaaaatattgctttaactagcaatttttatgaacattaatttttattaacataatataaagcactagtatttattatttttggtttgatgagtcagataatttgccttatcatcgtcatcattttattatttaaggaatcatatcagttgcctcttgttggactgtaatgagttaggtcaaaagaaagtgaatttgatagtcagaaacaagggactgtagatctgcattaccaaaatggaaatgggaaaaataagaaagttacatgcgttcttttggaaatctctttcagaggtggaagggaggtggtgttattaaacatttattaaggatctgcacatattaagcactatgctatgtgctttgtttaatttacctaataatgccctgagatagttactgtcatccttaaattataggtaaaacaaacacagaggataagtcagtagcctcgcatctctgggccaatgaggaacagaaccaagactccaacctggatctacatgattttaaaacctacacatttttctcaactgggtaaaatgagtgaactaataaagttagtaaatttcccagataaaatatttttctttgtcataatctaagcaaatatcaagaatattttaatgtttgatggaaggggacctgttagaaccagcgtttgtgttatttaaataatttcaacatttattttagatttagggggtgcatgtgcaggtttgttacatggatgtattgcatgatgctgaggtttagggtacgaatgatcccaccacccaggtagtaagcatagtacccaataggtagttttccagccctcctccacccagcagtccccagtgtttattgttcccaactttctgttcagtgttcccaatgtttaggtcccacttataagtgaggacatgcaatatttgagaaccagtattctaataacttaaatccaaaacttgtagattccaaaaagactgaaacaagtcaattttacttataatttgactaaagatatattaatagatcaattttcactatgctttaggtgatatggaatcttaaataagcttgaacttcatgataatgttttctatgttttgtaattctgaagtaattagggttcactttttcctaatcaaggccaagatctttcaacagttaagataattctaacaaagaatcattaataatcagcaaactaactcttttgttatctagtacttcacttatttaatattcagtttctattattttagaaacaaaacttcaactcctatcttcaaggtctttaagtgcatttatttctgtattcctgaaagacagcttttatccaagaaataaaatttactaaaatgttaataccctaagcagtaagacccgaaactttaaccaccctgctcaatgttgcataaacaatcatggaattgttaagaattcactctaaatgcgatgtcacgtgttgaacataaaattcaactctcttaatgaagcaagtaaacaaacttctttgcactttgtaatatgtatatattatctactgtagtaatctaagaagaaatagattcagttcccacttgtaaacagaacctcattaaatgcatgaatatgtggaagaaatgtaaaaaaaaagcatggtctaatggttaagtgactgtgattgtcagtcaataaaaacggtccccaatctgtcactgactccagtatttgtccttgggaaaatatcctgactctttcacagctctcaattcatcctgtttataaaagtggtttatgaagtattttagcatttataatgtgcttaacaatatttcaaaaccccagtgtatgaattattacttgtgtacaaaactatttataggaatgtcagtttcaacataattaaaaattaaatatacagttataattccctatttttagtaaaaattagatttttaaaaaaatttcaaggttctgaataccctaaaagtattagataatttcatatgctatttgcaaaataatattttcatgcattttatttgttttcaaaacctctcattaaagactactttttagttacattaacaaaaatcaaagaaaataatctgaatctataatgatcttttaaaaattcaaacttggtttacctaaacaaaactgtatcatagaattttaacaacaataacgaaaaataccgtccactgtctcagttagaactgcgcatcaaatgataaacagtttactttccaaataataaacaaaaatattgaccctaaaatagttacgctaaaataatatgttttaaaaaatatattggtaataaaaggtaaattttaaaaagattttcattccaacaagccagggaacatacttgccaatttctctttaaaaatatataagatatatataatatatataataatatataatatgtttttaatagaacattgaggcagtctagttaaagctgcctaaataacaaaacctagtctcagaaatgtgtttctggacattatttagctagtgttcaaataatagtacaacctgcattacaagcacctcttttctttttcagtgcatacaaaactcatgagttggcatatatgattttggtaaatactaaaagcttttgtatcttccattaaatttattacacaactttcctgtgtctcaaacaatgatcatcttagaggaaagtaataaggaaagtcatcaagaaaatcaagaaacaaaataggataaaagtgaagtctactggtgctcaccatgctgtgaaatacatttttaaaaaaagattgacttatggatggaccaattggagcatctaggaggtgggtataaaattcttccaacttttaaatatatctgaaatttttttgacaaaatattagaaaagtagaatccaattaatgttcttcatcagagcattaagttctaaaggtgagatatgaatgtcaatattttctttagtatttgtccttttctttgaacatgcaatattaaaataacagtctaataaaatgatttaagaaatctattaaccaacacttcctctttccatctcataaattatactttaaaatctattctgggacaactacttgaaaagccaatgagtcccctcccaacatacacacttaagttaagaaattccaggtaaagcccattaaacgctctgacccaaacctaagaaagcaacacttgtttaaacaatgacttctcttcctatccctgaaattaatgagtcaaccatgtgaatacatttattggtaagaagaaacaaggacacaagtacggatctgttggttcaaatgatacaatatatattataactaaagcaaaataaattcatttaaaatgtttcctttgaataacaatctaaacatttaataagttccaatttctaaaaatcacacaaaaataaaggcaacgaatattccaggatttttaatgtaaactccctttgttcaattatacaagagtaatactattcctctattttgagtatttatttttaaatggtacgatttctaccgatggaaagaataacagagaataagaaatatactacttgggcctggtgtggtggctcacgcttgtaatcccagcactttgggagaccaaggcaggtggatcacctgaggtcaggagttagaccccagcctggctaacatggtaaaaccctgtctgtactaaaaatacaaaaattagctggacatggtggtgcatcctgtaatcccagctactcaagaggctgaggcaggagaatcgcttgaacccgggaggcagaggttgcagtgaaccgagatcgtgccattgcactccagcctaagtgacagagcgagactctgtctcagaaaaaaaaaaaaaaagaaaagaaaagaaatgtactacttgtacagatatatgaaacaaactctcctttatgaaatatccaccttaaaggagatatgagaaaataaaatttttacttgtttttaaatgaaactgtctggcaaatagagtatggggatatggtatgctaaaaagaactagaaaattcagagtccaaaaggatatttgcagaggaggaaaagaaacaaaagagtagagagctggggaaaataaaagataggcttaatttggtcctgctatttgaaattaggttgtatacttgattactggagttaagaaaaatattatgaccaaagtttgaaacaaagttttctacaaattcatagaggacaaacatttggtctatagcattagcttacttcagcgttttcaaaatgccatgagcagcttgtaagtaatggtgatggtagttaagaaagtaggccctctgcgcagtggctcacgcctgtaatcccagcactttgggaggccgaggcgggcagatcacttgaggtcaggagttcaagaccagcctggcaaacatggtgaaaccccgtctctactaaaaatacaaaaattagctgagcatggtggcgggtgcttgcaatccaagctactcgggaggctaatccaggagaattgtttaaacccaggagacggagcttgcagtgagccgagatagcgccactgcactccagcctaggcgacagaacgagactctgtctcaaaaaaataaaaaaaaaaagtaggcactctaactgtctctataatggttttaaatggttatttgaagaaaagggtgacaggaaaatgggaaattattattctgaaagaaatgaaagttatgcataacggcctagatatagatatgagtaaagtatgtattacaggcataagtaatacaaatgacagtggactcgatctggacccagaatgagaaaacctgggttctataataatccggactttgctccaacaaagcacatctcctctttgaagcagcttcctccctgcaagatgagaagtcccacctgaatgttctcaaaaagtctttctgcatgtaaaatttcatgtttctgtggcatcaaaatatctggaacatttttaacttgtgaccaagatactgtttgattatatacaaggttacacaaaggatatatttgattatatacagggacatgtggaaaaaaataggaaatcacattgagaagaaatgaggaatgctcagtggtttaaaattcagatgacgacgaacaacttatgaggatcaatcttaggtaggactgagtaaagtttgaacagaaagataaggataaaaaagttaacaactgtgtcacctctgcatccctgaaaaaaagaaattacaaaaatatgaggatttagggagtaagaagataacgtcctggacaagaacaaatcccaaaatagaacccaaattaacatctttttcatagaaattaaaatactatccacaataattttggtcaaagataatcaaaggaaatgaagaaataagagataaaggcaaagacaatccacatatgatgataattcatgagggataaaaagctacttagtgctcagatgctttaatgacctagagaagttaagatgggtaataatataaaggatatctctgtaagagctttgttttataatcttatttctcaagagaaaaaattatcaaaaaacaattgtacatgtgttatatatgtggcatttttgtttcattttgtattataaaagaaaagttaaaagtaaaaatgcactctgtttttatgggttttgatgcttataaaatgtgatgaaacctctttataaaaaatataaaattaaatttacaaaattaggtacaaatgtaaaaatttatttttactgtgaaactaaatcacaacagatttctttctataaatccaacaaataccaacattatcacatattcaattagaaatatcatagtttaaattattgattaactgatataatcttattctaattgttcccactttttggctgtgtactctgaccacctctttacatgatgaagattttgcaaaatcattttctatagggagaataggaaaatcattcaaatcataaaagtagatggcttttatgtttctttcaacttcacaacctattatcggttattttgtgtaaattcttagaacacctgccaaacttggagaaacattcatcaggtttattctatatgagctgtatgattcagaataattttctgactccacgcattgcaagccttgtttctcctccattatccacatatatatatctatagccaggcatcattgtgcatatgagtggcattctcctgtctttggcccttttttaaatattatgaagagaagtactatgaaagaaaaatcatgaaaagagagcaatgtcaactaactatggttaaaatatatttatatcataattttagaaaaccttacaattatgtgaacccattgttatgctcccttccaatgctttgaataaaggtagttggcaaaatttcgtctcacagtggatatggctctatacaaaagtggctttatttaaaagaagaagaaggagtaaggaataaatccattttacagccatataagggtatctgtgaagtgcaatgggtttggtgaattggatccatgggctcatatattttagccttctctttattttctctctgtaagcttatggaacacatataacaaaaactataattctaaataattaattatatgtaaatgtatgtctggaactatatattcttatcaaacaagaaacaaattaatactcaggaatctcctgatacattcatgttcatttgcagttatttgtattgggttgaagattgtcccctcaaattcatttgaccttatttggaataaggtcaatttgcagatgtgattaaggtaaagttcatgataagaccacagtgaattagggtgggccctaaatcttttgaaatatcttacaagaaagaaaaaaggagaagataaggagaaggctgcatgaagatggaggcagaggtttcaatggtgtgtctacaagccaaggaatggcaaggaatgccagccaccaccagaagcgaggagagaaacgtgtgacaggttctgcttgagagcttccaaaggaaccaaccctgttgacaactcagtttgggacttctggcttccagaactgtgagagaacaaatttctgttgttttacccactcagtttgtgataatttcttacagcagccccaggaaattaatgcactttctatatagaaacattaccaaattggttagcatgacagtggatttgtaaactgtctttttatatgcgtgcctaaaaactcaagaaataaagggattcctcttggattacagcaaaaatattttcacagcggacttctatgcaccaaattgcgtttttgcagcccctgtagagcaaatactgtgttaaatgttcaaacatctgagatgtcaacatgggaaaataaatgatccttcatttctggaaaaaattaacaattctataaagtaaattgctttttaataaaaactgtattaatacattataatataattttatgcttaatacatttttctctaattttcaaaatttgtattggtcccataataaaagagttccgaaaactatgttaataacccatcctagggagaaaaaacagtaaaacttgaccaccagaatcaactttccatttttccttttttttcataattagattctctcacattctctcttttcactttggattgcaagattctaataataataatattaaatattaattaataatcacttctcagatgccattgtaattgttagaccctttgtaatatctatggcttgtctgtcctactaaatggtaagctcctatattgctgtggtcatgttgtgtacaactttttctttgcttactatgcctggaatagtgctggaaatctcttagatatatgttatatgcttattgccttggttgaatttgttatatcaactacaatgtggatggctccacagaaaggggctaagtttcaaaatctcttcaagtgtaatggactaccaagcaatccatgtgagaatatttgcattcctgttagcacaaaattaaacccatacccaatgtatttagacagtgctctgtagctatgcgcctggctttcctttcactaaggaaaagctctcgttggtcatatttaaccgtgctggtggaaggccaaggaaaagctcttcattaacatatactcagtaattaccaaaggcacatagacacatctcatttctaccctgccattatgctcactggcctggaaaatgggattgggccaagtggaactgtcccaagcacttgcactgtatattactggaagaagaaacacacagtgggctctacagacaagaactctctctgtgtacctagcaaacttcctgtggacagtttttacagaggtcctggtcaaaattatcaagataggtttactactaggcattgtcattctgctttaaactatcatgattacattaaggatgttatttcaattaaaatgattttaaattattaaattcataaatattataaaatgggaattaagtttctctcatattttattttatgtctaaatctgagatcagaaaaaaagcaccgtgaatattatgtgtagaaaaggttcacatttaaatctttagtctactaaatgaaaaggtaatagaaaagtaacctgagtaaatgatcacgtgaatgaacaacaaaatgctgtctacaggctcattataaagtcatctgaaataaataaactctggatagctactggtggcagtgtttccttcatcatatttccacataggaatggaagtggaattagactagttggctgcctcctactgtctctattcttcccctggaaaatcccctatgtggagaggggcccactggggtccattctaacatgctgcaggagaggcacaagggtagatatgtgctatcacttattccttctatcaatagatattcagtgctcaggacactacacttaacaaagggaagacaaataggaccaggcccctgcccttgagaagctcacaatctatagcataaaacagaatatatattatacttattttctataggtctcaatgccatggtacgtgtatacacatgacaccctaggagactgatagagataaacaaaatgaagcaatcattttatgctgtctgaaaggtcataaaagctttcatcaagaaggtgaattattgtacatgtgtagatatctgagttgataatgagatatcaattattagatttctttatagatttaacttaataacagtaaaagaaagaatccatttcctaagaaacacatttatagctcctatcctaagaactgccagatagagtaagagagaagtggagtctatctcattggctttgggggtctctaatgtttctttaaaatataatcatatctttcagtttttttcttcactgcccaaagatgacactgtcctcccagttccactcagcataaaaaattacaatatacagatcccaaaacttattaatgtaacttaaaagacaagaaagggagattgaaagctgaatttgcaaaatatactccatgatacaataaaacccttctctgcttagactgtaaaccaacagactgtgtctaatccatcaattactttgtctttctgaattagcttaaaagtgggtggtaaatgatcaaacacattttaaatataaagccagcagagagtcacatggggtccttttatgaatcaaagttttcacttctccatgtcctatgtgttactgtaaccactgaagtggcatatagtatataggacacagagagccacctcgctaatcggtccccacagacctgatggtgctctctgctgcaaaagcaattttcattttgaactccaataccctttaagagaacccttcaaaaataatcatatcacagtttgagtgactagagcctccgtctcaattgcatgcccccctctcctattctgtgtctccttcccccttcctttgcccttaactttatgcctagagatgaaattcctttcattttcttttcctggaaactaatacgaggaggagggatattgttatactagatattaaataatttttttctcaaatatcttttctttcaaaataagatataaccataccaaaagaaggacttctaatcagagatttctatcctgaggcagaagagcttttctttttgaatggaaaatcattctatgaggaaagtctgcatcaaaaatcaaacaaggactgttgttacaaaagagaaacctgccagcagtttcagggtaacttgatggttctttcttgggtctttcttagtgggctctaaagaggctttcgatttttttaaaggagaatctcaaggcagttacctcctgaaactactcatctttcactactgctgctaagaagaatgctttcaaatggaactgcacagcctcctctctaggagatcatcctacagatgaatgaagtgctggtaaagaaaaagcctcatatttcacctgaaaagtagaattggtgacaggattattattattattagtggaatattctcagactatttcttcaggctgacaaaatatttcaaaataaagaaaatattgccaactaagtttgaaattagaatgactgctaaattaaagctgattataaattaggttttagattaaataaaaaggttaaaaaaacacaacaaattaaatgagaagttctattcagttttgtccacatagtatcagacattacccacactatattcttaattttgatttatttgcatcggacttaacgaagagaacctatgctaatccatagttatgtaactagtgtatacctgaagtttggggctttgaaatctgaattgagcagataaacaaatgcctaaatatgtagtgtagatcattaaatgctactcggagcttttctaaattacagctgtgcacacagagtataaaaatgccaaaatattacacaccaccaaattcagttgcctcttgctcaacaagccttaatcaaatgggaaaagttaaattgaagagctgctttgtgaacatgcatttcaataaaccataatgtttgtaaaatcagaacatgggaaaagagaattatcaatagaaagaaaataattccccatgaaaattaccatttaccatttttcaagtacaaatttagggaatattactgcatactgatacatagtgattggaggctcatagataaaaaaagattccagaatctatatacaagttaaaaacaagaacaaaaaacttctgtgacctatatttgaataggtctaggttaacagtttaccttagcttattttagtgtatacttttcaggtgactgctttagtagagaaactcagcattgaaataaggtatcttcattggtttacattaataaaatacaacagcccctactccctaaaaatcatagttctcatttcttttttttttttttattatactttaagttttagggtacatgtgcacaatgtgcaggtttgttacatatgtatacatgtgccatgctggtgtgatgcacccattaactcttcatttaacgttaggtgtatctcctaatgctatccctccccccttcccccaccccacaacaggccccggtgtgtgatgttccccttcctgttctcatttctttatcatggccagacttcaaaatttctatacctggcactattagatctggcaccagagagaattatatagcccaacagcaatctatttatcatattaggtaattcttagtaaatcagggatattttgggagatgaccatatcacaagacagggcaatcttaattacaatatctacatatcaacagagtgctatgcccaatacagaacaaatctttttagcagagaagacttaaacatcaccactatatcaaatgcctgatgcaatttctagttagcattctctagaagaaggtaggaaccataaatgttatctcacaaaagctgaggcagtttgggagggggagcagaaaagtttgcctggggttagcatgtggccaagatatttcactgcaattctctgtatgatagcctgaaattttcaagaatagaaattgttttgattatactttcaatttagatcctctgatttaatgagatagaaatgacagattttaagaaaagtgagataaaaaatggaatagcacaaaaatcaagatcttagtgggaacaaaatcatataaagttccttgcagctctttgaaacattaattttcgtatgtgctgtgctaacatgctttgggacacatgacttaatataaatatataaatatctatgtattagcatttctatcaaaatacacagggacataatgaaaaaattgcatttttgaaagaataaagtaaaaacattatctaagttaattcacacatgcatttcattctatttcaagggtcaagaaacttctgcaaaggtttggatagcaagtactttaggcttactaggccatataatgtctgtcaaaagtactcaaatctatattgtaggaggaaagcagtcatagataatagataaacaaatgattggggctgttttccaataacactttatttataaaaaacagctggtgagccagatttgatccttgggtaatagtttgccaaatcctgctctagtctcatgaactaggagggatgctgagctgaaattttttctgtatagcattataaattattcacattgtcacactttgttccttttttattgaattatcataccagaaagaaacactagtagtactcaaaataattccagggagtttaacttctgtctattcaaaaaaccattagcactttcactcttttgcaataataaaatgatttaaaatacaggcaaaaagaaaaaaaatgtagttttaaaatcctttcagttatataatgcacatgatgtgcaatggaaaataaacacaaatgggtacttgaaagagagagcagaaattcccagaaaacaatggagacctgtcaccacacagctacataaatttctatagttcaaaaaggttacttgcccttttaatgttgctgtgattcaattgtacagatgggagttacactgactacacgtccaccttaatgccatttactcacatccccaggaagctatatgccagtgagaaatcagaaatataggagagtagatcaatgaacatgctttgtgttgagtatgcccaattcataccttaacaacatacaaaatcaggatgcagctctacccatgtgtgttcatacttattcatgtgtggggaaagccagctgattggcatgatccacatccatcaaaagcatgtggatatgccatcaactgatagaaaggagtcttgcaatacttacagtgtagacttttgcccttagatattatttgtgcaattaagtatatgtactcaatttaaaattcaatgtaataaggttaaatacttagagatagctatggtcatacaaataaacatgggatgaagaattacaagtttttgtgtctaaagtgttgatataatgagattcaaagacccagagtcaagaattgtaatactcaagtctagtttctttctactttatgaataaatagtcatggaagtgtgaggaagaaatatcacaacttttacatgctaagcccaattgagtgttcactgattgatactctactctttgccttgtttcctgctggtaggtacactcctttattctctgtccataattaggctctgtaacaccaagtgcctctaagtatcacgtcaaagaaattcaatatttctgcctgcttcctccgtagtttttttctttactgttgtgtgtgcttagtgactatagcacagagactaagaaaactattctgtatcagaaattccataaagtgactaaggagttttgtcatttgctcctctgaagctgcatttatcagattttaccagggatggtaaattaaacagaatttttataatctgtgtcagaactgtcattaataatatgcaatatacacttaaaagataatattgttgccacttctgatgaccaaaagagtagacatggtaagaaagtattgacaaacaaaatagattatgacattagaggaaaaaatgttagtatatgctaataaaaaacttaaaatggaaggatttatgcagtttggatgtctgtactgaaattgtcacttagctcaagtcacaagatctttgcacttgaacagctttctccaagttcttcctatggcttgttctctttcattctttactcctcagtgaacatatcgtttttacctcgcattctctcagtgattcctcctcccatcgtttattttctacggcagattcaacattgttggtaattctttgatagttctcccattgaaaaatagtgaaggagtcaatatttgaatctgggctgcaccatgaccaaaagtgaattgccagaaacgacactatgccacttctggtctaatctttaagaggcctggaactttctacgttttttggccttgaaatatttactcttggagccctaaaccaccatgtaacaagtctgatttccctgaggttcttatgttgtaagaaagctcaagctagctatttggaaaggtctgttcagggagagagaaagcgggggaaatgaagaaagagagaatgattgagagggagctattgggagaggaggagagaaatagagagagagagagacctgactatttcccagctttccagaccctggacattcaatcatttaaatggaaaccctagacatcgtggaacggaggcatgccatccacactatgtcctgcccaatatctgtcccagagaatgagataaaattctgttattataaattgtttttagccaatgagttttgcagtgcactgctatgtagtaattgataactacaattatctccatattctagtatcctattttatcgagcagttatcatataatacataatatttggaaacttgtgaatttacttatctaatgccttttgattacagaatggaaaatctatgatgacagaggcaatacctgagttagactttcagcattgttataatgcctgacaaaacaagtaaatatttgttaaagaaaggaagagaggaaggtgatctgattgctaataataaggctcttttttattacttcaacgtcttaccatgcttatataaaagtgacacttaggttagaaaataggttaggaaagtattttttcatatgtggtatttttctaaaccatgtgtatagtacttttatctacaactttcagaatttctctctggaaaatgatgccaaaagttatcagaaaggtaaatttcattttatgttaataaatttaaagatttatcagtatctttaataattttcttacctattaaaattaatctttcaaaatcacaaagcaaaataatagtcagtgattgaaaaacattactatgggctatgtataccttctaaaatgatttttgtttacaattgtcaatgtatctttcttgttccgaacagcaagtagaaatcaagaggtcacttcccagtagacttctgataaaagcctgctctttatctcacaaatatgaactccacatttagagctggaattcctccagatagagttggtaataataccccaggaagtttaaggagatggttgccaggttgatacatatctacattctgcttcagagggagcagaagccaagttaagagctgcaaaggcaagatgctctagacgtttagcaaagataaatattagtatttttcatattttaaaatgaggttctctagcaaacttaagagtccggttctcttataaggattaaaattaactggttaccaattaacattttttttaaaagacctatgcctaaggcagaaactttagaatgtgaaaacagagcctctcccagttttcatagcaattaacctcagtatttgccaatatacccttgatttaacactacctgtttataaggcaaatctaaaatttgccttataaatataaacatatatatttatatctgcctgtatattctaacatacacacacattttgccaaaaaggtatttaatttaatcctgacatatagctaaatatatggatcattttaaaataaaattttaaaaagcaatgcacaaaagttaaacagtccagaagtatacacaaagccaactgctcaacaattcccatttatttttcctctttctgggcatataaacagattttgcatttcactcttccctatagtcagatggggcaatatgagtaggtcatggccgttgaattgtgaaaaggaataatgtggcatttccaggcccagagaagggggttccccatgctcacaggttttctctcttgcagtgacctgcagttatctgttccatatgaagtagccccaggctagaggagagtcacctgaccaacatcagactataatgtcagcaagagaaaaaaactctgtgggttaagctattaggaatacatagtttgactgatgcgccagcttgcagtaattgccatgagccatactgataatgcaagtttcaagatttgattcaataatccataaaattatgagatcaaatacttttttctttgcgtagaaagattctactgttttttaaaattacagattaatattttctatttctgtatatgaaattaagaaaaaaatcaattgaacttagatttcattatttatattgaatatattacgtatttgaacacagttttactttaaaaatcagctgttaaatataatttaattatttctattattatataaatatccctactataaaaaccactacattttacttacttggcaagttaggatggccaacatatttctataagggtacacactgtttattgaaatatttacatatgtttactgactagggagggccactattacgactttgagtatgtggattttctgaccaacatagcattctttctttcaccatttctggaaaaagaaagaacataatttgccactccagatatattgcttagtggctaacattaaagtaacatgagaacatttttcatccagaaaagagtatcttcacatgcaagagtttcatgtgaagtattcaaactgtgttttttattatccaattatatacttaaatcatacataatttcacagttagcccaattcattgataaatagcaagtcaataatattatctattcaatacattgaattttcttcacttctgactaattgataatgttaaaaatgctagcagaagcactccagagttatttttgaactcatggcttaagaaaagtccagatagaaatagcaaatatgctaatagcacttactacaagccagccattcatggatccatgtggtttacatccttccaaggtccgtacaatcacattagcaggccagaatattattactcatattttaaagatgaagaaattctcatcataaagtaacattcatccccacacaaaaaagtaatcactaataacatttagttagctctattttggatctgtgtcagaggtaaagtattataatacttcagggatcataaaagttttggatggtttccttcacatatatgttgctgattataaacttcacacctttgtaaggaaaggattttaaaatcaaatgaagaaatgagccatgaaaaaggttcactcacttgtcagaggtcacatagtgagtaagtggtggaggcaggatttaaacctagagtataatgtatctttgaacaacgtaggagttaggggtgctgacccctgtgcactggaaaatctgagtataacttctgactcccacaaaacttaatatcctactgttcactggaagccttattaataacatcaacagtagattaacatatattttgcatgttacatgtgttacatactatattcttaaagtaagctagagaaaagaaaatgttattaagaaaatcacgagaggaaaatagatttacagtactgtactgtatcaatactctaactgtatattatctctttacaagatgaatcctgtctgaaaggtcaggaaactgcagttgcaaacctcaatctacaggacatatcaagcagttcaactttttcttgtaatgttaagacatttctctccttcttgggagcacttccagcatcactagtgacacttcatatgggtcccatggtgttattcaaggtttacggtattgcactaaacacaatgaacaatacaggagaactgtgacagatcactttttactgacatccacaatttattgggagatgaactgctcatgctgagatgattagcatcacatggcatgttaggtggctattcacatcacttaagctcaccacaatagcaactagcggaggctagaaaattaatacagtaattcagtatgtaatgcagttaattttatgcaattatgatctaatatggcaccttaacattagtttatatttctctcaactgcaaatggcaccatgtatggtctgcaagtgttactgtgcataagttttaataaactttaacttcttataataggtttgtgtatattttatggccataaatgagaaaataaactagtatctacaatattttatgtatctatgacatacttaactttttcttaatttttttattacactttaagttctggggtacatgtgcagaacatgcaggtttgttacataggtatacacgtgtcatggtggtttgctgcacccatcaacccgtcatctacattaggtatttctcctaatgctatccctcccctagacccctacccaccagcaggccccactgtgtgatgttcccctccctgtgtccatgtgttctcattgttcagctcccacttaagagtgagaacatgcagtgtttggttttctgttcccttgttagtttgctgagaatgatggtttccagcttcatccatgtccctgcaaaggatatgaactcatccttttttatggctgcatagtatttcatggtgaacatgtgccaaattttctttatccagtctatcattgatgggtatttggattggttccaagtctttgctattgtgaacagtgccgcaataaacatacgtgtgtatgtctctttatagtagcatgatttataatcctttgggtatatacccagtaatgggatggctgggtcaaatggtatttctagttctagatccttgaggaatcgccacactgtctcccacaatggttgaactcatttagactcccaccaacagtgtaaaagcgttcctatttctccacatcctttccagcacctgttgtttcctgactttttaatgattgccattctaactggtgtgagatggtatctcattgtggttttgatttgcatttctctaatggccagtgatgatgagcgttttttcatatgtttgttggaatttcatatccagccaaactgagcttcataagagaaggagaaataaaattctttacagacaagcaaatgctgagagattttgttaccaccaggcctgccttacaagagctcctgaaggaagcactaaatatggaaaggaaaaaccggtaccagcccctgcaacaacataccaaactgtaaagaccatcgacactataaagaaactgcatcaactaacaggcaaaatatccaactagcatcataatgacagaatcaaattcatacataacaatattaaccttaaatttaaacgggctaaatgccccaattaaaagacacagactggcaaattggatgaaaagtcaagacccatcggtgtgctgtacttttaatttttagtatttctaggctatacagattgttgagtttttccaaactgcagaaactttcactttgtttctaatatatttattcaaaaataccctcagataagtggacccatgcagttcaagccagttgttcaagggtcagctctaatgtggttccagggtccatatagttaatgaaagcattattctctcaaattatttcatcacaaacaaaagattttccttatcctgtgtcttgagtttgactgcttctttttcattttttgtttacccatggttgaccagaatgcctagaacatagtagtcaaaaaggatttttaatttaattaaagaaattaagggaggatgccactttagatatctgttcataaagaatatagtcataaagactatattactatctggagagcagaatctaaacaaaccatcagatttgtaaacccagggctgtgaactgtttctgttcccaattcaagagactaagctggtgtgccttttggaaagtaagtgaggaccttaagcaaaaatagattaggtaattaaacagtcatgtaagacacatggcttagacacagcttccccatggaaaccagtcattcacaaagggaaggagcaatgagaagaaagttttttgcaaatgtgcacagagattatggtcaacagtatacatgagaagacttcattcttaaaagtaaagaaacaatttaactattcatactcattcctgagatcatccagggccaaaatgtgctcgctatcagatgagtaactcatagttcagaagaaaattactatgaaacaaagagaattatttttctctctgattacaattttaaacctttacttttcaggcactttagccctaaatttgttttcactatttgtttaatttaattccttagaaaagctatgtcataagccatctgatgactttgtaaatgcaaagggccaatgttgtggaacagacaatctaatgacatagtgtttagtgttccctaaagcaggagacagatgaagagaaacggtgaaccggcaaccttagcataattaagacaagcctgagtgcttgccatggtgccattacattaatctcacatcagtggcacctggctaaaatttatgagatatgtaaaaagggcctttccaactgaccttgataaggcagagttatttatcatgtgagagaatagtcagcaagctagggggaatgaggtatattagaaataagttgacagagagatttaagggcagtgggctgcgatacacattgactgaaaagatctagggaagcatttccagcactatcaatcttaaacatctttgacaagtaaaatataaaatcatgcataatgttaataatatatatgagaagaggtaatagtaaatgtcaagttttaaactgatgctagttcattcatttaatattttttgatgtgtgtttattgagctaatataatggaacttgcaaccacaacggattctacacgatttcacccccgaataaataagcacaacatattcaccgtgagttccctggagcactgtctcattttattcatcatttcatttcaagggcctagtgtagagtctgaaacagtttaatcccaataaatacccagatctttttaatggctaactgcttcctgttcttcaggtctcagctcatactacagagagtctcctagccacagaggaagaccacaaagtgtcccctggccacctcatcaaaaagacttaccactgtatttaactctcttatgtattgcctgcatgcttattatttgcttttcctccctggactctaagattccctttcttgttcatctttatatgctgacacagattcattattagaacaggacgtggtaggtgcttaatacttgccaagtgaatagaagaaggggtgcttattaaataaattgtggaaatcagtaaacagaggagtatgattatgtttcaggttatattttggaaattacatacttttttattttaaaccattgcaatatcagtaggaacaacttgaaaaaaaatcagacaatggcctttcttcactccggacttcactgggataaaattagtatcacaataattcattatcgattgttgattgaaaaaatgtctcttttcttttcagcagttgccgctaatattgttaaatagaactaggctttttaggacataaacagttttgtacttgaaatgtttcaataagaaatatgaagggaaacaaagtggtttggttttggttgaggttttgtttgctttacttccatataaaatgtacacataaaatattggtagctgcaatctgtagaaattgccataatataagtgacattttacttctgttcatgggccaactcatcagcacaagggtcctttattttattttttgtgtaacagacaatttgaagatttccttttgactttatcaaacataattgaatttatacttccactaaaatggagatggatgggtaaaattctatctttatacaatgaaagccttatggtcttttcagtgaggggaaacagcagcacagatttagaatgtcacatagaaaaatcacattgggccaagcagacctgaatgattttaggccacaccagcaagaaaatggcttctaacatttaaattctacttcttcaccattgtgtacttggtaactcttctatgcaaaagcacagactagctgaaaacagcaagtcacaaaaaataatcttaatggtctttcattatatcttaaaatctgtattaaaagtaaggcacatttggtagctagtattttagaatgaaggtagaaaagcaatcttcactttaaaaaaagctaaaattaataaaatgaatatatagatacttgaaagaaaaggttaacttgcctcaattcctagcataatcggtcactttataatcccaattaacattcattcccacacagaaaattaatcactaataacatttgattagctctattttggatctgtgtcagaggtaaagtatataatggtacttcagggatcataaaagttttggatggtttcctttgcatatatgttgcagattataaatttcacactttgttaggaaaggattttaaaataaaatatatcagaataattaaatctctctcttttactgtaaatttgtgtgtatttttaatgcaacataatttgcttaattttaaaataaatattgtataaataatgagttatgagtatagaagagagtagaattaatgaaatttctctacactgtctccatttgaactgaatttctcttgctttctagaacttttgcagaataaaattaaaaggtgcataaaatatcagatttaatatttgctactgatcttacctaactctggcagatctctactgaaatttacttattttaatgattggaattccataatgaaaatttaaaacttcatacaaataatagaacgctgctgatttctatttgtaatgaatacactgaaagagggtaaaaggggagatgaggtttatattcataattccataacttagcaatcctatcttaattaaagaaaatctgccatatacttaccacataattatcatcaaagcaataagttttcattatgattcaaaggctgattctatgaccattttatcttgtttctatttatcttcatcccatcaatttttgctaactttgtcttcagattaattttaaaagatagcttttgcttttttaattaatcaaaagacctgtggtatcatccttcttcaaaaaatatgccaatatgagtcttacttttctttcaaaaagttggtgaatcttgatcttttttattgtttgtgatgaaacagacatttctttttaaaattaaattccaacgtcgtgaatgtataggtcattggtttctagagaaagtctttaaattaaggacaatattttaatctagaaaaggatacaaaaagttgttgcatataggccaaaaatgtttaagtgtgaaagagaaatgtaattacattataaagttttagaaaataattatttatcctaacaaaactcattcatttcaaacaataatcaaacaacatctagaataattttgatatctgcaattgaattgcaatgtaaagaaattttcttcaaaaagaacttgaaaatctgcctcagaagatgggaaataaattatttgaaaaataaaataaaatcctaaatcacaatgtgataccaacacagactgagtaaataataaaaggttgtacctcattacctgtttgaacaaccagccacccagttgctctcaaaaatatagtagttgttagatatataggcaatttttgctagtagaacatattcattaattttttcctgtagcaaccaacatatttttaaggcaagacatgaaaatccattatttaatttatctgtcaatgccttgggtctgggcatctgatctccccacttggaatggttaattcaccaaaaatgtctgagacaaaaaagccaaaattctttaacacttgctgaaaggttaatgaagaatgaagtgattcatagttttccccaaagtcaagcatgtaaaaatcaatattctacatcttaaattttttatatacaaattaagccaaatttgggccaatcaccttttagacataaaaagagttgctcctgaacatgcctcaaatgtcttctctgcgtttctgttgctgttgttgttgttttcctgaagtaggcaacattttttatcaggagtattacagttagataactttattcacactgaagtagattccagaataatgaaatcattggcagaaagaagcaaaccacagtggaaaaagatgcaggcatgaagtaaaagcatcatgaattgaatgaaactaaagatggactaaagtcatagaaactgttaaaaccaggaggaccctagagatgttctcactcaaagctctcattttaggaatcagaaactggggatcagagaaagtgtgtggctttctcatgatcagaagaaccagacctagatccgaggacttgacacacttggttttgtactgtctatactccgtcttttgacacttaatgaaattaagcaggaaaaagataagaaaattttttttgtaaagtcacattcctctaggaattatttactaaaattcttcttcacaactccccctcagaaatactgaaagcccttctttttttttctaaaaaacatatttgcaatttaagaaatcttctgaaaccgtcacagatctcaatttgctcttctattatcattagtctactaatttcattaatataatttaactgattttctttaagagtctgatgaatttgcctccctctttccaagatgtttaaagcactatgtgaattactttatttgtaaaatgtagaagtgagatgttacgggaattagtgtaaaattttaaaagtgtgcaataggtaaaaagttttccctcaagatgtaaaatcctacaagactaagacttctaaacaaatgccatccccagtcacatatggatatttgggaaacagaaatcatccacagaactgttgattcctctgtgagctcgcatttttaaaatttctatttgtagtagtcaggattacccatttcatttacatcagttgctctagctctctgtgttccagccatttgggtcactctggtttctttcagttctttccatcttgttctctccttacaaggcaagcatttaaatagctgaagtgtattgtttctagaaaatttctgcattgaaagccttgaagtctctatggcacattatgtggttcatcaaataacctggagcttaaattagtatattatttttccataatttaccaaatagcatctttccatctacttaaattctgagcctatatgtgtgacatagtagaattttaggcctatttaccttccaaaatagtaacaagggtaatttatgcaactctgcttcaatgtgttataaagtgtaaaaatcaattgtctaacccagactgcaaaacctatgccactcaatacacgatacgtttataaaactaaaagtcaaaaaaagtatgcattgtgtgccagagtataaaaatatattttaaaaatcatttgataacatgcccaacattgcaatgaacaatttgatcatttagaagttatatttgagagaatgccaaaattctcaggttatcataatattctctgatggtcactaaataacaatgaagtgaacaattctaccatctggactttgttacgtagcccgatgctgcccatagaaaagattaacctggcaggcaccacagggatatgtattttttcaattccctcattttataggcaaggcaaataaaattcagaaagctaaaataattgtaaacttggttacaaagtgacttggcaacagagctgggagtaaaacccaagtctctgagttgttcattacaagcaggctactttcacctttgaactctggaaagcactttttaaaaaatatttctctttatcacaactgcacttgaggtaactcaggtgttatcgccctgatttactatgggaagatacaaactctatttgattattcgacttgtatgaagtaacccagggacctcgagtgtgtccatcatatttatttcataaacatttcaaggccaataaggacaaataatatacttgttatttactatggacaaaaataatgggatatattttataccacttcatgagtggttttccagcttggctaacctccataatcattagagtcacttgaaatcttctggctttgccccaaacccactgaagcagaatctccagggaaagtgcctgggaatttgtatttttaagtggctcccccaggtgactttggtaattagccaagtttaggaaaccttgacaatatcactggaagtaacaggatgttgccttacgtgttcagaatgttcagaagcaaaatgtacctattgtaaaattgacccaatccagtttctctcttttacaaatggggaaagatagatgtctttgtcacaagtgggtagacaaactgccaaataccacctatatttttgggtcagagacagattggaactccaccaagagaaactgggcattcatactcggtctatttccatggcagggacaaaacaattctaatcttactgatcatttcattaaagaataaagcaatctcagggcattaactgctgacagtaatgcagaccatggatttcacggattaaccaaaccacaaacaatctagaacatgcccacagaacaattctttgtttgtgtagtacaggaggcaaaaaagcaatcagtatgacttgaactgctgggtttaattactcaatataacacttgccatttaaaaatccgtatgcccatcagcatggcaacagtctctcataaagattccggtatcatatggcacaatttgtacggtaatcccacatttcccaagcactttcacatatattagtgcaccttatccttacaatagccctgtgaggtagatagtaattattgacaaactgaaaggtttgttataattaaaagtttattactggcagaatgcaaatatcctgaaatgtatctgatatactcttggtttcatgcaaaataagatatgtatcaccccttagagtttgttaaaacaattttaaaccctaaaatattcattaagtttttttaatggaaaatgattcatgcaatgctagtttaaatgctgaatttgaggttaaaaaagaaaatgtatcaagtagtcagcctttactactttgaatatcaagcatacagatcctgatttatttcatcaaaatggtttcctagctataccaaaggctagatccttttccctatacaatggctcaggtgaaaaatagttactatagtgacataccacagtgaagagttgaaaatttgaagttttcaaaaattaatattatgtttgttcacatgctaattaaaatgaatccacagttgttattcctcattgttattgtttattgacacttttaccctttctctttcctaaagcctcaaactctctaaattttggcaaaacttctgtgttattctttctgtgagaaaaacttcaaataaacttccaaaattttttttctgggtacagtgaacatagctagaacagttactatgtgaagagaatgctattaaagtcaattattacaaagaagcacttagacacacaataatttatcaaagtttttattcaacgtaatattatcaacaggttcagataagaatataagtttttctcatgggagaaactccatctgagtctctaattaaataacttttgtatagttccttttcttctctgcacaaaagatcttttttctgtccattcttgccctccttctttctttgttgatactatttactcccaagcctgcctctgaactctgtctaattagctcttgatagatctgctgccctgtttccacaaacatttaattctgccgtcagtcccatttacattacagcatgttgcattgtcttttaccagcctaattttgtttgagtgaatgtaaatcccattaagcagtcacctattagactatggcatataaactccaaaagcctctttattacaagagtgaacataaggcccaattgataaaagatttctggggcatttccatttgtggtgtacttcaaatattctgtctgctttaaacttagctcatgtttttgaagtatttgacagactatttgagtatctttttgcctgtgtattccatagcatgaaatacataaccatcatttgcttgttgtctttagaagtttacttatacctaaacataagttaaatatgtatttcttcctctttagttattttatttttcctttgtaacctgaccacattatttttgagcactgcataaaggtgtttacaaataacaggatggctggcagaatcttctcggaaaagctctttatgaatactaaataattgtccagaagttcagtaagcctcagtgttttaagctgaactttctggagagaggtaagacatagcatcttgacaggcagcccttcaaatggcaagtagctatgggcatcagagacagacaggtttctcttataaccttaatgtaatttgatagctcaaaacgaataaaaacaagatgtaagatatcattagaagccttggaaagaccaggtggtctgatatttacatcaatatgatcaatatactcaatcagattagtgccaggtaccagttttaaatgaaggctcagttatagactttcgccaaaacagagataatcattcagcactatggtcacataatcacgtggttgaaggtaagggtgagaatggctctctttccatttcctcctggtaattaactcagaaagacatccatgaagtgcaaaccctcacacacaaaattatttctcacccctgcaggcttgtcaaagccaatatttcagaaaagcacaggttgctgaaggggactgtgattttttttttttttgcctgctgtgagtccctaaggacaacaaacattctaagagagactgtagccaaaattgctaataacttcacacagttcttttgccataatgacaaaattcaagggaagactgaatagagtagtgggttaggtggtaagccagttatttgagcaggaatgaaaatatatatggtcccaaatgctagttacgaagtcaacctggattaaaaatctaaaaaatgattatgacaaatatatggaatgcaaagtcaataacagatattcagtttgttaaaaatgaggacttacaatattttaagaggaggaaaaattataaaaaaattgagcatcaaaaattgatttataaagtaagaatttgcatcaatacctagccatacctacaatatacagcttggtattcgagtagaatagattttatataactctagactctctaatattcaggctcaaaaatacccagtaatagatatcaaaacaaatttcttggatgataggccccttatttctttctacatatgttttgatttgggtcaatggcttggctagatattatatgtatgatttgacatgattgtttatctttctgtcctttacatagcattaaggacatttattcgacacagatatagtcaaatgtcataatgggcaacatgagttacacgttggctcccttgagtgtctcctcataatcacttcaaatcttactgagaccgagatttcaaagcaagaggtacatattaattcagggttacttgttaacaaaacaggcagctaactactattacattggttcttacggtttactgaagcattaaacattaacattattattatgaaatacaaccaatatcagaaggaaattattttttaaaacagtacaaatattttaagtgggcctacaagaaaccttagtgattcataataagtatattgaacgaatttgaaattcagtgaacacatcaaagtttctagacccacataagtttctgtactacccataacatttataaaagcaacttcagtaactttttcaaaaaggtatctctgtgttatatctggacacaatacatataaaatataaatatagatgggttgcataacctctctgagcctcagttttctcttttacaatggagaaaatgcatattaaagttgttcagattaaatgagatgattacataagtgctgacttttttttttttttttttttttttttgacacagagtctcgctttgttacctagctggagtgcaatggggcaatctcgactcactgcagccttgacctcctgagttcacacaatcctcctgcctcagctccccaagtagctgggactataggcgggtggcaccatgagggttaatttttttttttttttttttttttgtagagacgggatttccgccatgttgcccacgctgttccccaacttctgaactcaagcgatccgccagcctctgcctcccaaagtactgggattacgggcgtgagccaccgtgcacagccagtgacttcttaatatatatcctaaagcgcaagaggcactggatatttgtggagtcttgataaccaccagggaggggcccaaggtaggagagaacaattgttctgagagacaagtaaccataaacaacgcgctgacacaacgaccttgctccacaggtagcccaaatggcacaacctcgatcagcatgtagccccctccagaagaccttataaaacttccctccagcccctgcctctttgcagacagccccttctctgtagtgctacatattgcacccttgcaatgaattttcatactttctctaataaatgtgcctttatttttctccccctacaactgtcttggtaaattcctttaccaccggcaacaccagccccagccagtcacacttgtaagagtactcagcagtgagcaacacttatttttcacagagctataggtgagaagacagacagaaacccatatgtaagtataacttttgataatttttgtcacaaacagtagtagccatagttttgcctctcaaatatgctttttgttcacctttctattaacataattttttatgttttaaaatgaatctgctccaaaagattcttgtgaactgatccctctgcctactccaaacagggggtaacctaacaggcttcatcgctagtcaatgagatgaccttatttccctatcaatagtgataggaggtatccagtaagaggcgtgctctttgcaataaaaacacaactatggatataatatgaaaaaaaataactgctttgaaccttttctgtcacaattccagaaaagactgcctaagaattaggccaataaaaaagaacgacattatgtcctttgcagggacatggatggagttggaagccattatcctgagcaaactaacatgaaatacttaacatgttttcacttataagtgggagttaaatgatgaaaacacacggacacatagagggcaacaacacgcactggggccttttggagggtggagcatggaaggagggagaggatcagtaaaaacacctaatgggcacgaggcttaatacctgggctatgaaataatctgtacaacagacctccgttacaaaagtttacctgtgtaacaaacctacacttgtaccccagaacttaaaataaatgttagaaaaagaaaaggaatgagatgagaagagagaaaatcagagttgagattttaagatagtaagagtgtcctgctgacatgagacatggtttcagccctggatctatctgtgcttaaggcctaatatgctcctggactttcattttgtgagtcaagaaaatccctttgcttgtgctagtttagactaggtttcagtgtccacaatgctaataccgcgaggcacacgggacaatggcaaaaggagaataggttagtgtttcaaggagagaaaatattacgagggctctatctaaggaaaatgttagtgtgcttgaggaaccacgaacatactattaacatcactgtcactactactgagacagccaagtaaaaagggctccctggcagaagctcccacaggcctgagcactgggaggaatgcgcactggggtggagcctcaggaagttcacgccttttgcagtggggaggagcctggcctctcctgttgcagcatagtaacctggaattcagtgtgcgaggtggaaaactggctagccggcttctcgctttgctgatagtccttctttcccttttcatccaataaaccctgtcctggtcacccttcaaagtgtctgtgagcctaatttgtcatggttgtgtgacgagaaccccgtttttagctcaactaaagacaaagttctacaacaccactataaccctttatagcttctagatcttgatctaaggccctgggaatgatactcctacctaaaaagagtttcccaccaagactacctgtttatttccaatttgtatctcatttaatctattgtgctatcaaatgcaaggacatttttctagatgcagatgttatatattaaaagaaagggaggaaagagaaaggcttggttctggaagaggatagagagtgtgaagccttgtaagccaccagactgacagaaagccgtgggcaaccctaggagactgagaaaaagaaacctcctgacaacacagccaagcagaacaccagaaagaactacctacgccccaagtttccctaaggccagccgtggctacataattcgtcatatactataaatgaaatgggtgtagtttgaaatattgctttccactaatattaatttcaagaatctacttttttaaaatgaatataataactttgaaatctgtttttgctgcttttcctgattttttaaatactcatacaatagtctggtaactggtattctttttaagcagagaactcctggattcaaatacctgataattaaaggatcttttgatattttggcagttactctcactaaaagaagttacattcagcagattagaatgattcatgagaaattcttggttagtaaatatttaatccagattttataattgcctaaatctctttataggttatttcttgcaatatttcaagatcctgagtcagccatgcttatacaagcaaacttttatttactgtgtttctttgtgcatctctggtgtctattaacatagtacctgaatgagacagtttaaattcaaaggaagtttttgcctgaaggagaacagaagaattgggctcaatgggaattctatatgagtatctgagggcagaatttaggctactggaagggcagttagtagctagggatttaaaccactacaacaaagttttaaggaagaaaagaggtggcaatattattggggcttttttgttcccttactttccccaagtagaattattttgaaaaaacaaaaaacttaattgcacagagtattctcaaattatgtcatcctgaaatctgtcttgaatgtcattcagattctctatagtacagcttttatagatttaactgataccaaatctttcagccttgcagaagtaatatgaaaatataaggaaaacaactcctctattcgtagcatatgtctaaatactttattataaaaatgtcatatttaagtttaagagccaataatttatatagtaaaattcctagtatttttcagcagaaaaaagaaatataacacacacttatttccccagcattaaattagcatgtttcagccttaatattctcatatttgtattcttttaactacagaaatcatacatgtagttttatattttttaaaggcaaagagtggggaataaaacaatgttctttttgacatctgtagattgttctgtttccttcttttcctgtccacaaagccaccactgtaagtctgaccagtatcgttccaacgacttctacgtgtacagatatatatgtatacacacagtagtacatagcattgtgtgatatatatatgaagtagtctttaccacatcaaaagacaaagtgaaagaaattacaaatttaaaatccagaatgtaaactaaaaattctagattcagacttcagtggaaggaagaaataatctctcttgtttaatagcaatagattctgtgccctagggaagggaagctccttagggcacatagctaattagtgaaagagttctagtgggacaagatctcttattttctagtgcaatgcattttccatagcaacaggccaataatcgctaagtcacgtatcacatactatactatatttcttttcgtgtgtgtgtgtgtgtgcgtgtgtgcacgtacacatgcaagtgatgtgtgagtagagaaatcacatattggattacttaagttaaaaaagaaaatatgtgacattctgttcaatgtaaaaaaacaaataacgaacatataccatgcagtaggcattatgccagccagtgtaagagcaaagaaaatcaaaggagaaaaaaaaatgtctattctcattgggcttatagtttaacggaacaagattgaaaaacacagccacaatgattgtgagtgtgtgttttagtgtgtaaaaaatattaatttagttaaaagttacacaagaccccagagacaaggcaactgtttccatacctatgtatgttttctatggctacttcttccaaatatggcctctaccaacacacattgcccaataaagtagggaacttactatgggaaaaggagctgtgcctcagcaatgtaggcagagtatgtgaacgtcaagtcataacacccatatctctccaagcatatttaacattgaaataactttaacacagcccatgacaagtttaaggcaacaacacttcctatagactcatggcaagtgttcctatagcccatggcaacaatacttcctatagactatactaaataacaaagaagaagtacaaatgattctaacgaacagttatataagttgatagtcctgaatatattttaatcagctttagcataatcctatcatgtattttaaaaagtctttttactagatatttttaatggaaagtgaacaatttgcattaaaattaagttaattttgttgttaatgctaaattagacccatttgtgcaaggatgataaaacatgctttaattgtgtagttgcatcacaggtgccatttagtttgttctttcaaacattatctctgtaaatatacatattttttctttcttttatatggaagtaaattaattagatgtcatctgtagcacaatgctggacacaaagcaggtgctcaaaaataatcatttgatgaacattagagatttttggggtttttctgagttacaaagtctgaatatttataaccatatactaatttaaattgaatacttagccagagaaatcaaatttaacagactatatagcaaattcctgatagcactgtacccataacatcttaaatgttgcaggatgtataactctatttttcaaaaatattttattaggctctttcagaacaattgtagggaagaaaagaaatttcagaaaaaggaacagtttgtagtttgtggactgttacaattaatcattacactatgaattagatcatatctgttatacagatgaaagaactgaggttgaatgactataatccttaatgcctttggttgtaattctggaaaaacatttctgaaaaaaagctagttttgctttttttaaatttttttctgaaaaactgaaacaatttttaagtcagaaaatccaactttctccattatcaaacacctcttctgacttctacttatgatttctagccgccaaaaatgcctctggcataaagatttttgtatatgtttttaaagtataattttaaatcacacttctatttgataattggaaagatgcttaaaaaaagatctttcctaaccttttcatcttatacataaaaaatgaggctcagagaagtgaaatattttgctaaacatcagaatataatactggcagatgtgtaacaagaattgaatcctcactactagttcaatgatctctgaatgctccacttctaccaatttccagaattaatattgcagttaatttctagtacctttagtgatataattatagataaaaaatagtaatgacataatcaaggatgccttaatatctctattaaaattagtttagatctaaaatcaaccaatatcaaaaattatgaaaaatacaaagtaaattgggtaacaggaaaaaaacacagttatatttaattataagtacacagcagcaaacagttcagattgttgatgcttttgatgaccattaatgcaaaaggattatggattatggcactgtattatgaatagacaaaaagattagtgaaaagttgtttagcctagtagacattttgacgctttctgcgtgaaattgaaagataaaccagagaaccattgaaagttcatgtatcaattaataggtcaagtaaaaatgtatctaaaattcaacaagaagagattgttttctatttcagttttcaaatgcaaggtagtgaactgaaatcaaatcaacaaaataaatggtcccaaggactcttattataagtatacaaatgtgtaactcccaggaaatgaaaatataaatgggtataaatgagaagaagctataaaaacaaagcaatccaaactacaaataaagcctaatctactgacagtagctccacataataacctagaacaatttttaaataaataaaactcaagcattagctgacaaaaattatgaatgaagacctaagaagtaaaaaaatctacttaaatatatttccaagcatataagtatttttttaacttatgatgtgggagctgctcattgtataagattaataaaaaggatttcagaaaaacatttacttaaaaaatcataaatattaatcatatttttaaaattccataataaaaatctcatctcacaatttaatgtagcatatattaaaaatattccataataaaaatctgatctcataatttaatatagctttcaataatagaaaaatagctccaaatcaccttctaaaaaacttcattaaactgacacagacaacaaaccttattaaaaatttatacaaaacaaccatcatcatatacaattttcttcacatctcaataaacattaactaatgcagttgagtgaaagtcatacatattggccgggcatggtggctcacgcctttaatcccagcattttgggaggttgaggcaggtagattgcttaaggccaggagatcaagaccagcctggtcaaaatggtgaaaccttgtctctactaaaattacaaaaattagctgggcatggtggtgcatgcctgtaatcccagctactcaggaggctgaggcaggggaattgcttgaacctaggagatggaggttgcagtgagtcaaaatagtgccactgcactccagcctgggtgacagaggaagactctgtctcaaaaaaaaaaacaaaaaaaaaaaaaacatacatttgtaagtgtatgatgtgtataagatgatgatgatatgtgtgtgtagagagaatatgaactctctccagagagagtcaacgaagtatttttctataccagttcccttagaaaatcagaatcagaattgacactaaatacaaaaatttatattttcttcaacagtattaaatttaccaagtaataaagaggataatctcttgcatttactgttactataccattatagaaataaaataaagctaatttccaaggataccatttctgttctacttttattttgctgttaagaatatacaaatatggaacaaatacaaggttttattacacaattcattccaatggaaaaactatgtagaagcatccaacatgcaaaccattttatggattgcctatttattttatttgaaatagtaaatattagagataaaacaaaaagtacactaaaactgagaaattcgtgtctctatttctacccaaataatcttaaatatattcaaagagggattttatttggagtcaatcatctgatttttgttgttgttgttcttgtttcatctcactttgtctaataatattttgtcttaaatattaaaatcagagtaattatactgaaattatatatacaaaactgtatttcaacctgtaaattataattcttactagctattgtcaatcactctatgaaaagttgtatcgctttaaaatttgtcagaaacagcttcttttataaatctgttctatcaaaactatacttacaatataaaaaactcttcaaaaatttactttttaaaattccaaaatgtttaatactgcctagaattttaaaattgtcttaaagttagaaaaatgattaaaatatgataattaaaaagtatactataaccaaattttaaaacaccttatatataaataatacagctctatttgcctactcgaaacagcttctaaagtcaagtcaggaaagcaaatgactgtagggggtttgatagagtgtaaaatcttggatgcataaatctcattcaggttcacttccatatgccctgagggcaaagccaggcatgaagcctttgccatattacctactgaactgggtcatacgtggtaatatttgctgtatggtcttgtgatgaggcagcatagggagaaccagctggccaaggctaatgcaccatctggactgaaaaaatattgccaattccattggcagagcagaaacagagtttgtaatcgagctataaatcacaagcaggtcttgcaagttgtcaattaaaagtctgatatattgatgtcctcaatgcatgggtgacttcttgcttttaaaatattgctatttacataatagaactcttttaaatatcaatctctacctaataaaaaattactcaaagcacccataagaaacaaattcagcacattaagaaatgtgactcacaaaaccacaaaaaatgaagagaagacatatatgttgatcacacagctatagtggaatttctgtgttcaaatgacacagatttttgaacctcaaaatttaaaacttcaactcaaagaattttcactgattatattatcttcatgtttctctctgtttcaaatgaaaagaaaacgtatgcatatgcacttactctttcatacacatacacacacacaaattattgtacactatgccgccaaattactgacatcacgacacagtggaaagaacaggggttttagagtcaagtaaacctgagctcaaattcctgttccgttgcttactagttctatggtattgtaccagttacttaatatttgtgaatcacagtgatgctgcagtgatgttagaaggattagcaataatatatgtaaagtaacaagtacatagtagctgcacagtaaatggcagctgcattactgtgacgtaggcaaatgatacatttggacaatctttgattctttgatttaaatgttgtatgcatgtttccaatcagaataaatacgtgaattttagccagaaagcagagaacataaaacttaaattgcttagtaataaagtttttgccagccattcatcaaagccatatttcatgcagttaactcttaatgttttgttgttttatttttgtttttaatttgttttttgaggttatctcaattagatgatcccaggattgatcaagctctgttgtctttctgtaagaacttcttggataatcacttgacaactcaatcaatatgtaattcattgagcattcgataggtgaagcagcactatattaggtactttataaatttaatctataatgatgtattagcaatcatagggaacaccatgatggtcagtgttcagacttgatgaagactgaagcatgagagagggccagacagatattgtagagtccgtgcagctttctactaatttctatttaccaataaatatgcctgggataatataggagaattatagaaaggaacaaggaaactaatcaaggagaaagtagagggtggtttccaatgagagaatttcatctgcttctaatctaaaaaaaaaagacattgacatattcaatttgtagtgtcatatataacagttcttcagtaatgtaaagaactatttcaaggtcatatattagcatttggaggaatatcaaaattaatatattcaagataacagaattaaatcagtataccctctccatcctcttctctctctctgcctctataacagataatttgcacactcccttccccagtccattatctgccttgcgccataactctgcaggctgaccctctggactgcatcttgtttgccaactggcttcaatctgaatgtagacaatctgaggaaatcctcaggagaagtttggagagcaagaagacagagacttttaggtgttcactaaggcttggaccagggtgaggcaagcaaggcattcagggcatgaaatttatgaacaaaatcaaccttagagactaaccacacccaccaactccatcctaagtctttgcaaccctcaaaactacagctctctccagatagactctccttcatgatttcaactctccttggactggtcagcctgaagggtggtaatgactcaccaacgctactaatccttcttcactgtcccttatttttttccctcccaggctcataactcgaggttaaactctcttttatacaagaaccctgtctgatgaagcatcatttcagaattttaagtcaacttacaaatgtggtattattcacatctgagtacaaatttaggactactatcatttattgagtatacaaatatttataaagatcactatttttgtataagaagtggccttaaaattaattggtagcaatacataatccactttagattatccaataaaacagttttggctttcaattaaaattaatgtgtgtgtatggtacatgtttgcacaaaaaccacttcattggaacaaagaacgatttgttgttggattacatttctagttcttcatccctagccaaaattgacatttttaaacattaatgtaacctttgtgataaaagcagattaaatcgatggtatatatgtgatccagttttgcctgtttcttaaagctaacaattcataattcatttggtcataaatgttataacactaaaagacacataagctttttataaagggataatatatctaaagctaatattttcattttgcaaaggataaacctgaatgaaagacacagaaagacttgaaagatcaaacaaaacattatttgatcactggctactaaaaaataaacttttacttacagtttttagataaacatgtctaatattttaataatctcaaataaagtaaatatttccagaaaacctagaaagatgatgaaaaagggtgtatataatgcatactcaaatctaattttaagttaatgtaattgtatatatcaaatgaccaatagcaatgagtccattatttattataaagatatttttgaccaaacttcctcaaaatactacatgaaaaactgataaatgcaaattcaatgtaaaaatatttgaattttgaaataaagtaagttcaatatagtcataaaaataatgaaatagcaaataagtaagaacattttcttatttgaagatggaagacagtgctgaaatctgatgctttaattatgttttgtttgaaatgtaaaatattgagtaaaatgtattattatcttactacaatttgttttcactaatagttctttttaacaagaatcttttggaaactgaacaaatcataaagaacttaaaaaacaattggactgctctaggtagaacattgtcacttttcattaatgttcttttatgctgcttgaagatcaatcatattctataccatctagtaaaaaaagatcagtttctacatggagtgaaatgctttgtatgtgctttacatcatgaataaatacaatcacagatttgtttatctttctgtatcatctaattcagaagataaaaattgcatatttgctattttctaactttgctgttaggaattaaaaaacaatattctatggctatgaaaatttttctttcagagaaagaaaaactccagagtagcttctcttattggaaaatagttttccctgaggaactgtcataactagtcctcagcccctgtcaagtctgcagagtcctttcaagaagctcactgtaggcaagacaagagtagtacttcttccctattttacactacctgaggaactcactacctctcatgtctaagatactaccatctttaatctttctcattatcctcacttagaacctttccatatgcaaaacatttactaagagcttcaccaaaggaattaaagaacatgctttttgcagagctgcctccacaagatacaatgaaatcagacgcaatagcaaaatgatttttttgttgagacagaaattaggtgagtagcattttaatggatatagtaaatatcagataaaccaaagtttaaagaagccctcaaaactgggaggaataattacctcaaatagttacatgtcattttcttcatctggaaataatagtctaatgtattatatagcaagttctctttcattgtgaaatactttacatgataataattatcataataatagctaatatttattgtgagctcagtttttaaagtgtcagtcactgagttaaaggctttatataaattatctcatttaaccctcattataatttgtgagctaagtattataattactgataccatctcacagaccaaaagagtgaggcatgtatcagatcacacacagacaataatacaagaaatgactaacaaatcagaccaacatgctacactgcttccctacattataaatgaggcaggagctcacagctcataatgacaccaattacttttgccatacattttggaatcattatggttcattaaatcctaatattggtattaatgctggccaatccctttttgaagaatgcaatgattatcttctcaattttaagaaacaatttatgggaaggtttaagttgtttacaaatatgtaatacgaaaaagtatgtaaagtactcattgttttagaaaccatataaaaaggcatacattctcattaaatgcatgtatttcttccacgaatatttgagtgtcgaccatgtaaaaggaactgtcctaggtgctgtgaaaccttcccctgagattttcctttgagtctcattactgaatatctatatataataatggcagggacacagaggtaatgatatagcattatttagaaataatagcccatataatgccagcatggtatcaccatcttaggcatcagaataagcagcaggcccctggaaacagatttcaagcactaatgagcagcgatagccaaccaaacagcagtctgttgtttgaaaaagattggtgaatctttataatagtttttcacaaactatctatctctttcaattcagtttcttttgtgcataatactgctgcatagcacggcagaaattttgtttgtttcaagtttgacattttaactaccctgtcctacattaaatcagttggagatagtcttcaaatgtgactcacagaaaacagcaaatcttttcactaaaatataaactcatagccccacattttcatttccccctcccttgttacctaaatcattgaagcaaaaatgagaaaagtcattacatcagcgaattagttcgcccaagcagtagcctcaaaccacaggttaatttgaactgttcacatataattacttaaaagaggaaaggattcattacttttgtggtgtttgctggttcactgaaccattgttggagattgtcaataaacaaattacatctaacactgtacccttctgctgaacagtcccctgagaatatcaacttgcacactatgctttctttcattttgtgtgtgtgacccatattcacatgctcttgattttaacattttaaaacactgtcaattacataaaaccaatctaagcagtcaaatataaataggactattaaataaaacatatatgttgttacacagggttcgcgtgttttttaagcaagagcttcacaaatgtgaccctaaaattttaagtagagtagtacgtctgaatttttcttgtgagactgtccttaactttgattagctttttaaaatatcccagcctacaaaaaatatcaagaaaactgttttgaataatgactaaaaactaagaaagcagtaaatcgagatgtgataagaggagtggggtgacgggaaccacttattcaccacaaacaaggggccagagttaaatatatctactatattatctcatgagatgctcaaaacataagggtgatagaactacctcgatttttagatgaaccattaacaatggactaagagaacctgcgttcgaatcttaatgtttttgactcttgcgtaaacgtatccctttaatgtgcaaatatcactaattctgtctgtttcactcagacattataaagataaattttagaaaaataccgcaatacctctacatgtgcttcactcaggtctctataaagtaaagatgctttataggtaacagttttgattcaaaaagatgtctggaaagcaaaatatttcttcattgatgtcctttattaaacaagaatatgcttccattaaaagtgtttcccataaactatgttaaaagatttgtacagttaagtagttagtacttggctggatcattattgttagatggtttgcattgatatgcttttttttttttttagcactttcaaaacattataaacctttcctttcctgattcaaggacctgccttcatcttaccatgtcttcctctataacagttatactctaatatctgaaaatccccagatattatattatcgcttctatttttccttttctttgttttttcttacaatgttaaacaaaaagaaacttaagcatcacatgtattcattaggcatatcccaattccctgtaatgtataacctgaaaattttaaatagggtaaaatgaattgaattaaagattagagaccaatatatctcactgaacaaaatacgagcactgtaatacatctcacaaatttgtcttaatctgtgttatatcatgtgactctgaaatagtttattcaatcaactgatattaattaagcatttaatttgaccagtcatcctgctaggtgttggacatatcttggtaaacatgacaaatttggaactctctccagtgtagtaacttttgtaacaggtcctaatattgtcagtactgatgcatatggattcatagattacacaccacacacttctaggcattaccgtttgcacatacaatattaatggtccccccatgcaagttccctcagaggtcctgaaatccatatgtcatcataattctctgcttcttaaaaatgaatatgtggcccaggaggcatgtaacttatagggtaaacatagttttgagctttgaaaaataacatcacatcttattttttaaaataaaaacataaagttgaaaatccacatacaacttttaagataaaagactttcaagaaatgcaacgctattgagaagggtaacattggcaggggtatcctatgtcactaaggatataagacatacttgaccaatactgtgccttgttgcttttgatacactctcattataaccattagctaatgtggggtagttggaatatcatctgatttaaatttgggctgattgattatgccatttactagacatgtgatcttgggcaagttacttaaatgttgtgaacctcagtttacccatttgtattatgaagccaacactaccttcttcaataaacttcactggggttttatatctagatcacctggtacacaggaaattgagaaaagtcatcagttctttacatctctccctggagttattagatatgtgctgataagaagacaatatatttaatacaaatgtttaataattgcttgacataagctatagagtagacataaggtatttatataaaatctccttgttgtataatatctactctagcagtgttcagtataacagaatcaatcttgtggtataacagctattcttccacaactgcatgtgtttgaatttacaagccatcaaaataaggggtgaattagagtccattttattacctcatataattgcagtacgataaaacattggcaaaatatgagtttcagaattttctaagcaatcaccttctctatttttattagggaagcagtatctcaaaagtcaaataatttctgtaattgaagaaagagatgaatggctcttgtgaacctccaaaaggataaaatgttatgatcttctgtaaaacatgaataaatattttagatttgcctaagtaattagtgggattttattttaagatagcacttattgtgattgttaagaaaacacacatgagcatgtatttcatttccatttaaatgaattatctttccttaattctgaagctatcatttctatgtatagacataaaaaattgtttatcccaacaagtaatagaggagattcactcctgaaaaggtgtttaggaagaaaagatgaaagagggggaggagaaagaagaataaaggaagcagaagagaaagaagagaggatgagggaaaaatggggaaagaagaggagtgtagggagaaagaaagacctaagtttattattttcttaggtggaggaagattcacatttgcattccaggggtaagtggaccaaaaggaggcagaaaaccaccctgaattatcccatcatcgcttaactgtcttttatagaaagggcaggaaaagcagtgcctttcagcaaaagtgagcatttctccatatttctgtctccttcagtgcttaatggattagggagcttcagacaggagggatgttcaggatttctccctatttcactttattgacaaaacactccaattatgtatatttgattataccctctgctagatcatgtcagtataggaatggatctttatccacagctataaagacatttattactttctaacagacttaagttcacaaattgggaggaactttgttctactgatatttgatccttgtaaatcctgagaacagactctatttatctagcacgtgtttaatactgcttaagccctgaaagttgtaaaaattggaagtagtcttatggaagtcttcctgaatgttaaatacatcttagaattacagtttaattttgtaatagattacttattcaagccactatatttttaatatgtgactacatttcccaaaagtatagttagttttgatgagtccaaatcaagtattattgatcaagaactcagaattgagtagttttaaaataaagacaaatatttgaaatcagagtcagcttttgctactagccatgttcttgttttcacaaagccatgttttccctgagacacttagctgatcttataaatatttaatgcagggtagaagtgcagggaagaagaaatatcttttgaaatggactctataacaaaattaaaagtaggaacaatggaaacaggggaaaaccaactaaagacaaatgatttaaaaaatagataactttcctaatttttcaactcaagaagtagaaaatatactatcttccttcttttatacttatgctttgatttctacagagacgtgataagcaatatcagatactggagatttcaaactatacgtataccagcaattttgttgtggagaatgtgacttggtcaaaatgctttcagcagaatcaaaactaagggatgtttagaaattcaagaagaatgtggaagaagaaattataaaatatttctgtacaaccggtggtggtagaggagaggtgtttggcaacgtgtattttagaaccaatcacggaaagcccgtgaaactaattctctcccaatttcccctgccattccaaactatacctgaatatggaaacattctaataaactagtaacaaaaatactttgttcaatgtcttagaaaatttattccacacactaaagtcaacatgcatgagaacacgtttggcctgtgtctgggctggcctgggcaaatggtactggcttgataaagaacacatattttttttatttgtagcatatccagagacttatttctaccaatcaatctaggtgtccaaatgtattcttagccacccccacagaaattgcccaaaatgtgccaagttattgaaaaagcatcaatgagcatttgatttctcatacaagacataaatcagaactggaccagaatctaatgatgccacaagggtggaaggttgacacaaaattcacatggccattttccaccctgtaaggtttccatatttagtcctcaagaacctgagcccttctagtaactaaaaaagctaaagttctttagagcaatttcaatagagaagaaatattgaaacctacaataaaaaaacagtgtctagaaacctaatttatatgtaatcagagaaagattagaatccataacaattctaaatattaattttagcattgtgtgtatatgttagtatatatgtgtgtatgcgtacatgtctgtgtgtgtgtgtatatatatataattagccaataacaagagagaaatataaatttaacattaaaatactaataaggcacttaaaatattttgttcatataaaaaagaaaaatatttattgaaacttatgaatgcccaacttataaatgccaaatattttattattttataatggttgatccagtctcctttcttttgaaaccagatacaataataactaagacttcttgatttttgtacatttagcagaaccaaatctattccctaagtcattactcttttcggagagccagtactcccaaaataaagaaaaactaattggtctattatcagtattaatgtatgctgtttagtgaggacgtactctaaacaagacactttgtgaaatactgtgcataaattatcttggttaatatattaatgatttttattccactaatagtgattttatgagtattcttctaaaaataaatagtatttaattggtcaagattgtacagaaaaatacactccatatttctgtaactctgtttctactacctatatgatggttgtataactcctcacattcttaatattagagtcatacattttctctatcaagggaaactaccatgagatgaatcaaagcaaaaaaaacctgactccttaacattttgaaaacatttccagtatgcctcactatggtagaaactggaatgtaaaatattatgacttcatttgatagtttttatggattaaaatatcaccacaaaataactacatggcaacacttgataaaaatacattttaaaagtaaatacaaataaaacagaaacaattacaacatttacataattatagatcatgttcctaatcatgtccctgtacattaaaagaaatgtatctgttaagtacacaaacttaatgaattttaaaaagaaacatattcaaaaatcaaagtggttattctgagaaaatatgattgtaaaaatagcctcaatgttttttagacatgctaaaataatttatttgaagccaatgatatctgtataagtaaatctgctaaacatgtgaaatatttactttggttgtttatgcacaaacagctaattaagttgtcaatattatattcgaacatgcacatatacatatatactgataaacattcccagttgaatgctttaaaaatataataagattcctttttatgtgcaacagtagataatatatagtagtattctgcttttatttgattttcatataaagaagtaaaaactctatgtctgaccactccccaaaaaatacaatatttaattgcacttgacatttctaattcagcaagactattgttttccttccattttagatgcagtatttcaagaagaaaacaaacaaactctataaacgaaagcctctctgagtatacacaaacacaaaccccatcttagcactgtgaggcacaggaaactcctgcatgatggatggttgctttgctagaacagtcagccatggacactcttttgcccctttgccccatttctttatttaattatatggcactgggaataccaagcaatgaaattgcattttcatccatagctgatttccatttagagcttgtcatgttaatagtgaaataaattgctctaattgccagaaaacttcatcaaattcacatttcttccttattttattcaatatttattaaactgcatatcctaacatgcctgcctggtaaaagcagcccagtttctgaataaatttataccctaacatttggtgctgccacttatttttttttactagtgttctaatttacttcttaaagtttggatgcatttattcatattgtttttggaaatgtttattatgaagagttacttacaaatttacttacccaaagttatttgacacttagaaaatataataatttaaataaaaaccaattaaaattacttatgtcttctgttaatataagatttaattgtaagatttctggatggcatttttaattgactaaaaaatattttggttcccataacacattattcctgaaatacttccaaaaaccatttgagagagtttaaaatgaaaggccaaattatcattaaattattgagtaagagaacagacttcaaaataaaaagtacatcaaacttgaagtcagaaggcctacattccaatcagagctcagttactcattatctgtgtatcctgggctcagtcatttagtctctcaaagcctcagtttccccctatgctaaccaaagaactggatcagatgacctttcagatccccattagctctaaaagctatcattctcataatagaggaagaagagatgaggagagcaaagagttaatctgacagcagggtagttcctctgactaaatacaaatattagttcttggatccccaggcaaaaataaatcatgctgactattggcaaaaaaaaaagaggaaattttaactaatgctttaaaaatatattgcaatagtactttgaattgcataataaaattattcaatactagttataaaaagtatgcagaaatagctaccactttgcccttttttatgtccaccaagaacacaatattagattgctgttctgaaatgcattttcgcacagtttttatgtaatacagacaaggttttcgatttctaatcatttatctacatgaaaagcatagagaattgaggagaataaacatttagtatgtttctaggacgggtcctttcaaataagaattattttgtgtcttttactatcacatacaccatatgagattgagatcacagtctagtgtttaaaatacagagatttcatgtagttgctttaaatagcaggtaacatgatgcaaattaatattttcttttgaaaattaaaatatttgattttctttgccccagaacaggccaccacactttatttcaaagagttctctaggagcagccaaaggtagactaatgtttttgaacagcagcattgcatcttctcacatgtttaacggaatactagattgaagtccccgatccatgcattataaccaagagacaacgttatctgaatttttgagaaaggagttgttgtattttctatctctaccttaattctctccaaaaaaaattcctccacaattttatagaaaaattgatacagagctgaatgagctcagatgagagttgtctaataaaaatacttggttgtttattttgacataaatgtcaatcattgaagaaacataggcacaccgtctggcatgtaataggtattaaatattaactgaatctgaattaatatggacctcatttttctgaatattaccagccaaattatagtatattcggaatcattcacaaaaataattagtttttctcattcatacattctttgcagaggacagcaagaatcctgaatgtataacacttcatattatttagatactagttataaatgaatgagtctgaggaaacaattttgtttataacatttagaactggcattttctctatgaaacgtctcattgctacctacatccattctccaagtggtatttctttaaaaggttctgaagaagctttaaaagaccagaatttatttgaagttatatagtttgacctctagacaccttctgtttaaagtattaaaggttgatcaatatattttgctaaaatatcttgccctcaacatcttttcccctcaactaaagagaaaaaagttagcaatgatcactagaaaaaaggctgtatgcctaaatcctatgagttctctatgcacgatactaggtaatgaaacccaggcatgtatttccttgagggtaaagtggattaaatgtgttgaagcaatattcaataggcttaacattctataatttggccaagctataagattatccttttggtagtcaaagtaaattaaaatttgcaagcatactggggaaactacattagaatagttaactaggggaaatatttccataggatttgggtccataacccaatattgggtaaaaataaccccagctgaagaaaaagtaatctcccttgaggaggttcttttcaatttaaagtgtataaaattgctacagtaagttaatttgaggaaggatactctggtttatcaaatttagaatgagcatcacagaacactaaattagaagcaagctcacctaacatcagtgcaaattttaaaactggaacaatgacagtttatgaagaaatatggagaaaaataactatttaaatatcttgataagttaacaccctctgatttgagaaccagactatttacgtaatccaaagaaaaatacaaccaatcaacacttttagtctgttttgattttccactcatttaaacctgcaagcacataaaggacataatccttaaggaatttataatatacactgattaacatatttatccaccaaatattcattgaatacttattataaaataaatgcttggttaggcactttagcaaagatgaatgaaacagttttagttttagtcctttttcatgtttaaaataaagacaatgagaattacctggtgagattatcatgagactaaaagactagaatgagatgtttataaaaagtatctagcagagtgactggtgaatagcaggcactcaatcagtatttgttatcattccctagcatagaaagcaaataagtactctttaaatagtaattttaagatgatgtaactaattcaataaccaaataacaatcaaagactcttcaagtcattagttacatatgtatttgcacctctctgctgcaaatctgtgtcatggttttcaatgccatggtaagctttgagggtattttttttttaagcaatcagagactttcaaagatttgtttttcagaataaaattaggacagttgtgttcttattaatgacaagtgacaaattttaaactgtattctatttaaactcaggagatgttatcatcctatataataaaaaaaaacttttaaaatactaaaattgtatatcaacatgttgggccatgttttcagtgctggagttcaacccttgaagtaaaattttaaggctctaactccccaaatgttaaggtataatgtaactgattctatagaaatagatgcatttttctaagtaagtaaacaggtttctataataaactgcccctcagttaaaagtcagtttattttcataaagtctaatatagggactattctatttttaattattttatcaaatctaaaattagaaattcaccattctccatgttataactataattattaaaattaacactattttaatatctttcaatttgcattttcatttattcaaatatcatcaccttaaacactgttaattatactctattgttcaagacatcaaatttatgtctctttatagcggcatcagtagagacactgacagatgatattcagcctccctctattggggaacaaggcgaaaacattaacctgattaacccatgttacttctctgaaattattagtgaatatttgtttttctttttcatgccaccaatattttttactccttacagcttattatacataggcatgtgtttgaaagctatgagatttcaatttactttgtctggcagctgttccctaagtaattttgcgtgaaccatctaatctctctgttttgagcttcatatatatgtatatgtgtgtgtgtgtgtgtgtgtgtgtgtgtgtgtgtatatatatatattccagaagtttatagtccaaactaaactaaaaattgggagaaaaattaactgaaaaatattttattttccaaaaaacccagaaatttaatgattgctattttaccatgaaaatcaggaaatattcatgagctatccagttcatacagcaccagtgtctggtagaagtagaatgtaaaatgttctcgcagtcaccatttaaaaagttaaaaaaaaaatgaaattcatttacataatatatttaatatatccacataaaattatcaatgagctattttacattcttttctatgtagtaatcctttaaatctggcatctattttacatgtaaagcatagcctgttttgcactagtcacatttcaagtgctcgatagtcacagtgacttctgtactagaacagatgttgacagtacaaacttccttgagactaggactttgtttacctatttctaatgactaggacattacttgatacacagtagaaatccaacatttattaaatgaatttgtcaaattagtaacttaggttagagataggggtcatcaaatttttatatccaatcagaggggctaacaatatatgccggaatactactggcagaatatgtaataaatgaataggaaaatagagaaaaataaaaataatatagaatgagataaaagtgaaaaagaaagaaacaaaggagttacacaatagaacaaaaaagaaacagatatggaagaatgagggagaatcccatcaactgttaacacacccatcctgagttttaaaataaatcctatcaccatagagttgcaatttagaaaagaacaggctgttgactgcccattaaagctatatatctgaatatgtcactatgtttagcactgatcatttttaataccagtttgtaaagataaaatgaatttgtttctttaaatgcctactttcagactattgtctggagagaatcaaaactatatgaaaaaagtagactgatcacatgcatccacctctcctcaagtcctaaattttttaaaaaccacaaatgggaccattttgcagaatatattcataacaattttggaaataaaaaagcttctatccattaaccagaagcaaaaagtttctatcagttaaccagaagcaatgacatttcccagatggaagaaattagatgacatcaaactaacaaatgcagagaaagccacatctacagcctaaaatgtgcacaagagaaatctattagagcaaacataaagacacataaactcaactcctggtgaataaatacagaaagggagaggatgcccaggggcaactgtcaaaatcgtgatttaaagattttcaatctaacactgaaaacagttcaactcttcaacccctatatgagtagattttgccttgagataaagccacccagttgtactctgaagaaagcgaagatttttcctggataggcatagggtcttgaagtctctctcataatcctatgtttcacattgtaactgcagggggagaaagcaaatgaaatgactttcccttcaaggaactactctaggatggccccggtcagaaaaagaccctgtttatttggtgaaactggggaattcctaacttgtctgccttctcaatatgaacattgtaaagtgagactactcttgtttgctgccatatatacttgaattttttttaatttagtgaaagttgttgagtggtaaaattttcaagactcattgaattagaaattatgcagtttgtccatgaaattgtgtattatccatcttccaattagattatacattctaataaaatgtctattttagcctcaaattcattaatttagtgcactaaaattttttttcttgctactgatattgttggcaagtactctttccaaattacataagaatcaattgtcaaattaaaaagcaaacattctaattaaactattttaagcatgcaagcaatatatatagttctgtaaaaattaatatagaatccaaatatattcagaaaaaaattatcttgttttctattgaagtgattgatcaagatggaaaacagcaggtatatatctgaatatattaaattgaacagctttagattagagtgaagcagtttggctttattcttatttgctttattttgcttctcctcctcctcttcttccttattttagaagcaaaagcagaactgaacaacatagtattaataaggaaaaaaaataaaatcattttgattgtaaattttcagaaaaatcagtatatttttaaaagttactatgagctaaatcagtagtaagcccttatagttttaaattcatccactaaagaaaaattaatgtctttttttaattttcaaagtacagtgaataatactggaaatattttggcaagtttcttttcatatggtaaggacagtggaacatgtagacaatttagaaattaatgaaaccgtattaaggtaaatatatccaatttggataccatatagtaatcaatgttatataccaaagtgttcttccatttacaaaccagtctataacatatttttgttatgcataaatgttattactgacacaaattagaaattgaaaagagccaataaacattccagagaataccaacacaatataactttactatcaaataaggtaaataaaagatatcaactagaggtcttacaacttttgaaaaattaataaatttattctgcctacatgggcttattttgtgacagcattttcatttacataatttgattttcatatattttatatatctcagaacatgccaagtgtacaactaattctggtatatatatataactaactccagtatataactaactctactgtagctcttcttttttactgtcaatgattctagtttattaatatcatataatatgtatactttgatattaaaatgtctcaacttaaaataatagatgtaattcaatgctatgctcgtctatcccatctgtgtagaagcacaattaacatgccattttatgaatatcatgaaatctcttagaatggcattttaacactattcccacaagtcacaatttagttttgttttccagaattattcattgagtgaatttttaaactatctttgtttcttcatttaaaaatttgtctttattcttaatatccttgggtaacatctattaatttggacccacttgcaactttcattaactactgttcaatctcctgaatcatcaaggtgttaaatgggatagaatctcaaagttcttgaggcatttttcagcatgaataaattttcatttgtgattatctccccttcatcccacaatttaaacaatctacaaactttcaaatacacttccagatactagccaaacagtgaaaaatatagttaaatcagttataagaccagaggtcttctcgctaaaataaagtaagatcctactttaagttggctaaatttatctttccctaaaatgctgaattcactaagacactgagttatgaaagcatgttattaaattattttcaaagttaactgagatcagttttgccaaaaatatttttaaaagcattgaattgaaaatcttgtttttaagtttgtatgagtacatagtttctcagactttgtctaccccttcctcaacttggttgacatttttacgttaatttttttcaagcactttttttctgaacacattcccaagaactgatgattcaaactatcacctctggtgagttaacagcatcccaaagtggatggcaagaagtttagatcaaagtctgtggtattacattaaaaaaaaaaagaaaagaaaaatgaaacagttaaattaattcattagaaaaaaattagttatttggttatcttgaaagttcttatcaagcctcaaaaattttcaattctactaagcagtatagaattttaaaaaaaatccaaaataaccatattttggtgattttttttaaaaagaatcaaattttgaagcttcaaaagatatttagaattaaaaactaattagcacgtgaatttacttattgcttaagttactaagagagaaattaaaggaaaatatcaattaataatgaaaagtattagtcaactgcttaattgtgatctccatccaggtcctttaatccagaaagagcctttctctttcatttactattctactcttggcaagtcatgataaatcatcatcaacattatttctttcattactttccattgctaacagatgtagggaccaagagcttaaattataattgtataatggactgaggctgaattaattaacaatcccaagcttgtgggagaatttaagctaatttatttggttttttaaaaggctagtcacagcttgaggtatctttctgtactttgagattactgaagtcatgagggaacaggagctttgagcattattacacaccaaaacagataagttttaagtactgtaggcaaggatttcagaaaatgggtatcagctacaagccttttaattttttttaatatttgattctactttactgctgttacacataacacttcaaaaatataaaagtataatattattttgctcctctgattttataataactcaagaaatgacaatgagcaagtaacacatcattttgagtatccgggctagaggttcactttctcttaattaaattagtctcagaaagactgcagcaattcaaaatgagaatccaacacgtggcttgtgaggaaattctaaataagatacacatagacacacatacacaagtatacacaaatgtttacacatatatcacacacataattattatttttctcttctaaatttccttaaaattatttttaaaacaggtatatagcaacaaataactttgattagatactgattctatgctggcaaaatagtaataatattgtacaagaactctaaagaatttgatgtgtcctattacagttatagtttcttgtttgcaacttttccggagctatacaaatatcctgccttatctgggtagaaagcacagttgctttggttttttacatggtctgtgtcacttccagttcacacaaagtggtacttagctttcctcgtcaccaaatacaatgtcagattccgggcattttgttaatacatggattttcaactttgaattctgatgccaaaggagagatgcatattatacaaaaaactttctgacacaacagagagccaattattttctaaaagtaacaattgaactcacagaagacatatgtacattacaatatgaagctaaatataaattcacagtcagctgcattattaaattcatcttaatctattaatagatatatctcaccaaatatatgaggaagtaaaaagctaaatattgattcctaacagacaaatgaaaaaaaagaaagttccaaataactatgtgagtgaccagaagcataaatagcatgctcatggctttaaataaaacaattatccctgagaaaactatcgatgattcacagaccacctttttttcctatgtatcttttactacttttctcctaatactatcctcaaaaacaataactactttttggatgattttttttctgttacttggagtagtatggtgcactgtaagagtcacacacgcccacatgcatgtacacacacacactgcaagggtgcccttttggatgccgtagaaatgtgtatttccttttacagaggtgggaatcacttgacaattgagcattaaagagcatctgaccccaaagtagtctttaatcaaatctgatggctatgcttttgcagaaagtgaatctgaagttcccccttttttccatcatcaatcttcttcagcctggcattcatcaagctgcatggaaattcgcattcacgctaagtaagctttcaggtgaatttactttggaaccccaaatgatccagtgtaaaggtccaaatcattctttcacagtattgcacccagatagtccctggcattctgataaaagtggtttgtcaataaaatgctgagcgaaattgcttgtttagatgtatggtgtcagttgagagactagtagctgagcaagcatcttcctaaaaaaaatggagagatttttgagtggttaaaaaacacttgcttgtgatggttgcaaaactatgtgtatacactaaaaaccactgacatgtacactctaaacaggtacatgtatgatatgagaattatgtctgtttcaataaaactgttttaaaaactacttgcttatagttctgtgaataaatgttagtttatcattaatctattttatgtactcagctgcaagtcgcaggagctattctgaggtgattatattaaagataactagattaaaatccagatgtttttcttcccttgctcatttgtgatatgttctttatttgatattttcaaaatcccatagttaatgaattttccaactaaaaatgtaaaattgttgagtgtctgagaaaaactcacaatgtcccaataaagtatttcagccatctctttacttttgtttccagtaagttcagatttttttttccaactaatagaaaatcagcatttgcaatcaaaaacataggctaaaaggaacccctggaaattccttgatcttttcagaatcttcattcaggtaggagagtaaaagagctttgtgatagtttaaaaacttttaccccaagatattacatcgattaaagaatcatattatatccttaattccaaagcaacagttcctaaattccagtcatcacctaaactaggaatcacttgaacagctggttaaaaacaagattccagaccacatggctaagactctgatgctttgaagttgaagtgagtacccacaatcagcattctaactaccacctcaggtgatttttaattcaagagatccttaaactatattttgcgaaattaatcatttttgtattatactatatagccaaaatatgtatttcaccctaaacatttaatttcacagaattcttagaattacagaagtttctaaataaagagaacttcaggaaggtatccagtccagtcccatgctttacagatgaaggacttaagatcaaaaaggataaatgtcatgcctcaaagcatacagatataaagtggtaaggctaggactagaacttactcactgggtttcaaatttttctgtttagtttcttcctgtgcctgtctacaatgaaaaaaaattctttaaataaattaacctatggaaaaagaagtttaacaaatagaaactacagaatcactttaaaacaatgctcaaaacttatcttttcaaaatccacacaaaagaagttaaaaaagagacagcaaaactatatgctttatccttccttaagttaattaaaataaaggcaaactttcattgaatacttatgcttgatccagatagccataggctaagtgttttattcttataatcctatgaagtaggtaaatttattatccctagtttacaaattcagtaaactgagtctcagaagtattatataaattgccaagagtcacacagccggtaagagggaaaggcagccctcaaatgaaggtctaaatgaaaaagcctttgtgcttaagggttcagtatgtattgtctataaatacacctgcttagtttgggttatattgttaaattggaggtatttaaagttatctgatataattactgttgtaatcagcatttctttcatttgcttgttttgcaaaattaggaacacaaaatagcacaatgaggaaagaactttttcccagtctattgttttatgtctttgatttctttcctcctcaaagggattgttttcaattagttatttcttttgctcaaaataaaagttgttacaaataaattgggttagtctctatagaaagagagagaaaaagacaaaaaaaaatcagaaaaaaaagaagtgtaataatatatcctccttgttgcaaattttattttatctagaacattttaccagctttaatagttgttttatgttttgtgggtaaactgaagctgactcagtggattggagttgagagagttgcctaaaacccaagtagattgttactaagttatattaataacaggtaaatctactgaacagaattatgtttcctgtggttttgcttaaaaggcttcttattttttatcatgtaagtcttgcccgaagctgaaacttccggtcttcttacctacaacagcacataatgaaggagacagagaaggtgaaagattttcacagcattactggccaatggcattttgctacatgccatggctacagagagccagtggggaccaatcctcaccatttttcagtgttctctttgcttcaggttcttgggataatagatataccacactttcaatccaaattcagtgatcccagctatgacatcactgaagtctatgtcacctccaatacctcaggactgtgaacttactaccactccaggcagctcattttgtggcacaagtcaaattgctcaaaatttattcctcttttagggtcaaaaatgggtcaacatataataacttctacctattgtttttacttttatgtagacaaacaaaatatgtctaacagttttcatacatcacagccttcaaatgtttgatagtaaggaacaaatacacccacctccttcccgcaggagtctaagttttaaacgtcctcagacattccaattcacttttcctgggtttagtttaactgttctggtttgtttgttgttttttatgattgctgttgttatttttgtgtttgtttatcttcttgctttgaggttaaatttgtttgttttacacaagtacttggcccaggtttctcaaaacattcaagtcagtttaatatgtaacctttctaaatgacatttctgtagcaagcataagcatttaaatccatgtaagattgaatctagctgtcacttaatatattatggccaaatggcaaagcaactttgcataagtgaaacattatttgttacaggaaactttgaattgcatataagtatatttttatctaacgtctcagtttttgattgagaagacagaagctccagtggctacaggttatagctcaagtcatatgcctcctgttttcttctaaaggctgatttccaagttagtaagcaattagaatgtatctctttatgtaaacaatgccagcccctttctcaaggcacatcatttaacacatatttgttctgtaagggtattaatggactacattatcaagataacttcatgtcgttccaaagctaggggccaagaacacaatatactctcatcttttcaagatctgaataggaatccaagcatcctccattccttccccaaaaatcccactccagataagtgggtggaattttcctccatacagccccaaagcagttgtttctgaatcttaaagcaaccagtggacaaatctaagcaagtaaaagtgatggcattgtactgaggtgagggaaaattacggattagggttccaggtttgcgggatggaaaaagtctgatatgttctgactgggtaaatctaccaggccgattactgggtacatctaccaggcagatttacgcagtcatacttttatttttttcctgtggctgccagcatatagcctaccaaatcccttacctactttcttaggggaatgaaatgcagtttcaagtacagtcttttttttttacttcttcttcttcttggtaatagtgaacaaataagaaataaagcatttagagaaaatgtactctgatcctccagttcctgatcacgttccttcttaacactccataggcaagagaaaagtgaaataaacattaactatagattttctcactaacaggactaaaggaaaatgtatttacatgacagaaaaaaaaaaacaacacaagattctggctattatattctgagttctcagaactggaaagaaggaaaggttgaaagtctctgagggcaggagtgaagctaggggaaaggcttgagggtgctaccaaaaagacaagcattgggacacagaaagccagggctaaaaaaaaacaaagaagctatcattcttatactttactctttttctctctggccctagggccaggtttgttgttttgttttgttttagtaacaggaggatcatgattacttgccctatataacctccccgtgttgttgtgagaatcaaatgaaacaattacagtaaagtgccttgaaaattgtaaagcatgacatcaatatattattattattacttgactccaaagtcttgtttggtaagaaaacgaaacaaaagaaaacctgaaaaaactgtttctttttgttgtttttatatttttatttttaaaacacagatatgaaaagcagaaatataccctattaccagaagttaaatgaaaaactctcactgtagagttttaatatgagataatcacagtggaaaaggaaaccgatggtaatcatctacattaaataaaatttgtgggctactacaaaaaggtgctcttttactaatactgtaacatgcactatgttattacaatgttttaagttttatattttgccatcgtgtaattatgatatattaatgccttataaagtgtaaagtgattaaagaacaactacgtttattaacaaattaattgagggactacagattcactaaggtaataaaggtaagcaaattcctaccaaatacatgtttttgtagaagttgacaagagcttaacttaattagaatctaatataatttaagacactgaactgtttatatggcagaattaaaaataaaacaacagactgggcatagtgcgtcatgcctataatactggcattttgggatcccaagagttcaagaccatcctgggcaacatagcaagacttcatctgtattaaaaatacaacaaaacattttgattagctgggcattgtggcacatgcctatacttccaactactggaagctgagatcacttgcaccaaggtgttcaaggctgcaataaactaggattgtaccattgcactccagcctgggcaagagagcaagattctttctcaaaaagataaaacaagaaaataaataaaaccacaacaaaacctgtatctttgctaatagctagacttaaatttgagaatctttgaagtacaattaggcattaaaaacacccctggaattatgcacagtgacttagatgtctcggtatcattcatggaatacccaccaagacatacattcttcataatttcttcaaaatgctaataagttgactttgtgttattaaaatggctacagagatggaatgttgccttcctgtggttgacagtttaagaagaataatataattaatagagaataatacgattttgttggtacaatgcaagtttatagatttcacagagtggatacaatatttatggtccttctttcatcttaggagtcattatcttatataactctgaactttgaaaattgagcctctatgcatgtatgtaaaatgctgaaatataaccctaaaaatataaaaatagttaggcttttctgttgaggctggaactgaagagtgaactggcttaggagaagacagaattggcctgggttctagacatgtgacttcgggcaaataacttcaccaacttgatctctcttttccttatgtgcataatagggatagtaagagctcttaaacaatgctgctgtgaagattgcctatgacaacaggaaaggtgcccaatttctgtcacctggtaaacactcaaaaaattgcctttctcttaaaatccaaacctctttaaaagctataaaaaaaaatccactattttaaaaactattttatgtgattactaaatgtcttctagaatatctaatctttatttaaaagatatttgaatgcgtatacattttagaactcctatcacattcactgcatgccaagtaactgttggggaagaggttattagatgaaaataagtctgttgtaaaagatttccttgcaattacttcactaccattaccctggccacatgctcatgcagcttttcaaattaatatgcctagattactgagccagtaatcagagaagtggaattctacgaggaactcaattactaaagaaaatgatcactcaagcatttgagaaattggggctacaaataattttgaatagtggatcattattgatattatggaagcattcggtacaaacatttggacatgtagcaccagaatagtgtttcattttatatacatatggtaaacagaactaattccttgctaatatttctgctaaatgttattctccctagccggaaaaaaaaatcattcttgaaatcagtacttaaaaaaaaatagggagctgattgcttgattgaataaaaattggattgttaactcacatttaaaataaactatttaatttttctacttcagatagagtaatcctttatacactagaaatacctatccaatgaaagcaaatttaagaatttttgtcactgtatttccataacacaaaattgcttaaatcctttcgtcagtgcattttaattatttcatcaccaaaagaacctcttttgactaaattattatgagattcatgtaccacgtttttactcatttaataatttttaatcaggcctttattttctccaaattagccatcatcctatctaagctcagttgcttttgatgaaaattatttttctaattctgatttttatctaagattgaaagcaaagactattttaagaatgctgctatatcttttttaaaaagcatgggagttaggaaaggtagtgtggggaagggtatgagcttgctatacttattgctctttgctctctaccaaggcaaacagtaaagaaaaatcatcaatatcatgatactttctaagaaatccagcagtcatcagctgtgtggccttcaggaagtgacttcacctctcaaagtttaataatataacataataatgacaatgattaatggtggtggtaataatgtagatactgccagcattccaaaaatgttataaacacaaagtaaacaaagtataaaagtgcttcaagagattattatgattattgtcagttatactttttagaatatcggttatttatcttttggagccatgtaccacactgaaaatatgctgaaagatttggtccctttccccagaaaaatgaatatatatgcagattgaaaacattaataaaatctcagaaatccatggcttttctggcacctctttattgactgacgtgttgaagaactacatcatggtagaagtcactggttgcccagtccggagccatgcccaccacacctcacgccttagtttgctctgccttcatcactaaatcctgaagtgttccagtatccaccaactcatacgaatttccagaatatcgtaagtcaacatgtgtacgacactcctcagtgaactggtaaactgtgacttctttccctctcctgctggatgtgaaaaaggcagcatgctatcacagttgctttcggcagccgtcttatgaccacacgaataaccagcaaggcctaaggtaaagccaaaagtgttaatggcaggtaacatagttaagcctctagaaaagtaacccgtattactctaaacttcctgttatattaaataagaaattactttacacatccttgaagtctcagttcagacattcacttggtgatgatgtcatggactgaaccaagaggaaatagtctgtcggcctctcactttgaaaacatctaatgtatatagagctttattatttaacccaatcattgtgtttaacattgagagtataacgaaaccatgaacagcttaggagcagcgggttttttgtttttgtttttttttcctttagttgattatattattgcattaacagaacaatgcctgctacataataggaattctacatctgtttagtggatcggtgaataatagaatgtgattgattttgaaagacataaatgaaaaaaataggtggatcttgcctacatcttactaaatctgataattagatttttggttctaattctttcttcttatgagaagattagacagaattcttcataaaagcacaataacaaataatgttcatatcaggttttctaaagtgatatcagttacttgcatgggaagagggggaaatactacattcagttttacagaatttatggaagatgaactttaataatttagggagatatccaattcctaatattcagtatgctcaaaaattttttcctcctaagttctggtataacattcataaagaaaagtacacaagtcacgattatacagtttaatgagtaaacactgatcacacccatataaaccactgcccaggccaataagtaaaatattacaagcaacccaaaaaaaaactctaggcctctacctttagaatgcgtttgcagtatttaagactattgtagttccaaaattactaaaagtaatgaatcattaatgtatgtgtattacatgttagaaattttatttattttttgaagcatgcatgtttatcattcttaatatactttctcctgtttaatctcttataaaccttaaactgtagtgactcttaggagagtgaaattcatgaatataaaggtagtccataaaacgtaatttgtagattttaaatctgaaaaacattctcatatgcactataaattttgtcactgttctatttgatttgcttatctctacagtgaatgaattgtttctctgaagaggatggggaagctttcccatttaacaggataaaactgagggaaatgagaaatataataagaaagagagattaaaatcttctgaaattggttaattgattgcctgacagttataacagaaatgctttaaatctgaaactcatcagttctaggctatgtttttcttttctacttaattagaaaaaaataaaacataaatgcattcttgtttagttcgaactgtggggaaatgcataggaagttgtaggcaataaagtaccagctgcttgtttggtgctaagtttaccagagagtttagaatttatcattcctgtgtattaaagttttatgagctgcttaggagaggatgtaagcaaaagccatgttatcaaaactgggttaaaatgcagcacaaaggtaaaggtgtgaaatggagtatcattactaaccaaaggtgcacttttgggttgggggagaggtgtatactgacaaacaaatataggaaacattttttccatattattttccaaatgaaattgtttgctcataattttatcggtctaagtatttggcaaaaaactacacctattaccaagacatgcccaattcagagttctgcctgtatacattatagaagatgacaaagctccaataagcccttaagtacagagctggaggcccaaacagccagccaaatcttgctgtattttatccaccatagtataatccagagactgtggaccccaaattgggatgcttttaaaatccaaagtagttctgtatacacatttgaagaaaaatgctgttgaagaaatgtatccataaaacacttcaggtcaaaaagcaaaagaatatcaagaaaaagtttaaataacatgattcctactggttttagatcataattatcatcctatattatttatattcgtatcactgttatctttctctgacaaataattctgaaatacaatacattttaaagttatgcaggattttaaagacctcgtcttcaagcaaatacaagaagtttaataacaaactttaaataaatgctcatttaaataaaagtttatttttctcctggccaaatatttggtgaattacttacaaagatactttcaatgattagattccttagcttaaaaaaaaattcatttgaatacgctttagcccaaaagctccttacatattttcgcatcacatggagacagagcatctcatatcacagtgatgggtatgttttttaatttctatagaaatgctattttatataaacatagacgccctcagtccctaatgcataaccctttttaccaaccagggctttgattttcatgctgtcccaaagttgcagacatgttcacgacacagctgcgtttgttccttcatcttgttcagcaacctttggtaagaaactaccatatttaagattggtattctagatccaaaagaaaaatgcatgtgtttgctgtgtgtgcatgtgcacatgtatgtgtatgtctgtctgtaaggatagagaatggctgaaaattcacaggtttttaaattcttaaaaacaggaacgaaggaattctaacagctatgactcaaaacaagattctaataagttccatgacaagtaaaacaactattcattgagatgttaatagccttggtaccttataatggaaaaagagagattaagcaattagctcatgggtacacagtttctcatttgtaaatactgatgataccaccacctgcttcatgaagtttttgagacgattaaatgagttcatacgtgtgaagtatacttctggttacatgataaacactcattaaattatggctattattattgttactattaataacactgagcactgttctaagtacttcaagtatattatttaacttgatcttcatgatagccttatgtggtaggtaatattattctaattttatagatgagtaaattatgaattacaaagttaggtaacttgtccaatgacacatagtgtgtatgtgctggaaatagaacttcaacagacgcaatccaaggcctgttctcacaaataatgagttatggactctgagactaaggatactcttggagaccaaagcagaagctaagtattaacaagaaaagaacccagactcagttagtgctcaaggcagctccagatctacatgttttgcttgatctcctggtcttgaattccctatgattctaaaaccaaaccaaagttacgtcattgtttatataaaggatataataaagttaaacattaagtgggtctggggaagaggaagtaactgcaagtgggcacaagggatctgttttgggaaaatagtctaaaacccctttaacgattcttttttttttctttttttctttttttttttttgtaggggagagaaacgttctaaaattagattctgatgttaattgcacaattaagtcataaaaattattggattgtacacttaaaaagcatagattttatatgtaaagtattcctccaaaaagttattttttaatttttgaaaaaaaaataaggcatagatactctttctgctttaatcacccctttaattctcagattgggcctaatgatttagtatttgtcatctaaatccaaaacagttttccagttaacaaatgaccctaaaatctagtgtcttaaaacaactttaaaaaaaaaaaaagtcacaattcacaatttgtacagggctacactgggcatttcttccatttctcaagtcatttaggaaactcagtggtactcatctggcagatgggttggtttgatggattcaagatggcttcaatcatgtttggaacctgggctctgagggttcaaagactaggactactagcaaggagcatgtacctgaggcctttctgtgcagcttagcattgccagaaggctatggcctcatagtagtcaaactactaatgcagtggctcagagctccaagtgtaaatgttttagtgaacaaagtggaagttgcatcatcttttattacccagacttgtatacgacttagcaccgcttctgctataatccattactcagagaaatcacagccctcctagattctataattaaggaattttgacttcatcttgttggggaataacaaggtcacactacagagtagcatatgaagctggagatattatggtcatcatttgaaaatatgtgtcataatagtttattataataatcaccattaacagaggattcagaaaggtctataattctttaaaactcaaatatctgaaacactgaggatttcttataccatatagtatgtaggctaggaggaatttgtggggaattcatactgatattctgatacacttcaagaaatttatgcaagaaatctcctttagagacaaatctaaatttttagggtataagaataattatacactaatttcccttgtgctattttatatggaaacatttagtttacataaaaatttagtttcatttccttttggtttttgattctaatgtggcagctgaatacagctgtgaattctctccttataaaacatttagtgctgactagggccaattttggacatgcattttctgaactgaacatgatatttgataacttttgccccaaataagaaaaatttaaattacaattgtaaatgccttatgtttatcccattttagtgaacattttggagcatgtgagagaaacacattgtactaagaacttgtttaatttaaaaccacttcagtttactgagagcttgttatttcattttttcactttaaaggtaccagacaacttaataatgaaggagtaactcagtgtcatgtgagtttagatcttattttgccatctgcaatgaataacaaagtattaaaaagaagagaggaagaaaaaaaaaactaggcctcttgcctgaaggacaggataattcacacttacttaaagaatgtcatttataggattttctcacagcaacttgagactatagaattgcttttttagcttttacacacagtcattagcaatttatagtgccagagaacactgtaatggaaaaacagtatgataaagtatgaaagttcattgattacatggtcatagcctactgaggtttgatttagtttttaaagaaagatttctgttctgttcccacctgttgaaaataccttgaatttttactcatgtaacccaggagttctccaccctggctatatgagaatcaaactgggcttgtaagaaatagcaacgtcaggctccagccctagagattagattcatcaggtgtaggatatgtcttaaagtttaaaaacctccttacatgataaaagtgggcagccaggtttgtaaaacagtgatttaacctgttactgcttctgctggcctagtgtcacttacttctgagaaaagcatgttgtctaaatatttatcaagataatttataaaatcttgaatctaacccaatcagaaaaaggttcctgaagtgcctccaatccctttagaaagagaaaaatctatcagtcagtatgctcagatgacaactaactttaagttactttaaaattcaccaacttttccagtgttactgaggatgttctaaaagagtccactgaaatcaaaaaccatctggctgtagatcaatctctgaagttccaccccagtaaccttttccaaaaagcgagttagatgaaggaagttaacagtcatggtggagaaaacaaactgaaagacaaacatttcaacaagggagaaaagagggagtttaagctttgatttggccactaacaaccattgtgtgaccattcatgggccacttagggcttgctggatactatactcctctgaaaaatgaggggttgtgctgtatctgtgttttttgtttgtttgtttgttttgttttctgttggtaatggtgaaagtgttatgagttaagcagtagaaaacactttccaaacaaaatacattaaaacaacctgcaagattagggggctagccgtggtggctcacgcctgtaatcaacagcactttagaagcccgaggcttgccaattgcttgagcctggaagctggaaaccagcctgggcaacaaagtgagacactgtctctataaaaaaataaaacaaagcaggcatggtggcgggtgcttgtagtaccagttactcaggagcctgtggtgggaggattgcttgagcccaagaggtagagcagtgagatgagatcacaccactgcactccagcctgggtgacagagtaagactctgtctcaaaaacaaatcaaaacaaaatacaagattagagttgttctggttgatcagtaggtgggggcatatggagacccacctatcaaccctccccattcaccagctgctctgcctctgtattcctacactaaatgcatttttagagataactactgtgtaatcttattttcaaaccttatgttttagacatggttcctaatgacctcttaaagtgcaaatattcctaggaactaggatttcctactgggtagattttaccacaagtgcgattaccctaatgggtagaatcatatatatatggctcagtgaggtttattaatttgcctggggtcaacaagcagcaagtggtatatgcaatatttgcaaccagaaggatctgaagccaaagtatgtgctttttcctgcaatattaaaatattgtatcagtaagtttcccatatttgtaatttgtatatatatatatacacatatatatatatgcccataacacttaatcagtatatgagtttatgcattttattttgcatgggcatatataactttacgtgtaacacttattgacagaccacataatgatgtatatgccgcatctcttgaaccaaacagaacagttaaatcttgaaataacctatttctataactaatagaaataagtcattataatataactagtatgaataatacttttgttgacttaagcataatcatacaaataattagtatataaaaccgagaatgtctcaatgctgacattgaggggaatctcgcaatgttctgtgttgggggaatctcgcaaaccaaaactgtacacactcaaaatattaacaaacagtaataaaaatttttaaataagaaagcaacgtagagaaatctattccctctccttcagtttttatatcataaaactagaacccagggagatagaaaaaagcatttttaaaggaaataacagatcccaatctaaagcatctattgtatactgtagctagagataatattaccaaactcaatcaaattattaccaaactcaaattattatcaaatcaaatattaccaaactcaatcaaattagtgtgtgtgactgataagaaccttactctctcagagaagtacagattttaaatacaaatcttcttttgttaactataaactctttgagggcaaagattcatgttacatagtttttttggtcatttttatacagtaatttacctgctgtattaaataggaatttatttgactaataacagaatcttaaaccaaagtacaggctgtaattcaatatttaagcagaattaattctatattctgctggagaactttccagaagactcccccaatcatacctcctattgctgtctcaggtcacccatatataaattaggatacctatggctttttcgagaaaaattaactaataagataagtatagtttgtctcctcagtagtgatacggtttggctgtgtccctacccaaatctcatcttgaattcccatgtgttgtgagaatttaacatgaggtactgggaaggacccagtgggaggtaattgaaatatgggggcaagtctttcgcatactgttctcatggtagtgagtaagcctcacaagatctgatggttttataagggggaaacccattttgcttggctctcattctctctcctgacgccgccatggaagaagtgccttttgccttctgccatggttgtgaggcctccctagccatgtggaactgtaagtccattaaacttctttcttttgtaacttgtccagtcttgggtatgtctttagcagcagcatgaaaacagaccaatacagtagtagctacttaaattcttctgaaaaatgcctctataagcctgagggcagtaatcatgccactactctgccttcactcttgcaaatcaaatatagattattctaaatttattttatttgtcctacttttaaaatctataattaattaatataagtaatgctgtcattattattttattattctgagactctttccaagcgttctggcattattcttatgatccacacagatagggatgaaaagagttcatttctttcctgggttgtaactcaatcagcctcttcagttccaaagattggtggtctttttaatctcgaaacttagagtaataatttaaagtttacaagaattgggttaataaaaagaatggctatttggatttctttatggtaccgtccaaaagaaaatctgagggttatttttctgccaaaaatcactagaagctgtgatgtaaatcattgaaaaggtgagtagtgattttttccccttcttaggaattctgcaaagaggagaacatgggtataaaagaaatgggtatagaatttaatagtaatgatcagaaatggaactaagatcatcactctagcttctttggatagagaaattctaacaatccctagagaggatttgtgtgaggtggttaaaatgaaaagcacacacatgtatacttgcacacatatgcttaaattcagtagatgggtataaaatatcagaatttagtcactcattcaaaaaataattttgaagtgcctacctctaccagattgagccctgggaaaaacttcctggttaagaaccctcactctagttgccaatgtttggagtcccagttgatcatcctcttcatttcttatttgatctgaaattcctgaatccgggtggccataactaatcctccagaagtagatctaaaacctgtccacacaaaagcataatctgggtagctttaaatatatatatatatttcaggctggacatggtggctaatgtatataatttcaacactttgggaggccaaggcaggagaactgctcgagcccaggagtttgagaccagcctgagcaatatggtgaaacccagtctctacagaaaaaatacgaaaaaaaaaaaaaaattaaccagacatggtgtcatgcacctaagtagtcccagctactggagaatctgaggtgggaggattgcttgagcccaggatattgaggctccagcgagccatgatcttgtcattgcactccagcctgggtgatggagtgagattctgtaccaaaaaaaaaaaatccttccttggtccacctgtatatctactaaatcagaaccctagtttgcagggatggaggaaaaagccttctggtcattatgatgagcttgtttgtgaaccagaattttggaactactgatcttgggttcacaataataattcctaagaaaaaaaccttcttgactaattcagccaagtcacctaatacagaaacctattagtttctgctccacatggactcagatagtgtcactgctatgtaccttaacattacaagcacactggactggaggctcaatgcaaaaattaaaatttcttaatattccactcacttaaaattataccatctttcaatttataattctaaaaaatcttcaaatattggtacatgcagatatagcatatataggaaaaagacatatggatgattcagctttttgaggttctctaagtgaattgatgataatgttagctagagtcaaattctattaattatttatcactcttaattcctctctcttttgctctcttcatctctctcttcctccactattttcctttaactactgaattcctacttatcctacaatactcaatttacttacagggaatattttctttataccactaaactgtaatctctatagcacaagacatatttgaaattttgttcattgatatattcccagagcaagaacagtgtcttgctctgtacaaagaaggtactgaataattaattgttgaataagtgaatgagtgaatgcatgtatatatgcatggataaattaatcctataatttctgttcctatagtatcaaggaattgttagttaaaatgtatttgtttgttatttggtagcagctaattgcagctaatatagaatttattttagcactcatcatattgcattataattatttgtttccttgactggatcaagccaggccttatttttataagtattatatcagtctcattcagtgtactgcatatggcagacattcaataatgttacatgaatgaatgaacataaaaagctacctctcaagattcatatttattaaaaatctgatgccaatgaatttagataatttagatatgatccagatacagtaatttaaatgctcatttcatttcatgacaacattttctactggttgagaaaacataaattccaaagggacattataaatacgtctggggaccatcattcatttcagtgctcatatttcataagtaagcaggtaaacagttcctaagtagatcactatatcagggtttatatttggataaattcttgaaaaaaatatattttaaagaaaatgctgtcttttaatttaacttactccttaccagtttttaccattacatttttgaatcctgaatgagagctattctgtaaaacataaaatccaaatattctctatagtgatatatatgcctctgtaacctttttaatgtttcaattagtactggtagagtcagaggttatatttaaacgataaaggttctaaaattgtataaagaggagctacatatttggagggtctcaaaataaggcacagagtaattgaaaatccatattatataatacataagattcatcttaacaatacaaaattgatatgttttaacaaataatacattttggaacagatttctgattttactcatgaaagtagtagtgggttacaatatgatatggaatacagaaactaatgatttgtaatttaaaaaagaaaattagggtaatttttttaattcaaaaatttagaaaattgcatctatgtcaagtcattcaggaagagtgaaataaaaattatgtatgaaaaaccttgttaagttacccataagaagatgcattttcgtttgattcaattaataactgttataaggaatgccattttatgaattaatatggaataaacaagaaaaattttacttaacatttcgtaggagacaaagtaaccacagcaatcagatttttctttgggttcggattagtcatggcactgtgagccaataatttaaaacgtaaagaacgagatactatgaaattcacgagtggaaggaagaacaaaggctatagtgagagagcaagcgtatggtgctcccttttgttacctagttctcctttcctaatgtgttcaggaactagttttaataggcatttcatgaaaaagaagttccactgttaatttttttgaaaactccaaattgagcaaaattaaaaaggtatccctaattcaagtctactcacagtctttattgtacaatgcctaatatacaattagttctaagttactaaataaacatttattcaatgaaaggggaataaagtatgtagcatttctcacactgctccagtttttaagcaagcactgggggaactgggggatacatggcggagggtcgtattaatgttccacaggaaaaaaaattaaattagcattaaattcgtgttttaccatacttcaatttgttttcattgtgtttttggcttatctgtgacagcttttcaatcagcttcctttaattgaggacttgacttggtttctaacttttagcatttaaataatctttctgccatcttttcattaagaagtcattattatagactgaaaacagtcttataaatacaccatctcccttcagatttaaggaaatttgtctccttgatttttctttactttgcctttacttttagcatttacatgagttctatatttttcttccagaaacaaaactctgccaattatatattgaaagctcataagcacaaaatgcactgtcaaccaatactggtttgtaggtatttgatgccaatgatacaatattgtttactacactaaaaagtcatttatgacatagaagtacatttcttgtttattttgatagcccgaaatcacagacaaaattttagtctactctgaggacaccacactgcactgaactccctgaactgccagtgaaatgttctttgcttttctaaaagatgtgcttgtaagtacttcagaatcatagcagggctgaaatttgaataacaacattttagtggactcactctaactcttcactttgcactgagattaggcttcccaaacggaaaccaagttttcctcaggtcagacacttctacttgtaaagcaatgtctccaagctctaatgcacctgtgagtgacttgaaggttctaataaaatatagattttgattaagtagttctgaggtaggtcctgcaatactgcacttcttataggtcagtactgttggtctatggatctcattttgagtagcaagatagaagtgcataaaatattactgttgacttagaagctaattccatcagtttcttaagaagtttattgcctaatatccagcataccataacttaacaattgtgaatacatttattatcttttttttccaatagatttgcttagatttctattttaagagtcagatctggtccagtgatttcacaggaactgcaaatagtttggagttattcttttggaatgctgtttttccctaaggcattcttccttttgtatcatttggtaagggaaactttcatacaataggatttagcaaacgaattagctgtgttcttgatctataataacctttctcttgtactcaggacataatgaacaaatttatatatttcaatgcaaagatgattaaaatcactcgggactaatgaggatagctttcaagtcctttaaatttgtgtatttatttgtactttctatgcaacaaatccgctttcacaaaattgtagatggcacctgtttctttcaaactgctagctcagaccctctcccatctctattacaatgtcgattacactttaatgtgaataagaatcaccagggggcttattaaaattgctcattccatgctcaccccagaggagtcacattctgtatgtctggagtaaagtctgagaatgtgcattttggcaaatacctctcgcatatctaatgcaatctgagttggggaaacactgtcttaagatcagtccagaccttaagcaagaagtttcaacatcaatccactcttgctacttaaagcctgatattattccatctttgtaactgagtttttgcactgtttcaaaggttttgttttcaaatatgctcctaatctacaattgctccctttgtttgggtcttgtcttgataatctgcctggtttttgccattgctccttggatgaaggaacttaactcataaatcttctccggggactacagcttatctttcaaagcagacacttttgagagtaatattgaatgccattagtaactgtgccaggataattgacatcagctgaaactgtccagggcagactttatgtcatactgatcttgaatcccaatccaggaaaaaatgttaaccatacttcagactggtggcagatggttatccacttctgaattctccatcccagtactattctgagatagaaaactcctacaggagtttcaaggcagatctctagctgtcactgctgtgctttactaccttcattccacactcttccttcattctattttctagcagacatgatactcttagtgtctggcggtgaaaatgagtctgtcttctaagacccagcactactgtggcagtaagttttttcccaaagcatcccaaagtggttcctcaagctacagataattgggatatgaaagaccatatgcatatacaaggcaacattaaattgaggtggctgttttaattatccatatttgaaagatccatatatttaatgtctcattgtgatgaaaaataatagttcaaagtataaaaacacttcaccagataaatgttttacctattttgtcatctttctcttaatgtcatcacatgtgaaataactgatgcaattcagagaaaagagatacgcactaaaatatacaatatttttctagatatacctacacaactcattgacaagtgaaatcaagcaactggacatttatttaggcattgcatcaacattgagtcatgtccctctcctccaagtattgaattatctaattattcataaaagaaaattcagagaaataactcttcccaattttaatagaattaaagtacatttaaatggatgcttcaaacattcatatggagaaattcaggacaacgcatacacggtaacacgaaattaattatacaaagcatgaaggaaaatagactcatccattctcaaaaccacctcattctcctacctactatattcaactgggttttttaaagataattaagatgaaaatatcactttcaaaaaatgttcctagtgcattattatcattattttcttaatttttaagttccggggtacatgtgcaggatgtgcaggtttgttacataggtaaacgtgtgccatggtggtttgctgcacctgtcaaaccatcacttacatattaagtccagcatgcattagctatctttcctaattctctccctccccaaccccacacctcatcaggcccagtgtgtgttgttccccttcctgtgtccatgtgttctcattgttcagctcccacttataagtgagaacatgcagtgtttggctttctgttcctgcattagtttgctgaggataatggcttccagctccatccatgtccctgcaaaggacataatcttgctcattatttaaaagagtacaataaactaagaatgttttaaaatgtagtatagtattagtaaatcatatactcttggctaaccttacaggtatgtgttgtttttataaattaactagaactggtttaaccctagggtcaggttcaagtggtgtacaccagcaatcagattacaacttgatgcaaattttgtctcattaaaaaagtcacgcatcccaccacttcatttgcaaaataattgtgtacctgaccaaggtcagagaattttccctctgtttctttcactgagtgagctcaacttattaaaatgcagctaaactgtgagaaagattaattttttttttcatttggggaaataacaggggagagcaaatttctaaaaacttggggttttatagtaatttctgattttcatgtttagaaaaagaaatcacattaaaaatatgcttttttaaaattttgagataggatacactataatattattgtagtccagaaaatctgtatactataattcctagggaaaaagagaaaattattagtgtcaaaatacctataattcccacagttacgatatacatttttaaaaattgtttaaatacacaaacaatgatgatgctgtcctactagaaatgacagagcagagcttttactctcttcaaaatgcattaacactttcatattcctagttcaaattaatattctttttttttttttaagacaaggtctcactctgggctgaagtgcagtggagtgaccaagactcactgaatcttcaacctcacaggctcaagtgatcctcccacctcagcctcccaaagtgctggtattatagttgagagccaccacacccagtccaaattcatattccaaatactccatgatctcaaattattttcaggcccttctttcttctatagcaatggtccccaacctttcgggcatcaggaactggtttcgtggaagacaatttttccacagacagaatagggaagatggtttcaggatgagttaagcgcattacagacactgtgtactttatttctattattactattatatcatacaatagaatgaaatcattatacaactcaccataatgtagaatcagtgggagccctgaacttgttttcctgcaactgcatggtcccatctgggggtgatgatagacaatgacagatcatcaggcattagattctcgtaaggagcatgccacccagattccttgcatgcgcagttcacaaaagggtttgcactcctatgagaatctaatactactgctgatctgacaggtaggcagtctcactatgttgtccaggctggtcccaggtaatgcgagctatgggaagcagctggctgtaaatacagatgaagctttgctcacccactgctcacctacctgcggtgcagcctggttcctaacagaccatagactggtccatggcctgggggttgaggacccctgttctatagctaaaatccaatgatttaaatataaatacatatttgtctattcgatgctactagtattttcctaggtgaccatttatttttatcatctatctcagttaagatttttagataatcacaattgatttaactcacaggatttatcaagatcttaaaaggtatatgtagggctctttgctttatttgagaaataaataatcactgcctcacaactatggctccatgtgtgttatttaataaaatatttaatcttattggaaatccttttatatttttttctccacaaaggacaaagagctgaaaataaatacgaaacagaattctttgtgggaattataaataaaataaaggctaatatttgctaaaagaatttgaaatgtatatgccaaaatatttgctattatataaaaatataagtattattatatatttcttttttgtcccaaaagatggtactaagtattatcttagaagtgaagttgactttaaacatgattttcatagaaatctagtaactaacaattttgaaaatatccagaaatgtcttaaatttttttttgtaagttatattatttgcataggtatagcccctacagtgttgttcaaattctgaactttttagcttccttttatttttcttactatttaacaatattagattggttatgttccaggaacaaatttcagtccatgggtaagtattcaatgtgaacttattcactgattataatagttgttgattgttcaataatatgagggatagacgagagctccatccatcatattataagagtatagactgtctttgactaaatgacatattaaaagcctaatatatgtcccataaaaatattaatataaggcattttgcaatttctttatttagttatttcaaattatattgtagaacatgaataaacagagaaatcaaactggtaagaatctatcttcattcttatcagcttgatctctgagtttaccttgggcttcaaaggaccaacatagagctaattgcaagggaaccagtaggtatagataatctagaagatgctgtgaatcctcttagaagagcaacaatagcactgttattaaataatcaagattttattttttagaaataatatgttgaccaaatatataatagaaaactaaagtggcttgagggctggacatggtggttcagacctgtaatcccaacacgttgggaggtcaaggcaggaggatcacttgagcccagaagttggagaccaacctgggcaacatagggagatctcatctctacaaaaagtaaaaacaacaaaacatccaggcatgttgacatgcatttgtggtcccagctatttgggaggctgaggtgttgcttatattaaagaattaagaacctcacaaatttaatacaagcaacataaatgatatgatttggctgtgtcccaactcaaatctcatcttgaattgtagctcccataatccccacgtgtcatgggagggacctggtgggagataactgaatcatgggggtgggtttttcccgtgctgttctcatgaaagtgaataagtctcatgagatctgatggttccataaagggcagttcccctgcatacactctcttgcctgccaccatgtaagatgtgccttccgtcataattgtgaggcctctctagccatgtggaactgtgagtccattaaacctctttttctttataaatttcccagtcttgggtattccttcatagcagtatgaaaatggactaatacaacaatgatgctggaagtgtgaatttttagcctcacattcatgaaaacaaagccatatatctgggttttcaattataaaggggaaagtaatgcaccaacagtaattactcatacctgattatcccaaatattatcataacaagcattatactccattttttacaactttactagacttctcatctctttaataaatcatgaatcaactatattgtagtttctaaacaattactttgcattatacaatattagaactttgtaaacacattttaaaagtagtattcttcttattcatatctaacttctgatctatgagtaaataggcccaaacttttacatcttccatttatgtgttctcttttaatctaaaccagttgaatttttccattaatgtttaactcaagaatttctatatttttctccttgtcaagtaactctcaattcaaatgatcaacaataaacctcactaaacctcacagtgctcacctagaattatggtctgaataatttgatagagtctattttttatttcatcagcctggtcatcaatgaacatatttaacaactgtatatgcctttggaacatcattcaacatttccttgacccgctgcttaggcccaagctaacattaaaccactaataatactcttgaaactttttattctatgtggatctaagtctcaaataatttcaaccacacacacctccatatcatgtgaaaatgaagtcaatgctgagagagagaaacaaagtgtctattgctttaatctatgcttgtcattgtgtcacagtccagagtattcaggtgaaattaaattgctaattttgttcagtcattttgatgctaaaatgataggaataacacatgatttccctgttagagtcaaaaggatgctataaatcactacattctacaacatacaactctaaatgcattgaatagaacataaatttataacgggatttactgaacaggaaagagggccaagaaagcacagattctgacttgaataagtaaaacacctagagaaagaaatcccagtcatcttattctaaacacatcacttcagcagaattcctcacaaaaacaaatcataacattagtattattcatagttatttgcaaagttttaacagattaatgtcttttcccataaatactgaaatagtacctaacctgattcaataaacagctgcaaacatttcactggttgactaggttaaatttaattttatgtgttaatttttcatgtttatctcatattttatttttctagttatatttacttttaccaaagcctcatactgtttttcatatcacataggaactcatttcttacaataaataatatataaggactaagatgattccaatgcaattttttttccatttgtatataattgctttatcttaaaagcaaaccctgcatattctgtcttccagagaataaagaataagaaatcattttaaatttattttgcataatttgctgttaatgggaaaaatttaggggaaaaatatggttatatagatggggccaccaaacaaagcattatatacaggtagttattaacgaaatacaaaggaattaatgtctctaagcttagtgctcaaaaatagagagttaaagcaagtttattggcctctgaactaatgacatcatggggctggataattctttgttgtggggactatcctgtgcattgtggaatgtttagcagactcctggctggcataccagtagatcccagtagcatgcctcctctacccagttgcgacaaccaaaaatgtctccagaccttgctaaatgtcccctaaggcacataattgctccagattgagaaccacaggataaaagagctgttaaacacaaagatagctaccatatatatgtgtgtgtatatatgtgtgtgtgtgtgtgtgtgtatatgtgtgtgcatatatatgtatgtgtgtatatatatacacacacatagcgaagtataagcaagtggaagaaatcctaaaccagaaaagtcttggtaatttcgtaatacaaagaaaaatgttttttcttttctatcaatgcatcaggtaatagaaaccacaccttatttcaactctaaaagtcctactttcatggtatataacaatgcagttaaaatgtattgcatcatttaatttattgtctcatgatcaagtacagacagaacagtagagtgtctaagagtctaagagccctggctttcaaatcagaaagacctagaacaaatctaattttggcaattaccagttgtcaaatttcagtgggcagataattaaactctaagactcttttgttatcttcaaaataagataatggtagtacatctctcatagggttgttgcaaaagtcaaataaaataatgtttataaaagtactaaacacaggtcgggcgtggtgggtcacgcctgtaatcccagcactttgggaggccgagatgggcggatcacgaggtcagaagatcgatcgagaccatccaggctaacacggtgaaaccccgtctctactaaaaatacaaaaaaattagctgggcgtgatggcgggcgcctgtaatcccagctactcgggaggctgaggcaggagaatggcgtgaacccgggaggtggagcttgcagtgagcccagattgtgccactgccctccagcctgggggacagagcaagactccgtctcaaaaaaaaaaaagcactaaacacattgcctagcatgtagtgagtcatcaaatttagctattttgttattattgctattcctaacagagttttatactttattctatggttttcaaagtggagcaactgtgctcccacaggagacatttagcaatgtctggagacatacttggctgtcacaacagatggagaggtactagctcagatacatagctctctgatacggtggcttaatttgggcaaagctttaaaaaatggagaaactacctagactttagctaacatgccgtaaatgtcacttctctcggacaataagtttttatagttttgaaagtggcatgaaatttaaaaatatatttctgggtaaataacaggtatatagttattctctattaacagctaaatttgaaatgatatactaaaatcacataaggggagttaagaaattaggtaaaatgaaaactttatcaaagttgattttaactggctaatttaaatcattatatgtaaatttaaaatgtaaatcctaaaataattactttctcagctagaatttccccaatcaatctatgaatttgggttcaagataagtaattgtccagttctgagaccaatatatctggaaaatgaaggtcagaaaatatatttgaattctccgaaaaagatagagagataaatacaatgtatattttatattatctattaagaaatttaagtttgcaactacattttaaaatgcatattctatcagaagtccatgtactagaaagcttatttaaggtgataatcagtaagctttttgctaatattaattgtctagacagtttaacttccattttagaaacacactctcagaagtagagataaccagttctttgtcacagcagataaaaagctcacagccaagaataccagagcactatttttgtcaggtgcatatcaacatttatgttgtcaccctgggccagcaaaacatttaacagatgtgctgtatctatgttttctaagtatttgatacctatttttatatttcctcaatgatggccccccccaagaaaagccacaaattggcaaagaacgtgaagtaaaaacatattctcttaaagccaaatacataatgtccggattttgtgtttatgtgtatgtgtttaatctagtttaaggtgactcaattttcaaaatcaattcacactaaactttgctatcttccttcataccaagcactaaaacattaaaatgttttaaaatatatttaaaacatgaaatgttttaaatgttttaatgttttaaaatatatttaaatgaaagtttgcataaacttttcctgaaacaatgattcaaaacaccaacaaccatcatgcgaaaaaatattgtcaagttatatttgatggaggtttactggttatgggacatagtatgtatttctgttacagcactattgcaatgtttcataacttttctagatctatcacacaatatgtgttgaaactttaatgcacaggaaggagcctaccatttgtaattctgagggccaaggtacttaggaaagaatggaaataattagggacggaaggaaataaataattaatagacctcaaaatgactattacttttatgaatactaagccgcatttacattaaaataaatatttttctaggcacttttgcaacaacattctttttattgtacttattgaaaataaaaccatgtggtttctgatatatgaattagcttgtctttggagttggcagaacatgaacttgtgtggcactgccttatctaaaagagtcatatcagataggcctaagtgctaacattgtaagatacagtgttgggaaaaatgctttggcaatctttccaaaacacttgactctctcctcatggaaataataacacatttcatttttgtagagatttgatatgcagataaatgccaaaggaagaaaaatgcagttatattttgcctttaatttaccaaatcttcaacgtataaattatgacctatataattgattatagttatttcagaagtgtccatgttttctaagacttccgttattctctgctgcttttagtaaataattacaactttgataagtgatttcaaaatattcctaactttgtaatttcaaaaaaaagggcattgggaatcactaatatacccaaaatgaactctgaggaaatgacagatattggagtgttggatggaatagaaatagtgtgactttatttaattgttacacttccttatacaactctttcctttcagatctgaagaactaatccaggttgagcatcccttattcaaaatgcttgagaccagaactgttgcagatatttgattgtctaaaattttggaatatttgcagtatgcagtatatttttaccagttgaggatcccaaatccaaaaatcaaacgatcatttcctttgagtgtcatattggtgctcaataagttttgggtttgggagcattttagattttggattttgcattctcaacctgaatatgagagaaataactgtccatttattaatttcaacatttaattaattcagtatataaaatatgaataagttttagtggtctggtcttttaaggggggaaagttcaagaatcactaacattttataatatagatattttaaagtagagcttaaaggcacctccagtccatacagctatttttaggtgaaatagcattcaattcctatttttatatatgttggatggatggaggggtattttgtcattttatgtataaaccaatgaactataatgcttagtgtcaagaaacagtttagaactcaaaaagaaaataaaatttttattttataatcaagtaactttcctccaaaaatgtcacaggaaaaggaagatcgtgatagtctgtcattgaaactgagctcataccctcaagtgaaacacctgggtgcttcattaccaaattcatgtctttcctattctgagaaacatcctccaagaggatcacctattttggtaaggcacctacttatagagtcagatattatcacatatagctgctggaaagtgtggccacaatacctcaaatattatcacttgccatgagttaaagtttcctcaaaatcagcacaggaagatgagagtgaagttaaacacatattcattaaagaagactgaaaagaaaagaaagggattagtgttattacttacagctaataatgagaaacagttaatcgtgtatcaaaaaagaaaataaactattgttttaaaactcaaattcgtaacacatcgtcacattctgagaagcaaggaacatctgttatagaatgtgaaaaaattatttctaaaaataaaaatgtaaaaatagaagaaagtaaacatctaaattcagtggacagacttggtcagaaatagtttcaatgcctagggccaccgtgtactgcaggaactggtggcattactgacagtctatgttttccttcagtgtgcacagtctgccatttcaatcacacaatattcagttctgtcctaagcaaaacctgcttttaaaaaacgattcaaaacctgctcataataaaattaatgacaggcaatgaaacttctgtaatgataatccaagacttaggcaaagaagtaggaactataactggagtatttagtgaagtttttaaccaaaactccactaaattcacataaagaaagagagcggaatctatgaagaaagccagtctgtgtgtggtggtcctataggtggacctctgctttcacaaacatgatatgattgtcaatattttatttcgaaaaggatataatgatttgtgtctcaaaagtggtgacacgaatataggtatcatgaggtgatatgtcacaaaatgtcttctgaagatggagacattaatttacattttttagaatagaagagttgtaattgttcaccaggttttatacctgggctgttaatcactagtcacatgtggtatctaaattcaaatttaagttaaataaacaatataaaactaagagttcaacttcttaatcacacacacacacacacacacacacacacacacacccttcaagtgtttgacagccctgctgtgactagcgactaccatattggacagtgtacatattggacatttccacacactggaaaggtttattgaacaacagttgttctaaaatgtatacaattgttaccaattaggaatacatttggctaaaagtaacagaaaacctgactaacagattaaaataagagttaagttttctgtcatagtaagtgcaggggttagcacttattgatattgacctagatgggaactgatgtccccaagaaagcagattcttttagtatttccttagtgctgtgaagtctgcccttatgctttttatttcctggatgcaagaaggctgctgcagatacagatattcttgcacattcaaaaccagaggaaaagtagaaaagggagtagaagttgcagttatcccgtagtaaagcaattgctttcctaaaaatatcccataaacttccacttatatcttggccaaaactatatcttatagttgctctaggaaatgttcccaagaagactgggaaagcaatcccagcaaaatcaaggttctgttaataaggaagaaggggaaaatagatttggaaaggcaactcaccatgctcatcacaggcttcctgaagatttgtccttgaaaaaaacaacttgatgaaaaaatgaacaaaggtaaatatagttccttccacagaaaaaacttttaaagaggaattttaaaatcaatgcttaaaaattaacctcttttttttctgccatgtgaagaagtacagtttctaaatgcaaagaacttccaagttattagttagtgtaaggcattccaacaaaaagtgctataatcaaagtagattaatacttccaatatgctctcatgttttgattaattatgtgtgatatattctttatgtggtataatatagaaatgaattttcctagctgacaacataactatttagttaaagaatttgggctaagaccttagagtgtaaagctatccatttacacaagaatagtttccttaagaggaaaaatacgaggttttccctctttcccttagtatgtttactatggaataaatattgcatgagatgaattccaagaacataagcaaatgttttgctgtctttaatactaacatggaaagatatagcaactattctagaaagttctgcgtaaaaaatatttaaaacatgtgccaactaaaagagatattgaatggctcaaaagtaataagacaaagacattaagattatattcccttcatatcagacattttccctattaatattagaaaattgtaaagcgatattaagtcgttcaaatctttcatgagttctatgatcagtaaaacacaaatatttatgtcatgagtttataaaattgcctactattcttagaatgacacaagttttcaagaaatacacatcataaagaagcatattaagtaaactataaataaggtgacaaattcaaaataaagactgtaaaataataaaaaaaatgcacattgtcaagacttgcaataaggctgactttagataatctgcattgacactgtgttctaatgagtaaaaatatgatcccactttgaaataaaaagcaagcaaggtgcaaatggaaaatgacctgcacacatatctccatggagcagggaagggctattattatcagctagtgggtattactggctgaatcatatccccctccaaattcatgtattgaagccctaatccccagtacctcagaatgtgattgtacttggagattctacttggagtatgtacttggagcctttaaagaggtgattaggttaaaatgaggccattagggtgggtcctaatcaaacctgacaggtgtccttataaggagaagaaattagggcagagaccctaggaatgtgcaggcaccaaggaaagaccacaggaagacacagaaagaaggtagctacccacaagacacaagaggggcctgagcagaaatcaaaactgccaatgccttgatcttggacttgtagcctccagaactatggtaaaataaatttatgttgtttaagctacccagtccatggttaagctacccagctgttgttatggcagctttagcaaactaaaacagtgagaatgacagagaacagaatgaatttctgagttgcttcaaacagtgtgtctttcagagctgatgacattaatttgatttgatttataatataaaatttgagttgatcattccccacaagtttttaagcagtgctgtgcaatattttgccattggctatgtgtagctgggtaaattcaggttaattaaaattaaataaaataaaaaaatcagttctgtcatcatgctaaccacgtttcaagtgtttaataaccacaatagctattggcaagaaggtagtcatttttttgtctttctacactttttccactaatggagcatataatcaaagcatgtataaacatcttcgttgctatgtattatactgagataatcatgttgctaaggtcatacattgcaaatgaccctcacataaatgaattagcacagtgtcatcttttcaaacacagaaagactttataaaacaatggtaataaatcaacctaaatgtctatcagtggtagactggataaagaaaatgtgatacatatacactgtggaatactatgcaaccataaaaaagaaggagatcttatcctttgtggcaagatgaatggagctggaggtcattatcttaagcaaactaatgctggaaaagtaaaccaaatagcacatgtcctcatttataattgggaactaaacaatgagaacatatagacaaaaagaggaagacaacaaacactggggcctccttgaaaatggagggtaggaggagggagaggatcagaaaagtacctatcaggtactatcctttgtacctgggtgatgaaataatctgtacatcaacatcccaggatgtgagtataccaatgtaacaaacctgcacatgcacccctgaacctaaaataaaagttaaaaaaaaaaaaacactttattttagattgaaaaaaacaaagaaaagaaaaagaaataatcaagacaaaaatcttgaccaacagaccagaagttcttctttggggaaataaaactaataatttattacaaaatgtttatcaagctagttgaaatttcaagtttaaaaaatcttaatgtttgatatattcttagattcattaaatgaagtatgcaaatgtatatgtgtaaaaccatagaaataaaatgaatttaatgaactggccaggtgtggtggctcatgcctgtaatcccagcactttgggaggctgagacgggaggatcacaggaggtcaggagctcgacaccaacctgaccaacatggtgaaaccccatctctactaaaaatacaaaaattagctgggtgtggttgtgggcacctgtaatcccagctacttgggaggctgaggcaggagaatcatttgaacctgggaggcaggggttgcagtgagctgagatcatggcactgcactccagcctgggtgacaagagcaaaactctgtctcaaaaaaataaaataaaacaaaataaagaaataaattgaattataatttactttaacagtagcacaattttttttcatgggcaaattaaatcactctaaaccaacgaaaatgaaaatgaaaatatccttccttagtaaaataactgttaaaaatccttttactgtggtgagttgcctggaatactggaaactttccctacccccacctcacaattctaatttcatgtttttctgtgtcaaatgcagccgtcaggaccagttctaggggataattgtttttgttaggctttgaattctctggcaataaatgcatgtccttaaactttaatgatttggggcccactaaaaatcatgaagtgttatacaaattatcagagattttgtatcattatacaatacaaaatacaaaataatttgtatcattatacaaattattataaaagatatacaaatgtatataatatatgcaaatatgtatataatatgtacaaatgtacgtattatacatatatgtgctgtatataatacatacaaataaaatttgtataaaatattatataaataaaagtatacaatataaacaaatattttataatatatacatatataaaatacaaattatttcctagacagatataatctacactagctttttcctattagtttcctctgtaccttctgaaaatttgtactctaaattttctttctaaaaatttgtactttaaaaatctatgtgatgtgtctgaaagtgctcactagaacacaaagctgataaatgttgaaaaaagaggaaagaaatctacactcaaatacatttagtagtacagtgtgtaaaagtgtgtgtatggggaaataaattatgaaacatcaggctgtagagttaagtgggcaccagatcataagactcatgggacagactaaataaatgtcccctgttacacttgaaaccatgtaactaaatctggccactcaactacaagcagaaataactgttgtaacttctggaccagtgcagttaagaagcagtgcacctccttaattcctttcttcttcttatacagggacttgggagtccacatgtgctagatggtgtagccacaggatggagaagagtagctgacctatactgaacatttcaatgagtgaaaaataaacctgtgctgtgttaagcttctgttccatttcagaatatttccatcgctacaggattgatctcttacctggctcatccttaccaatgaaggctcttcatattttttattctactgagatatttgtaattagtcttttttcacatgcacttgattaatcaaaattatacataattattgtataagtgaggtttaaagcaactgtccctaagcagcttcatacaggtaaatgtctacagtcaggagctggcagcaagtttgaatctaggtcatgtgatatttttgaatgattgaagagctgtgagactcctgaggtgctttgcaattattaataggtcataaggaaaggcggccaaagcctgagcatgaggggtgccacatgagagaagggtagcaaatgtaaatttctagatctcatgaggtggcctaccaactggtactacataatctcagcaatatatttacatgcaatacaaaggtgtacacataaagtccatgttgacatatttacacatacacactaggaaataacttggatcttcctgggtatctcattcttacaccagcaatttcaaaagaagcaatgctttttatctttagacctgacttccaaatctgtttacagacagagagtgaggtgagctattgttcttgaaaaccaacactgccattatgaagtatttctgagaccaacagaccctttcatggtagctttcatttacagaaagagaagcaaaaaaggtaattgaagagaaagtaggtaaaaatctgttgaagtttccaagtggcttttaccaacttaagttgggtttggaaatacttatatatctgctggttctttttttcttttcctttgttttattttcaggaggcccctattagctatatattaaatacagatactcgtgttaggcttatgagtgctacaatgttaaataaggcccaagtccctgtcctgagggaacaatgtaagagggcacatgtgaccttgatatttaatttaaattgcatattttaagattattgtctattatatctattagagttgtcttgaatagttttacaataaaatgtgaccagtcagtatttaaataatacaagttatattttcaacttcaactatttatgctatctatacttcatagtacataaactccattgcacttagcactttgtgtataattttaccttgtattttataactaagactactacatctttggtaaaattatcaagaataataacagtttattattatctagaccctagggttttgtactacagtattgggctataagcaaactatcagctccataataaactttagaatgagcttctgcatggtgaggggaaacatggtttgaagtaaactatgaagtttgctccctttggaaataaaagggtcttgatctacaaacctactgaagtctttaaatagtcattgtatgttgagtggcacttggcccagctttggcttaacagctatggaaaaatccaggggagataagaaatcaccgtgctaaaactttaaggcatagcaaggctgctcgttattgtaatagttatgagcctatttttcccagcttctccataaaagacattttaaaaccttgcatatcattgcaatatgctcataaataaacaggtagtcatcttgtcagtatggagtttattataggttgtaactaaaacgtatcctttaaagggtatatgttatattaactgtgatagatatatatgcatgtgtgtatttatgtatatatgtatatgcatgtatgtatatatgtgtgtatgtgtgagtgtgtatatatatgtgtatatatataaaatcatctaatatattccaacctatggcatcacctatctgttcccacctcacttccaacctttgctaaggaagttagtcatgtcatttgtaagggtaaatttgaaatgtgcagctcagtcccactgacgctaaggaaaaaagcactaaacaaaattaaattaattcctctttatatatagtaatgcatttcaaataaactcccagagggtataaaacagttattgtttatccttacaattattatatattcaagtctgaacataaaagcaattgatcttttctgtaaaatgctgattctattaacaaacccacctttaaatattactcgctgttccaaactgctttttgtagactgcttcagccagtactttggagggggcagtcaaccatgttgctgtactgatcctcacacaactacagaaattacaaatatgttttcacaggagcagcaagacctcattaatcaagttgtacacacttccatcagccacaggcagagccaatgggtctgtctcagatgtcccaccctaaattctgtatttgttcactttagtttatagagaataaagccttgtaaaaaataaatctgatggctctactaatggcataatttgtttttctcagctactcctcctcctcccaatggcaaattacttttaaaagtaagtatcaaaaatacatttcacaaagcatgatcttcataatttatcacataacacttgtctcctaaagtaggttttttttgttattttacctgcttatctaaaaataagtcaatacatttaagcatcctccttttgcaactgtctatacatgccctctatttttaaatcataatcactactgagtcacagatggacagatgaacccatgtaaaaaaaaaacattccttgataaatcgatctttccaacttttatcctaatagtatgaatgctcatattcagtcaaattgcttgaacatcacctatgatgctatttttatgtgaaataaagtaaaaataaatttcttggttttgctaccttagaaacttatacatagaaacaccatactgactaaaatgcattattaaactctagatcatatcaatcaaacataagtatattttcctctcattatcattttaaaggatttttgtggcctaagaaaaaattattttaaacatgatcatttgaattttaacatatgtaaataaaatcataagatacataatagtgtcttatacataagtgtcttatccttcaaaaattatgtgagcaaatttgctattcctggatatcatatgtctctcagcttttgcttttttccccattttctttttgtttacaatacaggtctgtagtatttcattcagaacaatgagctttaaaataaaaaaaggattcattttcttttaaatattgtatggttacctccttattatgataaattataaagttcctttagatggtgtcctcatattattaagataaattagtccaatttatcaaagaaaagtgctcaagtggatccatctgtccatctgtgaagcatgaatgctgtgagaatacgactttaaaaatagattcgaagtataagcggtgtacaaagttatttaaatatattaaattattataggtaaattatggtaaataggcaaaaggtaattcagcagaaatatacaataaaaataagcttgttttatcaagctcaatatttaaaaacatgtcacctttctttttcccatattcattttatgaaaatgtacgtttgcccacagagaagcccagacactgaaaatggtctcatcaacacaaccaacattttcctttgactaacctccttcgatctgttttaacactgtagagtgcagaaacgtagctttctatcaaagacatagtgtgctgccctccactgtgtgggagacttgaaattgttcagccccacggtcacttggttactacattacactgcaagaatatagtaggtaaacacagtgtggtgtggggggacaaagtatcctttctgagcagggaggtttagataatggtcaaacaataatggatttcatggtgtcggattcatttgatttccactggcctcacccagaatcatctttagattacttttgaacatcgtgtattcattgctctcctatttgtcaaagtacattttctaggccaaattttgcttttcagagcatttctaaatgacttcccatagatgtcttcaggtttctgagacaaatttgcttgacagggaaaatattcaaactattatttataacctcatttctaaaagaacggataccaattttctcatacatgaatacatttttttaaaaagaactatttaaatctttcctgaaggagaattcataaaatacttacgtgacctgtgctgataatatcagattaatatttttaacaacttcatatgcttaaatattttaagatcatgtcttttcctacaattttacatttggtaaacagcaagcagcattttgtaccaaataacacactcagttcttagcactttttttaaaaaaaaaacagtattatgtttacctaataaaacacagacaaggaaggtacacttgtacagtagacaaataatttgtacaaaaagtgtgccattcaaatagctgaagattataaatgttcatatgggagtaaattcttattccttgattaaatcatcttaaatgacatcttagctaatttataattggagttttcaattaaaatttcttgattaatgaggttatatatgttttccattcctggaaattttggtgtatatatttaccctgtttaaattatgaatcaatgatttaagtaacatgaaaaatgatagaataacgaatacttaactatctaacatcacaaaggctaaatgttgtcattttcaccaattcattcagagtgaattaaagaaaagaggtatagaaattctcatgctttaataatttcttagcaataactcaccagccttaaatattggattcaaaatctaaccttcattatgaaaccttgtatgtcaaaagatatatacaatatatgaaaaaagatgaatacattcactgaatatatattaagtttagaaaagtatattatcctaatttactgcatgagtaactggtataaattattctatttcagctacatctctgcacaattcatttaaaactgattatgagaactcttcttctagaaatgcagaggatgagggaaaataaaccaatgcaacatcatattttgccacataatttcacaacagatattgttcttaaaaatcatgaaatcttcaacagcaagccccctttaaaatgtcttgactcagaatactgtgcaatatcttattaaatactattgtatatatctaaacttgttctaaatgtgatatataaaagtcagaaatatttacatattttaaaaacttgtatatatatacatatatatatccatatatatctccatcaatctatatcgctttgatagaaaatttgatgatctgtattgagaaggcagttttctattctgcctgaaggttcagataggtttctatcagaaataaagtggaaggtttagaagaaaatcaaccaataaaatctatttcaaattgctgaacatgaatttgcaggttttgttttgggctaatgtatctgttttttcctagtttccaacctcaccaagaagagcagagggctggcaaacactggcttaattatccccatcagtctcagagacaaggcgcttaagagttctagctgctgtaaacactcccctgatagcagataaggaatctgctgaaaggcagttttgtctgggaaacctcaggggcacaccagttaatcattagtgcaatattgtatatgcattactacatcaaaggaaacagaacccaatattctattgtgaagattgtctgtgttttcttaaaggtaagaaaacaaatgctaaaccagaaaataaaagataataattacattcgcacatttaccacagaaacaaagaatgttctactttacattttttttttcaagaaagaataagtcattattgctttttattttttaaatgtgcccactgggaaaaaagctttccactgaagtcaaacgtgtaacttttgtctaaagagaaatttgcatctttgtatctaaaaacattgatcagaatcagagaatatcacataaccttattttatcacaacactagaagtaaaacaatgttattcttctatatcagcactgtgtttgtaaagggatctatttgtggaaaactgacacctcactgtccctaacaaagaacctttctatcacttcaaaatgaaggcatccacaatgacctactattctttacatctaatagacttctcatagtcccattatcagagaatcttagaggtttccaaagccttcctagcatgagtccagagttaacttccactctctctcagcccttctgtcactgtgtgcaagccaaagaaaagttttcagcatcaaatactccttgccctttcccacatccttgccttaattagcactatttcttctgattggatgtctatttgctagccccatctctacaggtttacctttcctggaagctccaagtctcatatctgaattcaaaacaatctctgttgcttcccttatgtaactggaagtaatttcttttttcctcgggactcttgtagcaacttttttattagaataatgcctaatctaatgtttggcatatcatgggctctcagtaaatgctgctaaatgaccaaacttagtagcaactgctgatttttattaatgattatgtatggatatttaccaagattttaaggaaaataaaatgaccctttctaccacagaaagcatggtgactttcagtgaccatactgaaaaatctttaaaatctacataagattactaactcatgctactctttcagtgtgtctaaaatcatctaaattcttcactttttttccttgatgaaaaattcagtgatttagactgagacttacttaactatttgtgagttaatcaggatgaaacagagatgtctcaatcaggtattaataagcccagattttgcttctgtcagatatgatacagtcccatcttcttaacagatttttctcagaggaaatttttagtttaaatttttagtttacagccaactcaacatggattctaaacaagtgagttcaacatccaaacaaaagtgaccaaaagtttttttttattctatgttttacaaatgtgtagtctcagtattatcccaagtctatccccaaggtccataaagaatttgaacccatactttaattaaagtttcaggataagggaaattttgtgtaataacatttccatttggttcatacaatgtaattgataaagccttccttaattattctgatctgaggctttcaggaagactctacattatttgaatcaaaccatatgtgcctccatgctttctttgtctagacaccaccagtcaaatagcctaggtaaatatttcatactgatgaagcagtgacatctttgaaagctgacaccaagacagagtggctctttctggagttagtatatcaaagagggaaggttttgcatataggctgtctgtaaagtaaataacatcataactgcaattttgaccttccaaagcattttactctgtaaaagtaatgttatggcagattaattcttttactggcactcttactactcagacatatgtgccagactttctatagtagaagacaaaattcacaatgtgtgagagtgcatggttagaagaaagcttttccttaacaaagtagaacaatagttagggcaaggggcttgtagctgaactactgtcattttgaaatccatttttggtgaatgttatctatacggccttaggcaaattatttaacctccacaatcctcaactgattcatctacaataaaataataacttctattcgacaatgtctggcatgtggttgtcacattagcatttgattaatatgaaaaacagcagaagtgtgagtttcactctgcgttttaaaagtagaacagggtaacaaggtttctaactcatatgacattttaatagacaatataataacaaaatttgatgaatatgtaaaataggttatatccatttaaagcatataattttgtatatacataacattttaaaagtttcacatagaaagttttttttactgaggttaggttataaaaatgagacaaattgtataattgaaactttcaaagagttataataaatatttagttttaatctataaagattttctactttgttattataatgttttaaattcagtggctatcattttttattttctgtactggcagatctggtaaaagtatgactttcaaatctgtagccagatacttccatcggtatactaaaataaagactttgtaactcaatggaatggagaaataaatttaaaaaggaatggccaaattagcggctaattttaaagaaaacacaaatagggcttacaatacatgcttttaggttatctaccacctgttttagcttttaaacatatactcacacattatattttcttagcaactgcaagcccattttgatgtcctaagaatttaatatagctctttaaaaattaacgtactctctaattggtaaaaagaaaaatgtcatgtaagctatctagtgtgacttgttttcttcctgacattcatgccaaatgtgcttagatgctgatgggttatgagatccaaagaatgctatttctcagttcttcaattaaaaaatggtttataaattgccatatttcagaatataaaacttcattttaccaatgccaacacagccaatgccagcactatctttataaaaaataaataatacaatagaaatattgaataaaatttagtaattttggtctcagagtagcaaaaacataatttaaaacacatatacaattgtatacctaaatacttctttcataaaaaaatatactttttaaaagagctattaagttttaattataaaacaattgaaatttaaaggtgataggcagttgtcaaatattacttacagcctaatttttaaaatttgtgccatgaagataaaaatatgggcattttactgcctataaaaacataaatttgaaacacgaaaaaatatatttactgattgtatacaatatacattaatttaaataacagcagagattaaatttagcagtttggtatatatcccactataatatcagacttaagtatcagattcctatttacatgatgtaatattacatttaaatttttaaatttaaatgtttttggatagtatagcttttaaaggtatcctatggttgtaattgtgtgatcagactaagtagcccatgcagacttgtatttgcaaaatatacaatataaaatcaatttcttttcatcatatcttgttaagatattattaaggaaatgatcacttttgtataactaaaagatagaacatgaaaataagtaggcttttaactgatatttattttacctcgttatcactgacaacagaatcatagctacagataatacctagatagatttattcattgaaaaaatacatggatgcttaaaaattaaagaacatgctattataatcatcattacactgaattcttaatatttcaaaatgtaatattcacatttaatctgaacttcacgtccaacttagacacttagataagaataaactgcagccagatatctatgaaaaagacaaatgaaaataatttacatttgacagcaaatacacctaaggcacctgtttgttgctttcattaaaaaaaaaatacttatatatttggaaatgagttacataaatttttgttagataattcattttaaatatggatttacactggaaaattaattggatttacaaacggatttacactacttcacaattggtagtgtgacaactaaaccagcctctatacatgattatatatacatttacaaaacttttaagaactaccaatttattattgtccatgaattccactatagatttgaacttatgactcatagataccaaacagctaatggaaagaggatcaaggatcagagaaattgtgcttccagatgccaatatgttgaatataataagaactgtgaaacacatctagtgtacactgtggaatgacacaattctacacatctctggtaaactggttagttaactgaagaatgtttaaaatttacttcaaatatagaatatttcatatctcaattctgggctgcaactttcctttcttaagtagttctagttccttatgcaattagccattcttttgaatcaacctagcatacagctagttgattgtttagggaaatgggaggaaagggagatgggagaatacccgggaagtgattcagagcatgtattgccaaaatttttacactgtgcatgctttgcttttccaagttgtcctgtgcccaattagaacctgaatttttttctttcaaaaaaatgaatttctgtctaaagccccttgactcctactaccgctaataaagaattctcagtcagcaatttgcagagtagggaagccagggataatgcaactgggcagcctttacaagcaaaacaaaacaccaaagaaagggaataaaaagactgacaacaatgtaagctctcccagaaggctcatacttatttttccccctctaaaatgtaacattaaagaagctgaatcagctgtgaccataatgatgcaaagttttgattattatggcaaattatacctttgctattcaggagagggcaaaaaagttttgtggctcatcaaaagaagcaaggaatgagagccaaggccactgacatttgtggtggcagattaagctgtgagcagactctaaataaattccattctcccccatccccaaaatacactattctggctattaagactgacttgcattttatgcatgccagtacactatccattcaggatcacttatttcagtgggagacagggagggtagtcttctgagttaggaagctgtaacagattatttgtgtgtgcgtctgtgtgtgtgtgtgagtgtgtgtgtgtgtgtgtgtgtgtttatcagactgctaactgaatgaattatagtctctgcttcaagtttaaataagtattttataaaatagacaaaatatttaaatcttatttaaagtcaaatattttataaaatatttataaaaatttctggtcatttaatttttgaaaaaaaatgcttaaaacagaaattagcctttctgtcattcacaatacatgactaaaatcctttcttttaggaacacaaaataaggtttgcaaagacatgtaaataattcaaactaaagttctcaaagatatataatctatataagaataaaatgctcaaattatcttgtgaactctttggttttcttgattaaatgatgttttctttttacattgactaacgttctttacagttgttttggaataatatatccccatttagaagaaaaataagaatatatctgtcataagactgatgggaaaatatgaagcaagtaaagaaaattataacaatcctaaaatgaaattatagaaagtgaaacaatattaaggaccataaaccaagtgtcattaaaaatagtggcaatctattgcaaattcagcattaccagtcaaactaaattgactgtaagtactgagaaaaactttacaacttcatttcaagcctaattttaataaaaatatttccttagctacaaatagctttatgaggtataaaaaaagaagaagtatatgtaggaaatattatctttgataagtcagtaaatctgactcttccataatcaatgatatataacctgatatccttgtttcggtttatacatatgctttatatttgttcatctacaaatcatgataatgtttttaagctaactagcacacaaagaactacaaaagttcaaatttacaaggactcacaaataactgtaagtacatactgaggagaacaggtttctattgaggaaaactgtctttagtattcagaaagtgtaccttgaagggaaaaccctccacgatcagaccagctaaaacaacaatgacaattaagcatatagtagaaaaatatcaaatatcaacaatgacaattaggaatatagcagataaataccttcaaatctaagaaaatgccctaaaaattttgatatgtcattcagtggcagtgaggcaaagaagacagggatcaccatctcaaggtgctagcctccgaaaaaatataaatttgattggcaaaatctgctcagagaccatttacatgctattcatggaataagaatgaagttgaaacaagtattagagtatgttctgtgatgcttactactgcatatctgatataaattatgattatattaaaaagcttggcagttttcactgtgtggcctggtttgtgcaagataggattccaaatattgttttctccaaaaactacagtgaattaaaatgacaattttaatatcattggactgcttacacatcacagaggatataaaaattatggggaaaaaagaacagtgactttaatcagctccatgttacaaattacacctttcagtgttaaggatacaaaaattccttaaagggaaaccagatcataaaacacatgaattcagggagatctatggctaccacaaaccacactgtccagctattggaaagtattgtcataaaaaagtttgattgttaatagatttctgaaatatttccaggtgattttctcattaataatatattttatcccataagacaatcaccaataaaacataagatacataacttagagcacttgatactacattttgaataatattatcaagaatagcttttaaaaatgtctctgcttttaactctatggattaaatgaatttataaagcacagatttatttatatggattttaaccattcttttaataaaacgttatcaaaattataaaaatattattacatttttaaataaacaatgattactatagttgtataaatgaatccaaaattgataaatgatctctctatggactgaattgtgtctcttccaaatttatatgttgaagccctaacccccaatgtgactgtatttgaatacagggcttttcaggaaggttaaacaaggtaataaggtcagaagagtgaggccttaatctgataggactggtgtccttataaaaagtagagacactagataactacacccccaaaaccctgtcccagcatgcagagaagagatcatgtgtggacacagtgtaaagacagccatctacaagtcaaaggagagtcctcagaacaaaacctatcttgccagcatcttgatctttgactctggcctccagaactctgagaaaatacatttctgttgtttaatccacccatccgtggtgttttaatgtggcaggcctagaaaactcttaatggtgtccaagcaaacaaaaacataaagtggggaaaggacacccttttcaacaaatggcgctgggataattggctagccacacgtaggagaatgatactggatcctcatctctcaccttatatgaaaatcaactcaagatggatgaaggacttaaacttaagacctgaaactattcaaattctagaagataacattggaaaaacccttctagacattggcttagtcaaggatttcatgaccaagaacccaaagcaaatgcaatgaaaacaaagataaatagctgggacttaattaaacaaaagagcttttgtacagcaaaaggaacagtcagcagagaaaacagacaacccatagagtgggagaaaatcttcataatctgtatatctgaaaaaggactaatacccagaatctacaacgaattcaaatcagtaagaaaaaagtaaacattcccatcaaaaagtgagctaagggcatgaatagacaattttcaaaaggagatacaaatggccaacaaacatatgaaaaaatgctcaacatcactaatgatcaaggaaatgcaaatcaaaaccacaatgtgataccaactttctcctgcaagaatggccataatcaaaaaatcaaaaaacagtagatgttggtgtggatgcggtgaatagggaacacttctacactgctgctggaaatgtaaactagtacagccactataaaaacaacgtggggattccttaaagaactaaaagtagaactaccatttgatccagcaatcccactattggatatctacccagaggaaaagaagtcatttgaaaaagatacttgcacacacgtttacagtggcacaattcacaatagcaaaatcgtggaagcaacccaaatgcccatcaatcaatgaatggacaatgaaattgtggtctatacatacaatggaatactacagagccataaaaaggaatgaattagcagcatttgcagtgacctggatgagattggagactattattctaagtgaagtaactcaggaatggaaaatcaaacattgtatgttctcacggatatgtggaagctaagctatgaggacacaaaggcctaagaatgacacagtggactttggggatttgaggggaagagtgagacaggggcgagggatgaaagactacaaatatggtgcagtgtatactgcttgggtgatgggtgcaacgaaatctcacaaatcactattaaagaacttactcatgtaaccaaatcccacctttaccccaataacttatggaaaaaaaaagactcttaatggtgtccatcaatattagcttttcttctgtaactgcatagctgtttgaggctgaggaagtcatttaatttctctgaatctgtttcttcctttgtaaaatgatcaagctaggctagctaaatataagacacatataccaccactcttttttcccatgcccagagaaaccatactattcttggtaatcataaccaatcagtgggaattatcttgggagatatggcctattctccacacctgagttggaagacatatgagctcggttttagtactattaatagcaccgtaggtccctactactacaagtgcggcccgtggaccagcagcattgacatcccctggaactcacaaggaatgcagaatctcaggcaggctgtaggccaaccttctgaattagaatctaccttgtaacactatccccagtgcacatttgacaagcactgatctaggactcattaagtttctaaaacaaaggttgcaaaaagtggcaagccacaaactaaatgtggtctattacattttttgtttggtctctacactgtttaaaattcttgaattatttgccaaaattaaaaggaggaaaagttcataaaaagagattaatttattgataaattgcatgattatataaaaataggctaacatttctgtatgacaacagtggagctgagtgacactgcttcctttacaacagaatgctacatgttccctgtgacagggttcattgcagtcctcttcatttacttatgttatctacctgaccctggtacgcatttgactttctaatctctgctgtcaaatttccttttcttacatgtagcattgaattaaaaaaatgtaacaataaaagatgtttaaatatataagtatctgtccaaaattaataattcccgttatcatttttagttttctatttttcttcactcatctctacttattctttcttttttaattttaaattttcttttatctgaatcttaccattgcttgttttaatgcctgtatattatggcatttgtttactttaatccatcagagattttgtcatttaaccttgctctctagcagtctagtaataaatgattttgtaaagtaatacactacctttttttattttgtgggaacagggtctcactctgatgcctggctggactgcagtgtaagatcatagctcaaagcagcctggaaattgtgggctcaagaaatcctcctgcctcagcctcacaatagctaggattacaggcatgagccactgcatctggctggaatatactaatttcgtttaaagcaagttatctcttttgcttcacgtcttgtaaaatcattgtgaaaaacatttcatgtcttcaaatgtttttaggatccagggaaaatttagaaaaaaaatgagaaattaaagggagatatagagagaaatagtaaattaatgaattggtgattagctgattgacatggtttggctctgtccccacccaaatctcaccttgaattgcaataatccccccacctgtcaagggcaggtccaggtagagataattgaatcatgggggtggtttcctccatgctgttctcagaatggtgaattctcacaagatctcatggctatataaggggcttcccccttcactcagaattcattctctctcctgctgccctctgaagaggtgacttctgccatgattgaaagtttcctgaggcctccccagccatgtggaactgtgagtcaattaaacttattttcttcataaattacccagtctcagatatttcctcatagcatcatgataatggattaataaactgaccaaacactaaattcagaaacgtgcaaggcaccagccaaaaatctaattacaataactgcctctggtagctagttggatatataagggaacacactgccccaaacatatttttatagaagttatgaaaactgatacattcttagctactttgggccttgaatttaaaaatttccagggtgataattttcattaaaattaatggaaattaggaaaatatgtaacatagtattattttcattttaattccaattaccttaggaattttatcttcttattctcaaatcccaagtcttactactattttattgttcagaatcttaaaagccatttaccttctgtttttatataacccttaaacactgattcccttaaacaatgaaggtatccacatagttttaaccataatgtcaatagcaataaatgataactctttacctttagttatatttatcccacttctcagtctttacctcttttcaaatacctaaaattttatctgaataaattaaagtcacctcatactcaatatatctagtacctaatttctcccacataaccattattttcccttaactcactgttgatgtaaaaagctattatttgaagaatctcaagatgactaactggatatgaactagagatatgagtaaaacatgtccacaaatctcagcagtttctcagtgaaagcctgtttcttgtgtgtaccatcctccagatttttactgcccaatcacgttgggcaaggtgttcttggtttttccccagcctatgggtttcattgggacctgcctcttccagtcctctcatctgccatttttagactaatcattaaatatcactagcatagtactttcatatttaagcatcaaaactccattgttacattataacaaatggaatctaaattcttgttcactttaaaaactttcaaaatctgacaatactctatctaaacatatcctctgctctacgcaattcagtttctttacaatgtcaaatacatgccatgctcaaaagagaggtttttaaaatgtgcatgcttgtttccatctcctacatgctggtttctttctttctcattttgaattaaacaaatatgcatttattacccactacgtactgtcttttaaaatccaatgcaagttctattgtatttaggaagactttcctatgtcagcactcatttatttgtggccatcactactgataatttcaataactaccctttgtggagtgcttaccactgccagatggtcagttaagcaatttatatacatcatctcttttgttcctattgatatctctgtgaagtacatattacaattcccatactatagatgaggaacctgaggatcagcgcacttttggcacttactccaaaccatgaaaagtcttactttgagctgagaggctcattctctcctctccacttaaagagaaagaaaaaaaagcatgaaagtgatgaagagttacataggcgagaacttggtttgtgtgacccaaaggatatttgcaatttagtagcaagctcattttactataaatatttttctactttgtaaagatggcaatagtatataaaatattttaaatttgtgtaaaaatatgttacttttaaaacttttaaaatctgatattagcataaacaagaagacctgggccttatttacaatgttgaagaggctggatggcaataggccaagtttgaactaagtcctccaccaaccagtcctgaatctcgtagcccccttttccttacttaatcgataatacactaggttcaaagcaaggacatcagacacaaagtatagctatgttctctcttttttgtcaacagttacttaaggccttcccaggctcatggatgcaaattgaatttaaattcataagcagattccctctattgcttgtcttcatcacaacgcaaaatatggaactatagcacatttgatttgattcaaaattaggacctctattggcctaagacaattaaccccttgttgaccttaaatcctataagatccaagcttcctttgcctagctctgaaagcctgtcttaaaaagatgcctggccaggcgcggtggctcacacctgtaatcccagcactttgggaggttgaggcgggcggatcacaaattcaagagatcaagaccatcctggccaacatgataaaaccccgtatctagtaaaaatacgaaaaattagctgggtgtggtggtgtgcacctgtagtcccaggtactcgggaggctgaggcaggagaatcgcttgaacttgggaggcagaggttgcggtgagccgagattgcaccactgcactccagcctgggcgacagagcgagactccgtctcaaaacaaaaacaaaaacaaaacaaaacaaaagcctgaccacatcttttgagctatgtccagctgtctgtagttctttatacactacattttactttcttctcccatgccattgttcatgctcatcccatgcctggaacagccttattcacccaatcatcatctctcaagacaagattaaaactatacataacagggaaaatttaagactgtactgaagagcaaaaacaaaaagcagtaaattggtatagaaaatagaagaaacttccaaagttaatctattaaaacaatagtttttgtacttaactattacaataatagaaatgataatgatggggttaatgacaacactaaatacatttattaagtggttagtatatctcagattctctgtaaatcattatatactttatctaacaccaaaaataaaattaaaataagcccaagaaagtagcattatattatccacattttagagattaggtagagagtacaaagttttagtaacttgtccaacattgtacagctaactaagttgacagagcctaatttgaattcagttgcaactgatttgtgaggaaagcataataaactcctataacacctcttgttaaattattaatcagattatagcaatgactatttttaggagccatttttgcagtcaatgaaactggagataaaatcataataatgatagtaatagttacagttttcattattattgtgtggttttccatttactcaaggattatttcagaatttttacagcatttactatagtttgttaagcaaagtaattaataatgaaagtactaagaataatgtagcagtttaaataactttaaaagtgaaaaggatacaaaatgggaggtattaaggtatcaagttatagttctattttatatgatatggttgaaaggtaataaaaccaatggagatacatatatatccatatatatatccacatatatatccatatatatatatccatatatatatccatgtatatatccacgtatatatccatgtatatatccacgtatatatatccatatatatatccatgtatatatccatatatatatatatccatgtatatatccatgtatatatccatatatatatatccatgtatatatccatatatatatatccatgtatatatccatatatatatatccatatatatccatatatatatcatatatatatccatatatatccatatatatatatccatatatatccatatatatatatccatatatatccatatatatatatccatatatatccatatatatatatccatatatatccatatatatatccatatatatccatatatatatatacacacacatatatagctactgtgatttgacataaaacatgtaattactgcaaacacgtgtttatacataaaaataggcagatagacattattcagtggctaatttttaaaataccaataataatgctgtatattatattacatccatggctaaaacatttcaaagaccttaacagtgactattttgactttgaaggaagttggtgatgaattaaaaatccataaaataaatataggaataataaataacaaaaagattaagggaacagcacattatagtatagcaacaataacaacaaaacctccaaaaatctaaaaagtgaatgtgcatctcttcccataatttctctgtgaccaagtgtgaacttgcataaaagcaaacgatgtgtgtgtgtgtacaccacacatatgccttcatttctttcaaagtcatcattttccacatatcattcatgtttttagaaggcttcaagttttaatgagtcagtctaactgaaaatattacaaatataaacacacacacacacacatatttgtaaagaggaagaactagagtgccataagacaagtgagataaatgacaagaatggcgtcagttccattcttggcctccagaaaggttcctattagtttgtcctcggctttggaaactaacaaataaagaaaattgcatatgatttggggcaagaaaattttctttagtcactgatttactctgtggcacaatcatagcagatagtgcccaaattgaaaggggaaagtaagaggtctgttaatttttatattactgagaagatttttagaaataaatatggggaaaaaagagtgaagaagaagtgatattctctttccagattaataaatacatgattaaagatatttgtcaatgattatgtaataagtctgggttagaggaatatattgacctgcaacataaacctaactataggtcagatagcctcatatgaatcaattattaacttactctaaataaaacacatactctaatataacacattactctaataaagcttactctaatagaacacataaccaagccagataaatatcatggatatgacaagtcttacagaagtctcagattatggagagaaatcccccaaagtttaggtatggtactaccacagtaatataattctgctgaatattttaatggcaataaatactattaggctgttttgttgtaaacaattggcttagattcaaagagttacatgtataactaaatcaatgtgaaattcatctaatgaagaacagttacttgatacctaatcttgcctgatcttttaacaacaaataaaattgtaatgcaacaattctaccattaatacaacttttctcactaacgccacttatgtgtgtggttcgtgtttagaagttacatcaatagcaagttgctgggcaactacatatctgagagtgtaaatgtggattattacctgattctggatgttacagttcttagaagaatgcagcctatattttttcttataagggggacttcaaaaacttcatggaaaatgaatattatgaaaaagctatggatgtatttccatttttgtaccaaaataaactcatactaacttgatatatcatgtctgaacaggaaatagtttgaggcattaagaaggattagacatcagtttgaaaagagcccctatcagagcaacatgaattctgctaaagttgaagcaagaacaaacataaaatttagggtgaagcattggtgaaagaatgatgaaatcattgatgctttatgaaaagtttgcacaatgtcccaaggaaatcagcagtttacaaatggataacttgtttcgagaagggagaagaccatgttgaagatgaagcctgcagtggcagacccatccacatcaatttgtgagaaaaataaaattcctcttgttcatgccctaattgatgaagaccaatgattgacagtagaaacaacagccaacatcacagtcatctcaactggttgagcttacgcaattctgaccaaaaaattaaagtggagcaactttccactcgatgggtgccaaaaccattgtgcccagatcagctgcagaaaagagcagagcattaatggaaattttaaacacttacaacaggaaatgaaacatgtattttccagtatgacccagaagacaaagcacattcaatgcaatggctaccaagaggtggaagtgctccagtcaaagcaaaagtggaccagtcaagagcaaaggttgtggcaacagttttttgggatgctcaaggcattttgcttcttgactttccggaaggcattttgcttcttgaccttctacttattatgagaatgtcttgagaaggttagccaaagcttgagcagaaaaacatctaggaaagctttgccacggagtccttctccaccacagctatgcttctgctcattcctctcaccaaacaaaggcaattttgtgagcatttcaatgggaaatcattaggcatccaacttacagtcctgatctggctcctttggacttctttttgtttactaatttaaaatatctttaaaggacactcattttcttcagttaatgatgtaagaaagactgcattgacattcttaaattcctaggaccctcagttttttaggaatggactaaatgtctggtatcatcatttacaaaagtgtcttgaccttgacggagattatcaagaagcaaagcttatatttttatcttctaatttcatttttccatgaaagttttgaagtcccttcccatatgttcaaagaatgaataagaagcaggcaaactattgagaaaacacaattttatttcatctgtctttatttcattgtctttatttcatctgtctgtacctaacttctgggctgtagacacagaattgttgggagagagatgaaagaaccttcactatatcttctcccctgcttaacttattgtacatggatattgttttgttgacattgcctttggtgccactgcttaaggcaccttgtaatatatagctcttacgtgatactgtaaaatcatagaggtagtactaaaatgactgaagtttggaaagcacttaaatgttcctggcaaatatatatatatatatgaatatatataaaataaaataaagttatataaaatatatatacaaaaatatataataaatatacatatgtatatacacacacacatactcatgcacagctcttctatagagatatgttctgataaatgtgtcattaggcaattttgccattgtgcaaatattagagagtttacttacacaaatttaggtggtatagccttctacacacctaggctgtatggtatagtctattgctcccaagctacaaacctgcactgcatattattgtactgaatactgtagccaattttagcataatggtaaatgtttgtgtatttaaacatagaaaaagtacaataaaaatgcagcaaggatgataaaaaatggtacacctgtctaggggacctaccttgaacagagcttccaggactaggagttgctctaggtgagtcaatggatgggtggtgagtaaatgtgaaggcctagggcactacagctactactgcagactttgtaaatgctttacacttagactacactaaatttataagaaatattttcctttcttcaataatataaccttagcttaccttaaggttaagttttaaaaatcctttgtttcttacttcataagttttttaattttttaaaactatttgtctctcttgtaatactacctactttaaaacacaagcacattgtacagctgtacaaaaatattttctttctttatatccttcttctataagctttttcctatttttatcttttaatttttttttgttaaaaactgacacacaaacacacattagcctaggcctacacaggatcaggatcatcaatatcactgttttctaccaccacatcttgtcccattggaaggtcttcacgggtaatagcacgcatggtgttgccacaacattataatggttacaatgacactaggcaatagaaattgtttggctccattataatattatgggactaccgtcattaatgcagtattgttggctgaaatgtcattatgcacctctctctctctctgaggaagacagaagagctgctttgaacagaatactgttctatatgccatctgcatatagaacttcaaaagtctcaatagaaccaatgttctttgtccaagttgataaggtaaagagccctgcattgagcattaaaataactgactatcctgttttagagatggaggtactcacactatcaggaaacactgagatgtttagcaattattaacagtgagaaatactttcttatgtatgatatagtcttccattggccttttgtctccagcaaagatactggggtaccatcttctgggaaatcagccttgagagagttattttcacctaaaatttgaaggccatcattcaaagcgctcatttttttttccccttccctggtcaaattcactcgcaactaaatatttttattcaatcttctttatctttttattatctttgtggctacatgattaatatttctctgaagtttggtcactattaactcagtatagtgctgtacatttatactaacacatggtctacaccagatcaaaattatatcatatgcattaccaatgttcgagttaacaatttataaacttctgcacagacatgcagtagtaggcattgccatttatgctaaatttctgatactaataaactatttaaaactgatgattttagttccattaaaatgcagaatttaggtgaggttctaaaatattttaatattcatcgtatggcacccagttgttttttcttttgtaattttgaaaaattttaaatgtcattacatttatagtagaaataatcaaagtccactttcatttaccacttagtttcatgagtaaaaagttcaagtgaaatgttcaatttttgtgaattcacaattaaaaccttcaaacattagctgaaattttccagcaatatattttatttgattatctaaagagggggaacaaattctaattgtagcaaagcattagtaaagataagtgaagctcatgtaactgttatcctcaaagtcattattaagttatcttgtgctcatttgctcatgtttaaacaagattttccatttgcacacagcaacaaagtagtcgtcaatatgccagtaaccacacagtgataagaaagagcacagctatgtgaagtttagaacagctcctttattcaaatatctacgaaataagaaaaaatttgtaatgtaccatatataaatgcagtatgacgaaaagttatcaataaaaaatatggaaatagagtcaacatttgtgtagactacctttactaatgtctaatcaggaatgatcactgaatattatcttgagccagaaagatctttttaaaaattctttgtcaatctattgccaagaagtccatttccacagctctttaactttaataaactatttttggcaatgggaaaaaagaaaatggaaaaagaaatcaagtggaaattatcataacaaaataaaagtgacacaatgagaaagaatcttaaaaattaatcccccaccctgatattttgggggaaaaacactcaatttttctatcatatatatttttcttttctctctctcctctgtgtgtgtgtgtgtgtatgtgtgtgtgtgtctgtgtgtgtgtgcattttccatactaccaatgggaggctgaaagcaatgaaagacaaaacattgtaagcatttttaaatattcaaaataaaatacaaaataaatgtaccgcaaagtcacacctaccaggcacctgtatcagttctactttgaagatacagaaaatgctaaagagttgttcaagtagtagggctaaggacagtaagtctctttatagctgccatctaataaggttttttaaattttatatttttctgctactctgctgcatgattatacacacacacaaacagacacacatctacatacacacagttggtcttctatatccatgggttccacatctgtagactcaatgattagtaaatagaaaatattcaggggaaaaaatgtgtctgtactgaatatgtacagtcttctatttcttgacactattctacatctaataaagttaaaaaaactatttaaatagcaattacattgtattaggtattactagtaatttagagatgatttaaagtatatgggaagatgtgcataggttatatgcaaatactaccattttataccagggacttgagtatccatggatttaccaatacctcagatactgaggaatgactctgtgtgtgtgtgtgtgtgtgtgtgtgtgtgtgtatgatgttatgctaagtgataaaaacagatttacaactgatgtatttgtttaggaaattgacatcaggaatgcagctcatttattttaagatagtgtacttgataaaaaatacacttaagttatacttaaatatatttcatttatattaaatatattttattttaatgtattaagagtatttatgtatatattttctcacgagaatttaggctctttgaaaatgtatcatacatctttatcatttataattactaccttgcaccctttttcaataattgttaaaatcacatctggaatcccatagcaattgatgacatttggttataattagagattaaatcaagtatattgtatttacttaaagtttattcaaataatattttcaaagttaaagaaaggcccattatttatttcacaacacaaaatcatatattgggtagtcggaattaaagcaatctaaatttcctaaagcaaaggagataggtttcttttttcgttttcattgtttcaagtaaaatgattgtttttccataatttagaaaacaatagtatcttcaccgaaaaaagtcatagttaaatgtcttcccacatcacacaaaagatttaaattaattattgcttattttttcctgtttaaaatgctaacaagcttaaaacattatttatatttcacaggaaaaatgattcaaattatcctaattaatgcaaaattaccaaaccaaaatcttacaaaaattagatgagtcagttcaaaaagttagataaaaagtcaaaggttggctcaaaagaagcagttgtacctaaatgattaagtaaccacttctacagaggtatttttcactctgcgttggaaaggtgcactgaggttaatctaaatgtagcctttttcatctgtataccagtttccagactgtcttgtgtggtataatttacttgttgcttggaaaaccataaacaaaaataagtgacactattacatgtatatgtgtagtgagacattactttttccatgttttctcctctaacctaaaactttcttaactctccaagcaattgcagcctgtcttcaaataccaccaaatcaaccattttgagttaaaattgggctctctgccaagtaattagtcatgtctccaattgccttattagatttattcatgacggaatcatattatgaccagaaaaaaatcagagccccaataaaaatccagttgagctgtctaggcatcacttaaaattaatgtaacaaaaataaatttattcataaatgcattatataccctcacagataaccaagtcttgaaaaagtcaaagctcagaattgtaattattttttgatatttcaactacccagaactaacctacattaaatctgtttttatatattataactttatatgacatcattctttttttccccttaacattaaaaacagtttcccatataactccagtgcctgtgtgatattctgtagatcctcactactcaaagtgttgtttatggagcagaagcaacagcatcacttaggagtctgttagaaatacagaattttagacacctccccaggcctactaaatcagattctgcatttcactataaatatatattattatacacatacacacacatacatatacacacataaatgtatattatacacatacaatatatattatacacatgcacacatacatataaacacatataaatatatattatacaaatatacacacatacatatatatacacattatatatttactatatatttatactatacacatatattcatacacatgtatacatattcatattatacacacatgtatatacactatataaaacacatatgtgcatatacacttattaaagtttgagaaatatttttgtgaactctatgtaaaaatgtgtgtattttttcctgcaataaaacaactttataatatgacaatatgtagtatacaactgcatatatatttatatagttcacattgtcctactataagttcaggttgtttgtaaatgtatctagtattaggaactgttcaatgaatattttaatttatatgtatattttccctgaatttctgaatctttcctcaggaatgattcatgaaaatgaaaatacttgaataaagaactctacattgtaacagttgagacagacacttccaaagtgttttctagattacaagaataacagcggtattttttctgcactaacacctacattattacttgtttaatatagatgtttaatagcaggaaaaatagtatctcacattaattataatttgtaattattttattgctagagaagttaaacaatttatcatgttttttctttttgtactcttcttttgtgaatttttctgtacattttatttcccaatacattcaggacttggtatcttacttacaatattataacccttttaaatattgagggtgttatgtctctttctgtgaacaagtggcatttttttttctaccttactgttttttatattgcgatatggtgcttttgacttttatgtagttaataaaaactaacaactttttcaattgtttttaagcttagagagtctttacccattcagatactcgaaataataaatcaagtgtgtttacctttttctatagtttgatattttcaatagccatgattttgcattgaatttatattattatatgcaatgtaataaagacctaacgtatttctttttcccagatgacttaccagttaaccatcaactggtctacctacctacaccctacaattggtttatgaagaaaatcttgtatttattaaaaatatactgattaattctaagaatataggcacatatttacttctttcctatttcttagaagtttctacttattcatatttcttagaagtttccacttatccgaaagaaagaaggaaagaaacaagagtatcaaacttttccctaatttgtgaaaaatatgactgcatgttttagtacagtctattgactagtaaatcttttaaacaattattttatgcttgacactttagtggatattgtggtggatacaaatataactttaacatgcaatgtttaacctcaggaagctaaaattcacctcaagagacaaagcataccaaacatttagatgttaaatctgctagctttcaggaattcaaggaaggggaaaaagaatgatgagaacaaaactgaagaaagctttgtgaaaggttagagcttttctagtagttgggaagcacaattcaggttgaagtcacagcaagtacaaagtacctttagttatctgtgttatcgaagacaattattcctacatttattatgattaattaggcacatgtcaggcttcctagttcatcacagattaattttaaggaccacagttttacatttccaatgtcctacagaactctgaacacagtgcattacccattgtcattgcttgcttgacatttgttcaattaaattgcttttgatcttgtgcacgaatttttataaatattactcctgatgggctagtatatattttaccagtatctctgtgttgtattttagaataaaggtgtcctaaaggttatgagagtactgttaatacattccagacccagtggctacaaactcttaataagcacagaagctgcttttccttcctccaagcgaaacatcataaaaagtaagtgacagcaattgtgaccctatctgtagaagtttatgagaacaatttaaggacagattgagttacagtattattgtaacacctcatcaaaattcttgtccagatttttagcagtgacttaagacaagtagactggcctgttactgctgggatcacttccagcatcttacccagagcaccaaattacccttttcagttaaccccagttatttttctctctccttcttgtgacggagagagtatataagaaaaggggctctttggctgtctagggcaagaggcaaattcttttctaccattctgcttccaaagagacaaattcctgaaactactgtgacattacattagcagagaaacttatgaaaaggtcatgtctaaagacttcatttgatttcctcttatcagcctgaagccatttaatagctacattttagttttataactatttcaaagagcaatatatgtacaaaaaattaaccatgtttagcacaaaatggcaataatttatgctagtgtaatgacataattacagcattcattttcaccattcatttccacctaaagttagttttctaaaggtaatgggaaccaatatggattttcctaagaaaacatctggcagttaaatttcaggagtgaatttctacatgagggaatgttgtaaatgcaaaggaagaatagaattgttgttcttaaattccatgtttgtggaatatatatatatatatatatatatatatatacacacacacacacactcacacacacaaacacacacacattataactactaccctacaaggtgttccacaatatattatttttaaaagagagataaaaaagaatcgtttgtgtagctgcaatcttcatgtttatgacagaaaaattcaacagtgtttgcaaactaactggaagattacactttattgcaaataaacggcttaagaaacctaattcagctgtgatggatctcaggctgacaaattaaaagactgcaggcaatggctgtaaaaatgctttttctgcaagatttacttcagcatgttgaataaatatattatacctgttaggcttaattctatatttaaaataaatcctggatggtgtggggttttgataaaggtattcaaatatatggaatatagtgcttttaacaaaggattcccaggaggaaatcagtggacaacaatgttgaatgtactcctcactcatcgacaaaccacattttcctttctaaataagctgtgaaaatcctatctgtctatgtgagtcaacatcccattcaaagattaaaacaagcccatacacgatcacctttatctgtacaaattaagcaactctcttcttgatataaaccaaaaggaaacctagtttattttcaaaatcaagtttatgctcctgaaataattttgagaactgaaattttgattattcttatttacacctttctgcttgctgttaatagtatagatgccaatccctcaatcacaagagaaaaagtagttatgtgggtcttttttgttttgttttgcttttttcaaaaaacctataatattcatataaacttcaagtggaaagaatggggaaagcagtaatcctatacttgaggtaaaagcaaataacaacagataaaacccaaacagaatttatatattgaacatttttattttaaattattccatatccaaaatttcacagtcttacatataggcagactattgttttatccacattaagaaacaacctctgagttactagtatttctttttataaaagtagctttgtttaatatccccattttccatatttgccaaaagggtaagacaatcagtctctatcttaccagcgaagaccagtcactctctctgtgtcttcctctccctaggtcttccaaacctgatccttaagtttatttatgtgtctgtcatcctttaccacttgatagcttttaaaatacaaaaaaaaaaaatacacttttttgtatttttagaactgagtgttttttatcgactcccaaggattcaccttccaggtaaacacttattgccaaacttctatatttggcccacacctctttcctaaattcagttgccataagatatttgtattatctctccatgatgtctcataggcacatcaaatactaacttatcacatacatcctagaatctctcattctttctccaggtttgggtggggaatggcacaatcatctacttatgtccttaagacaaacaccaggagtcaagatactctggtaatcaaagctgccaaatagatctaaacttatttccctctctacatatgaacaattagaaagctacctattcattctccacactaccaagagagttctattttgtaaaagcaaatatactacttcctttctttcttaaaaaaaaaaaaaaaaacccattaactttcattaccttctcctctgggacaaattacctagcataaaatgaacagaactaggccccaactacactttatcttgtaccattcatcctaacttgccttgttattgcatgcaacactacttcctctacctggaataagctcactaccctccttgttcttttagaattaagttaccaccctttattcaaatgtgtttccttgtttccataatactaaccatatattttaatatagaggtcattaaattgtcttgaaattatggatctctctgattatcttcttactgttccaatgattttgtcttattcatctgtacatttcttacatagtggcatggctataataggttcttaataaattttgaatgaacccttaagtaaatagtaaatgactgaatgaatgaagctgatccctcattttggaagaaagtggggtattttaaccatacataatcaccttttcttttccttctagtattaaaaatcaagcaaataaaataacctgaattcatccagtttagaaatacttctgaaggtagatattatatgtatctgtctacaaaggagtacggttatttgtatctttttggtttggtgtatggaacatgataatatcttattttctggatacaaagcgaactataaataaacccttagccttttgctgaattttagctaatatcaagcatagttttaaagtgccaaaagccacaagaagcaaaaagcaagaatgcatacagcagcgttgaagaatttgggcctcatgtctggaattcaccataataaggctttggtactttctatctcaactgaagtcttactttgatacaatctgcctcttgcagttagaacacattttttttttttctttttttgagacaaagtctcagctcactgaaacctctgcctcctgggctcaagcaattctcctacctcagcctcccgagtagctgggattacgggcacacaccaccacgcccagctaatttttgtatttttagtagagacggggttttgtcattttggtcaggcttggttcaaactcctgacctcaggtgatccacccaccttggcctcccaaagtgctgggattacaggtgtgggccaccatgccctgcaaattagaacacatttgaatcttgaacattttgaattcagtttattctgaaatttctgtgagagaattaagtgttatatccctttgtatatgctttgatttttcaagagtacacttttggttaatgtgaacaactcagcaacaaagatgattaacggcaaagatggctgcatacatactatattcagagcattgtataattaactaggtgtgtatagaaaccatgctcaagacaaggttttctgatctcttgaggctcaccacctagaagtaatatcagtattagaattttctgaaatattataacatattgcaagcaaataccttcttgaatatgccgttagagagaatataatgcttctatatagatcccttgatatctgaaatgggtgttaaattctcagttgaggagtaatcagtaagctcatgactaatctgactgtactaactagagttttataaaaagatacagagaatttattaaaataggaagaagtaaatgattttctagttcagttggaagtagctgttaactcagaagtactaataggttgctgcatgatttgaaatagataaaatggatatcagaaaagattttcttcctaaagcattttatttgaagtggtcagaataggacaaagcatatgctttcaaataattagatttgaaagggaagaattgctaaataggaggatcttgaagccagcattaaacacatacaggctgaatgcctcaagaatggttctattcttctcagagttcttcgtgctgttatacctggaactgggcagagaggaaatctgagcagccagagcacaaagggtaaacactagggttaaagaagtcacgaacattttcctccagagggttgtcacggatggactggaatggacaaagtcaggcatcaaaaaaatggactgaacctagaagcagaagaaatgccatatttcatgggatatttttctcccttcctatcttgagaaatgtcgtcattgtgggcatacatgtacatatactcttaggtattatgaaacattaaaacacaatgcctaagaattaacagaccgttcttagggccaatcttgagagccttgacttactttgtaccacaaatttgttgatgaaaagaatttattttctaatttcaaaatattagatggctgctggatttctctaacaaagaagaatctgaaccagaaatggaccaacctaaataactgaacaaggcatctctaaatataattcaacttatatatgctgcaatttgtacctgctttacaagtcaataagcagcttttatgtgatctgagaaactggtgaaaaagtgtatagactacaggttaggcagtttggtcagaaccgcctttatggggcaaaatctcaaaatttcaggtggcagtttcacaagcaagtgcctaaatctgatgttccagcataacattagcaaacccctcttacattttggtaaatgtgatgtagttacataatgattatccaataagctaaaagaggagacaaaaagtatgatttaaaaatagatacatatattgaaaatgagtattcaccaaaatataatcctacctctaaaacaagtatagaccatatacacatataggcatgttgtgtcagaagtagagatcagtgttcaaaagttgctgattttacttagagttcaaagtatacattagtaaagcctgaaaatatgatatcaaaagcaaaactacatctaatattttccttattttcttgttgtgcttacagttaccataagaaagcctgaaaaattcaactctggtcaatcagcactctatgggataaaagaattcactcactcactcatttctttatacaatactttagcaaatatggaacactgtgtatttgctaagcactctcccaggcactggaaatataacagtgagtaaaacttacaagtctccacggaatttgtgttctagtgcacagtacattaatattactaaaattattttagtaaccatttgttgagcatatattgtgtacttggcattatattaaaatttagctctcttttgtgtgtataattctaaattatattcagagcttcatgtgattgctaactttcaaaaacatacaacaaataattttacataagacaggtgaaattcagctgatgttattaaaatggtataataactcatgtgcagttataactcaaacccaggtctgtcttattaaaaaaaaaaactctgctctagactctgctgtgctctctagaataaaagaaatagccctcattcaccaatgaaaaatgaatggttcagagagagtaaatgattttcctccttagtaatataatggccaagttgaagaggctggaaagagaaatgtgttactttaaatgaggaaaagctgaaatgcaaaatcttaaatgacttatgtaactgtaaattaaaatgtaacatctcaggaattttcatttaaaacatatctaaaatgtagtcataccacaaaagaaattttcactgttaattgagtttattaaggatttgtacattgtaccacttcagggcagggacttcatttattagtattttaagtattattaaagagtatgtaaatcaatttaagtagactaagaaacattctaaatatcaagttttatttaattttgtttttcttgttattgttttaaataatgaaatcatttttcacctgttatctctgagggaatttacacacattaaaaaaatcatatataaagtctttctcagctaacaattctgccaaaacaatatgttcagaacatctattcttttttcttttgcttcatttatattgctcaaataccactagtgacctagatgctagaaaggaaagctatgctatgtccttcaatatataatgagggattacaaaatgtaattcactgaaacagaagattataatatctaatacatatgcatttttcttcaaatggatttatgaacactttctccaggacactcctcaaaagacatcatatttccttaatttctttattggtgccggatatcttccacaagtctttttattttttcttctttaagcttaatactttcagacacaaggaaggttaaagttcaaaaaagggacattaattgttttcatggtccacaggtcttactttatatatagcacagttttattgtgaatattctatgcagaattggttaaataaaaatagttattttcatggttttaaaacaaatctaaaaatgcacaattcctttcatgtagacacatttagctctctgatgaaattcctaaaatatgtgaaagtgagatagcatataacctcatcagttcactttcactgctgtgtttacgtcttaataaatgaccaccatccatgaactaatatttccattactttaacacagacaacttcaaattcatcaagatcttatgccttatcaatagaaaacagatgtcctaaaatacaccaataaaattgtttcttttaggcgttctacttaaaactccaactaaatttaatgtgcaataattagaacaataataagttttatgaaattctctgattgtctatatgattaacagaagtataaatcattatcaatagtaaactatatctttaaaggtaagatttattttggtcacctttctgtcagcagtgcctagtacaatgcttcattcacagctgatgtttaatatatttgcttaatgagcagactttaattaaaataaattatgttctctcatcaaagtaaaaccttatcagttcccaaattgaattttaacccctaaactaaaatatttagaccttctgcattgtatggcctcatagatatatcaccaacagcactgtctataaaattatggattcttcaaagtctctcctgtacagcaatgtgaatattatatgtcaatatattatattgacatataatattatatattatattatgtattatattttatatatattatatatattatattatatattatatatattgacatatatattatatatatgacatatatattatatataatattgacatatattatatatatgtcaatatattatattgacatataatattatgtgggattatatataaaagaagttatatatggtacatgtaaatttaaagtatctacatatgattgtctttgttctatttcacagtcagaaacaagactccccaaaattgacaaaataaataaaataagcaatgcgaaatttttaatttaaaaggattataggtaaatgacctactttttagctatttaggatgactgaatagaacttgaaatattcaccatctttacagtttttattggcacattttattggttactatagacacgtaaccatcaaaatgaatataaaaagaaggcttttaagagggtctgtaaaacatacatcaatgataaaaaaggaaaggcatctctgtttctcctaatccataagactactcagagtgactgtgaatcactcagaccaatgtccttagtcccttcagagaaatctaaggcatttaaattattgagtcatgcctcaattacatggtcagtgactcaaaaacatgtttcttattacataaaataaatctttaaaaaaatgagtcaggaaaatggcaagagggaaatgtaacatggaaaagaaaagaagccaagattcctaaaattaaaatttaagaaaaggcatacaagaaagcaagagataaattttcgaaattacttaggaattgtatgtcttaactcattcaataaacattattaaaatctacctctctgctgagacctgtttggtaataaattctgctaggtaacaaagatatacagaactcaatacagcaaacatgcattatctgggcaaagagatatttaatgcaagcaagtaaattaaaatgtcattcgatattaagctaatctaaaatagcacagagaatgagttcccgatcatcctttaagacccagctcaaatgctttctttatgaatccctcctttttctgtgcacatcttttttgtgcaataatcacatattgcttgcattataagtgttttatatcatattacattactggtcaacaaactatgagctgtgagcagagattatattctctgctaagatgatattctctaactaagacagattgatttaggatggcatcagagatttattaggtggctgctcccctatcattttctgcttgtgccacttttgttccccggcaatcaccctaccttttattttcatgctttaaggtcttctaggactgacagagaaagcagtaagataaccaggggaactacaatagccaccaaagcaagccctgggcaaattggcatggctcaaatcccttgcattttcttttttctaccattaaatatgcctctctgctctctccaaacctgaacctacttgggcctgttcaaattattctgtcccatgtggcagaccttgcttatctacaaactaaagtgtctttgggtcccattttctcaagaatctgttttataaaagttccaatctttaaaccaaaaattatagtgcctatttcaatagggaagaataaattacccttatgagctatcacacattcatttttaagggagctttttataaaagctttctatccataaagcaaactctacatatatgaatcaaaaccactgaacagggagcattctttgctggcaaataggtgagaggattaatttacttatgatataataataacatatgaaataataatatatcattacttaacaataataaaacgtaccacctttggctacacacaatcagacactctaggcaccttatttacattacttcattctattcacacaataatctttgtgagaatagggtatgtggatgttcttgtctctatgatacatatgtatatattatgacaaagagaaggtaaatactttttccaggattactcagctggtacaagaaagatcaagatttgatcttggatccaccagaccccgaaataaaatctctttttcaaaaatttccctaaaaatgttgctgtggcagattctgttggtcatatattaaaaatagttctttttgtctacatttcctagcttcctttgcagtaaggtgtgaacatgtgcctgagtactaggccaatgaaatagtaaaagaagtcatttgttccacttctaggccagatgcaaaaatgcctcccatttcccctctgccagttggagactgttaagtaaggcaaccttgaaagtcaaatgctaaatatggcaaaatttctattagtctgagttgttgaatgactatgtggtatagaatccacttgcataccctttacctctaatgccactggatctgccttaaactagtgaatgattaaaatattattttctattgtgcttgagtccttatacatttttaaattctatttgttacagcatctagcccaccctaactaaaatggtctcatgtacaaatgtagtctgaaaggacttccctgaggaaataaactctaggctaaattatactcatgactatgttttccaaagtttggataatttaaaataataaaagaaattcatttaatattttaaatgtggcatcaaaaatattaaatttacaatgagaaaattattttgagttaatattataatggtactgtcgctaatataatgttaatctattgcctaggaattattaaccattttgtcaacatgaaaattcaagtaaataaggcctcagatataataataaaactggaccaccatcttgaccatttatattttcctgttatcattctatcaatattcatttttaaaatgtgcattttagaaacataatttaatttatagaccattaatattcattttgaattagagatcagaaaagatgtttactaccccttcactacttatgttaaatattttcttccacgtgcttccatgtgcttatttcatgtgtttccataattttctctatacttaccttgtttagtgtctcattcaagcactagaaaatttataaaatgaagtattttgattgtgaaagccctgtaacatgaatgaagacatagagaaaactgaattgaaaaaatattcaaagcaactttaggaaatgacgctgcatttggaaatacagtttagtaacgtaataatcattgtcatagtcatattttgactttgggatacactgacctgaaggagaagaattggatcaaatctaagttaagatcaagtggccttaaacgtcaacttccagatccaagtagtgattatcaataagcataatatgaatacattagtaaaacataaaactttcacaggtttgctgccaaattttaaacaatatctaaaagtcactattcttaacaactgagtatccatactgaaatggcagtgtctgctatatatatgtgtatatacatattcttgagttatctaatgcagtatagagtaggattctttggtctcctccttaattgatatgttatctactaaaaagtcaaggtagaatcctcgcattattcttaattttttatcagattttgaataatacttcaaatggtgattatctttgtggaggagaggagagaaaggcaggtgaaagaatagggaggaacataaagctttatatattataataatattttacaattggctgtgagcttataagcattgattatattatcaaataaataaataaatataaaagaaaatagaggtgtgtcacgtaaaggatactgatactgaatcatgatgatgaattcacctgttgacctaatgtcctaaaataaaaaagaattaagcctatgctaaggaaagagcatacctttatgcttaccgctatgtgttagcatctttggcttgggagtattaatgacaggacagaatagcaaacagttacactcttttttttttttttttttttttttgagatggagtctcgctctgtcaccaatctggagtgcagtggcacaatctcacctcactgcaacctctgcctcccaggttcaagcaattctcctgcctcagcatcctgagtagctgggactacagacatgtgccaccacatccagctaatttttgtattttattagagacggggtttcaccatgttggccaggatggtctcgatctcttgacctcgtgatctgcctgcctcggcctcccaaagtgatgggattacaggtgtgagcgaccacgcccagccagctatacttttttacacagcatgaagatcaacccagtggataactactgaatcttttagagatactacgagagtcttatataggagtggtgattgtgtgttaattataactgatggttttatgtgctttaggatgtttttaatacttttaagatattctgccaaaaattctgatttttaagcgtgtgctcaaatagaaacagttgggaaactacttgtctggaaaacattgaaaagaatgaaatattttagcaatattctcctttaaaatgctttaatgaactccagaggagtccttataagatctgggacaaaggtatattttgctggagtctattagcacattccagcccaaaattcagaatgaatccagagatgatcctctacagttacttaagcttctcaaagctttttaaaagcctaacttaagaagccatatagttcagtgattctaatgctagattgtctgaattcaaacccaagtttagccactcactaactctctggccagagcaagataccaacattctctctggtttggtttcctcctctgaaaaagggggataatcaagatacctatgatatagaattactgtgagatttaagttaatataaagttcttagaatttaatgccccagatatagtaagaaccccgagatattagctattattacccttacagaaatttcatggcctacagagatctccaaaaaaggggtttcaattattttaatgtggcagatatttagatgggactggttcacaatacctacttaagccatagcagacccaaaccaattattctaatatgtattatattttttacttaatgacatgagtagtttttttgaattatttcttaaaagaagttctttaaacatctctaattgtgatttttactcctcaatccacagaggaagataaagtttaagaatttcttcaaagttttcatcataataacctcctacattttaaacaaataagaatgtgtctgtacataaaaacaaaaaataaaatcattctgatgtataatctgattgttttcaaagaacaataaatgtatattattccattttaatgactgtatattaatcaattggtattgtatatttatgtaaccatttaatcccatattttagatattttaaataatctttaccatacttcttctattgttaaaaaacatataaatgtcttatttttccagatgtcagaatattgtcctgtaatatagttataaaatatcagaatggccttttaaaatacatattgctaggcaggccatggtggttcatgcctgtaatctcagcactttgagagactgaggcgggaggatcacttgagcccaggagtttgagaccagcctgggcaacatggtgaaacccactctctacaaaaaatacaaaacagccaggcatggtggcacgctcctgcagtcccagctactcaagaggctgaggcgagagtatcagttgagccttagaggtcaaggctacagtgagccatgatcttgacactgcactcagcctgggtgacagagcaagcccctgtcaaaagacagaaaagaaagaaaaaaaggaaggaaggaaggaaggggggaaggggggaagggagggagggaggttgcaactttgtcttccaaatcaatgggattttacaaggttgcattcataccttgttattacactcctctctttcctatatcttaacaacatgatttttaaattctgccaagcttatggtcaaagattatagaaaagtgttaattctatgtggatatatttgactaaatatgaacatttctcacattttcaattgtttgttgtttttatattgtgttcatttttctatcagggcatctatttatcttagttcctggaaaggttgtaatctattaaggatattgatcaattgtcaaatgtatcaactaatgtttccagacttattttaatattgtttataatatctatagtgttgttttaaaatgggagaaactgataactctttacttgccaaaattaggaatatgaaacatcatacggccatttcaaaagtgtcatttttgagaaatgttacatgaaaaggaaaaatgtgaatagtgataatatctgaaaagaataatcaggaaataaactcatatatatataaattaatgatcactgaaatataacctgatacatatatatgtgtgtgtgtgtgtgtgtgtatatatatacacatatatatatacacacatatatatgtattataacctcaaagttggaaaagagaatgtatatttaaggcagtaaagctatatagtaaaatattcattatctctgggtaatggggttatgggtgtttgttttgttgtcttctctttattcttttctctggagcacatatatgtggtttttaaaatcaggaaaatgtattagtaaaaccaaactttattcagtgacagcttgaaccaaatatccaacataagaaaagctgatgtcacttaaagatttccacacttctctgaaaacataataaaattttatggctatacaagatcaatagttcatcctaacaaacacgctcatccaaaatgccaacatgatcattgtaatgttaattaaattttattgtcacaataagttaagaatggcaagactgcaggctgagatgttgacttaaagatggagctaaatgttttattgctagatttgcttatagacagagctaattacttaaattacatttacatgtttttgttactaaaacaattgtatttgtaaaagacagtgcatttaaaagaaggataattttacatgcctctacaatttgatcaagttatgacaataattcatgaaagcatttaatgaggaatctcatcttaaaaaaaaagtgattacaccaactcattgattcttattcaagatttttcaaggcttaaaagaccaaagcagatagcatattaatttattagtgtaaaaatatgttttctgaaaacaacttctatttcaagatatgtctgaaaatatattgttcattctatttattttattattattatttttgatacggagtctcgctctgttgcccaggttggagtgcagtggcgtgatcttggctgactgcaacctctgcctcctgggttcaagcgattctcttacctcagcctcccaattagctggactaaagatgcccaccaccacgcctgactaatttttgtatttttagtagagacagggtttcaccatgttggccagactgatctcaaacttctgacctcaaatgatctgcccaccttggcctcagaaagtgctgggattataggtgcgagccactgcacctggcccatattgttcattctaaacattctatattaagatctatattatttaccaatcctacctatagaaagaaatgatatgaggcaaatattttcagacatatcttgaaattaaaatggtttaattattattgttctacagtccaactgatacaaaagtattaaggggttatttactttaacatttgtttatgatgaaatgtgattctgcacaatggtgatcactcagattttgtcaatctattcaccttcaatctaagggctgctattaataagtcatgcctcccctgatatatattttatatatacatatatatatatatatatatatatatatatatatatatattgggcgtggtgtcttatgcctgtaatcccagcactttgggaggtcgaggtgggtggatcacctgaggtcaggagttcgagtccaccctggccaacattgtgaaaccccgtctctactaaaaatacaaaaaaaaaaaaaaaattagcctgctggcatggtggcatgtgcctgtagtcccagctgctcaggaggctgaggcaggagaattacttcaatccaggaggtggaggttgcagtgagccgagatcgtgccactgcactccagcctggtgacagagcaagattctgtctcaaaaacaaaaacaaaaacaaacaaacaaaaaacgagcacagtatagtatatgaacatcatgacaaaagttcagagtgctttgagagtctatgggggcggagaaaaactttaatgaaatcaaatgatatgttaggcaggctgaaaggactgtgaaccaggaaggggaagtgccatgagaaaacctggaaaaagcgaagctagaagttatagtgaaggaaaagtggcaagatgtgtggttagaaagatgacaaaaccctcagtctgtgccagagtttggactttataccaaggacaataggaaacctttgaaagattgtaagtagagaagggacatgattacttttgcatttcaaaacactcttgctggagtggggaagaggatttggaagggaacaggccaagaggctactgcagttatgctgtggcctaatggggaggtggtgaagcacctagggcctagctgacctggggagacatttagtaagaatcaataggacttagtgaataactgaccatgacagtgaaagacaggaggtgtcaagattgacagactgccaggcttggagccccatatctttatttttatagaatacaaataacttcaaatcagtgatcactaaaatttaacctgatacctaaaagagttctcttgataaaatcttatatagttcccttttagtcagcaaagacaaatagtttagatagatcatcaaaattttacattgaatagatttttcttattatgtattttagtatacattaacaaaactatgggatttggtctctgaaactgaagctattgaggagagcaatattgagcaaagagaaatgaaattttataaatccactttttctgattatctgtgtaagaacaagatattttcaactgaccattatttgaacaataatttacccactctgtctctgaactttaataaaaagatataactcttgaaagataaactggctacttgggtctggggcaacaattttttgttaaaactcttagcaaactcttctcaaaattaattaatatttgcatgtatatagtacaacctaaaagagcacctctcatattagtagctcaataaatgctagctgaatctgaagtaaattgctagagaatgctatgttttggttcataacgatacagcacttaatgccaattttaagttaggtataaaagagtgttcatacggtaagcattagccttaaaaattaatcatggactttattatttacccaatgtctgtgtattcatttctgctttcactagtcagaacacatggatccagcattagacatggatcccagtcacagttttaccattaggccattattagctctgcagtcttgaacgagacttaactagcaatgtagtcagaatttcttcatttgtaaaataccatgacttccttacagagttattgtgaagatcaagtaagataatatatatgaaaagataaaacccaatataaatagaagattagcttacttcatgactggcctctaaataaatgttttgattagatatgccttctctacaaaagctggtttgaaagctcatattgatttgaaatacaagtgctttgaaaaagtttttatatttgttaatatatttacactactaaaacagatctgcacaatatgtggtataacagtttttgcaagtgtaccaagaaatgactgaacatacaccaaaataaataaatgaaataagcttagcttatgaagtatttataataataaatgttctcatttcagagaagaaattaaccattatgtttattaaacatgatgataaaattataatcttatttttgtacatggattgcgttattatataattttttttattctccttggcaatctattactgtggtttagagtatagagtaaggctctcagtaaaactaaaaggccacaaacataattattgaaaactcgggatgccattacatacctatcagaatgggtaaaataaaacaacagtgacaccaaatactgacagggatgtagagtgactggaacaaacatatattactactgggaatataaaatagcatggctactctggaaaatagtttgaggtttctcatatttttatatacaatctattaattgtattctcggccatttattcctcagttatgaaaacttacatttacacaaaaccctttgtactaaagttcacagcaactttatttgtaatagtcagaaactgaaatcagccccaatattctttaacaggtgaatggtttaataaacagtggtgcatacacacttcagaaaactcagcataaaaaaggaatgtgttgttacacatataacctggaatgaaactccagaggctttatgctgagtgaaaaaaagtcaatctcaaagattccatactttattatctatttatataaaatgttttatatgataaaatttcagaaatggaggacagattagtgattgccacaggttagggattgggcgggctttggaggaatgtggatgtggttataaaaggtgaataaatcgatcctttcagtatcctgacggtggtggtgaacacaagagcctacccaggtgataaaaccatgtagaacttatacacacacgagttcaaagaaaacttgagaaacctgaataagaccagtagatggtgtcaatgtcaactttttgattataatattatactatagttttgtaaaatgtgactactgtgttaactgagcaaaatgtacaagggcttctgtgtattatttattacaactgcatgtgaatctgcaattatctcttaaaatgttcaattaaaagtcagtaatttgcataagtggtattaaaaaaacaactgcatgtgtataaatacaggggtttgtaaattaataaactctaaagccttatttttgttttattttgtacaaaaagaaataaaaacatttttatatagttttatcaataaatatcataccaaaaataattaatgaaacacagctcattagtttttcttcatgatatattttgtttcattcaacttttacgtgataccagcatatgtactttgttataattgtttcccatatgcaaataaatgtcagggttggaagacctgttgtttattcagttcagaaataagactaattatatctactaattagtcatttattggctttgtaaaacaattattttataaacagttataattaaattatctcaagaaattcaaatttcaaaacagaacattggtgaacttggtttttattactgtagttagtaaaacagatcaaatagattttgcgaaggccttagaaagttcaaaaaaaattgttaaatgtacttcttttctcctaggtttcatttctctggctgcaaaaagtaaatattttaatgaaagtgtcctgcttggatcctcggaaattttgggagatttctcgatttaaaagcaaatgcagctactacgaaaagcagtataaggttcttcaaacaattaaaaatagaactacataccagcagtctcactgctgcatatcaatccaaaagaattataatcagaatctcagagagatatttgtactcccatattcattgtagcactatttacaatatccaagatatgaaaacaacctaaatatacgttgccaagtaaaatgtgtcatatacataaactggaatattattcaaccttaaaaaagaagtaaatcctgcaatatgtgacaagaatgaacattgaggacattataccaagttaaataagccagtcatagaaaaacaaatactgcgtgggacaatttatatgagatactaaagtaatgaaattcatagaagcacagagtagaatggtgactgccagggactaggggcttggggaaatgggaagttgctaatcgacaggtacaaagtttcatttatggaagatgaataaattctaaagttaataataatgtattatgcacttaaaaacctcttgaggatacatctcatgttgtgttcttactacaataaaataaaataaaccaaattttaacttgagttctctctcacatcttctttaggcaggcctgctagccataacttctctgatacttgctcctgacatcttcctgaagtttaagaaggcaggtaaaggcattgtagactgaacgtttcagatggcttcaaactacttaataagagccatcatttttaagtaaccccctaaataacaggttttagagtctgattagttgagatgcaaagtttattcacacgagccatgagggaagagagaaaagcagaatcctaaagtggaagtgaaaactataatacaccctcagttccagcagaagctcaaagatagtaaatcttgccacaagtcaatggccaagtcaagactagaattactttctcaagtcatcctttttcctcctctttcttcaatactcaataaactacttatttttcaaaacttagatcaaattctgttaatcccacctggaccccaggcagaagtaatcactcttcccgttgttcccacagtgtccctcattattgattcactcatttatccatctgttctttgattcaacaaatatttttgagcaatgactatgtgcccaacacctagtgccaagaaaaaaacctctgtccttatgacactggtagtagtaaaagggaaaacagataataagtttttaaaaagtaaaatacagaacatgtgagttatggcatgttagaggatgacaagtaaaagaaaatcagcagggcaaacagctggaaagtgtgcatttgttgtagggggatttttttaacttttattttaggttcaggggtacatgtgaaggtttgttacataagtcaactcgtgtcacagaggtttgcagtacagattatttcagcacccaggtgttaagcccagtacctaatagttatcttttctactcctctccctcctcccactctccactctcaagtagtccccagtatctcttgttccccttctttgtgctcacgagttctcatcatttagctcccacttataagtgaaaacatgtggtatttggctttctgttcctacattagtttgctaagtataatagcctccagctccatccatgtccccacaaaatacatgatctcattcttttttatggctgcataatattccttggtatatatgtaccacattttctttatccagtctatcattaattggcatttaggttgattccatgtctttgcaaagtatgcatctgacaaaggttaaatatccagcatccgtaaggaacttaaatttacaagggaaaaacaaatccattaaaaattgggcaaaggacatgaacagacacttttcaaaagaagacatacatgcggccaacaagcatatgaaaaaaaatttgatatcacttattatcagagaaatgcaaatcaaaccacaatgagataccatctcacaccagtcagaatggctgttattaaaaagtaaaaataacagaggccggtgaggttgcagagaaaagggaacacttatataccgttagcaggtgtgtaaactagttcaactatgtggaaagcagtacagtgattcctcagagaactaaaggcagaactaccattggactcagcaatcccattactgggtatatactcagaggaatttaaatcattctaccataaagacacatgcacacgaatgttcatggcagctttgtgcatttggagatgaatacagttctaaataggacagcctggaaaggcctcagtagaaagaataacacttcataaaagatctgaaagaggtgaggatatattttcacaattaatcatgcacatctgtttcccttagatcttcaaagttacgaacatacttcaattatttttgtatgctggctcctagggagcagccacacttagtaagtacataatgttggatgaaatatctcaggtttctgaacttaaatttcagttgtctttcaactacacaaggctttgtacttcagaaaattgatgaatttgaatacaacactgatgtaaatcaacagcacaactagaacttctacactctcgctgctcaacaacttaatttaataggggtatgattttctaaatgttgtagcccaacacatgcaggaaacatgaagaaaactgaatcctaagaatatcgagggacaagcccaaaaccatacacagtgtgaactaataaacctcctaaacctacatttcacaacatgaaaaataatgaagtgctaagtaatacatttgatcaatttttgtctctatttctgattttattcccatagtatggccaattttatattcagcactactaccatcaccaataggagcctgagaagtttcatgcacgttgtacctgtgtacctgtgactataggctaagtttaagacatgtgtgcctccaaatacctgccagcagtgataccttatgtcctagtacatcgaaatacaaagaagaactccttgagagtctaaaggagactacaaaaatcggttcactttggacagataatatgaccacagatctagaactagtatgaccactcagtctgggatgatgaaatggccaatttcttggtataaaatgagaacagcacacatggctgaaagccatattagaggcaaaattactactacttatgtgctgttacaaattgcagataaaagatgattacacatattatagttatctagttttcattataaggactaaatgatttaagattacagaaaagccagactgaatgaagagtaaaggacgggtacattaatgaaacattcgcctttgttgctcactgttaaaaacctctcagagactcatcgttgactgggaactgactctggttgtcatttgggataatgtatttgtgagtcaatagattaatggttcaaaaataccaatacttgcattatgagtccttcagtgattctccattaccatcaagaaaaagcccaaaccccttagtacaagatacaaatgtcttcatgaggtgactctcctcttcctctccacacattccacacccttccattcttaggtctctgaacatgccatgctttcaacacctacttcagtctctttgcacatactcttctctctgcacaaatcctttctccctcacctcccaacagggtgaattcccttaaaatagcttaagtgttatcttcatttggaagcctttcccgaaccccactgcccatattccctatgttaggtatctcttccccttctaaatatgactgttaagcttatcacacaatattaaaagattatatacataacatatattatatataaatatacattatctatatgatataacacatataaatacatatatgtatgtatgttgccttcactggatcaaaacttctgagcaagttttattcatgctttaataagcaatactatagaattgaatacctgaaagtaaaaataaaatagtggtaactaatatttattgagtgcttaataactgtcagacacccttctgaggctttaattcatttattgtcataacaatctaatcaatacataactaacattattcctattttacagataaagaaactgaggcggggtacgtttagtaaaccgtctaaggttacaaagctagtaaatgacaaagccagggtttgatcccaagcactctgacttcaaaatgcatgttcttcaccactgtactacagctacttcatatgtatatatatgtatttaagtgtttttaagtaaataagtaggcatatatataaaattcaagagtatgtgtaatatatatatgtatatatgcatttacttgggtatatacatgaaaaacattggcttttaagaatgaactctaaacagcagtacaaagttacttcaatgaattagaagttttgacaaaagaccatctgctgtcctagaaattgtcttcttttccactgacatattatactattctagttaataatttataaaacataatatcaatgcacatagactttaaatgcattaagtagatatgctttgtattgagaatatgcacttattatgtactactaggtagcttagtaaaaatttgaaaatttaggtataaggtaatcattacaagattagttctgcaaagtactttcgcatgtatagacaattactgaataagtgttttattcaggagaataaaaatctatatttataaatatattaaaatatttgtttctcagtaacattttatttttatttatttttatttatttatttttaagttctgaggtacatgtgcaagatgtgcaggtttgttacataggtaaatgtgtgccatggtggtttgctgcacctatcaaaccatcacctaggtattaagcccagcatgcattagctcttttctctaatgctctcccctatccccaccctcccccaataggtcccagtgtgtgttgttcccctccctgtgtccatgtgttctcattgttcagctcccacttataagcgagaacatgcggtgtttggttttctgttcctacgttaagtttcctgaggataatggctattattttatactccaaaattttaaattcaacatttgtaatacaatgggttcccaaacattgccatatactggaatcacctgaggatcttttaaaaatcctgattcctgaggccaggcatggggccacatgcctgtagtcgcagctacttgggaggctgagtcaggagtatcccttgagcccaggagttcaaagctgtagtgaactatgatcgcacctgtgaatagccactgcactctagcctggacgatacagtgagacttcatctcttacaaaaaagaaaatactgatgctgacaccaccaccgccctcttaaccagacattctgatttaattaatgatgggctgagtcatgaatattaggattttttcaaagcttcccagatgattccagtatgcagcacagattgggaaccagaattttactaaactttccctaaattcactctgaagtttacaggaatttcttctattatgacatttaaaagcaatcctgacaaaaacattatttcaagtgatcagcagcagcaatgccagaaatccacatgtagtttctcatatcagctatatcacctggctactacattcttcaaatagaattcctttcctcttggctaattctctttacagataatacaaatcatttctttactaaatcatttattcaagaacacagacaaattcacaacctaatcaccaaacttaattaggcagaattttacttcattttaattaagtatccattttcatgtgcttgaaacagaaatgaatatagcttggacagggaacaggttatttataaaaagggagatttaaatgagggtaaaaatacatggaaagacacaccttgcacacccttctctacctacttgtccattttaatccctgtttataatcttaggtatcggctcaatttaaaagcagtaaataagtaatactaatgtttatgctgatgtggagatatggagatgtggagattttatatgagaagtcttcaatgttttaaagtccttgagatttgtgggttattttttattgcagtgtaatctacccaatctttaaattctatatgtaagtatgattgtatatgtaaatataatatctatttcagaaaaaatacatcacatgtgtaagtgaattttttagattaagaattggcatgtcctactttattcaaagtgcatgttctttacaatgtttgtaaaactatatgcaaggtaaaacagtgatgtctggtctatctataatgcatgatgatcaaagagttttgtttatcacatactcatgctgagaattcattaagcactttcactattaaatttgcagaatgagttgttgtctccactttactgacaccatgagtcacattcatcagtctccaacaggatgataaaagactgaatgattcaatgaaaatgttgatcattatggttcagttataacaaatgtgtgactaaatctgtactctcataatacatcacatcaaacagaaattttagggtggaatggttcttcaggctaaatagtgaagcactttgaaatctaaattcgtgtattctagttattaacataaactctgaaataaatccaggcttcatcttcagaaaacaataaatctaaaaaataaactcaaagattgttagatattaaagaaactgcctggattaaaaaaaatagaaataacagtgtttctctttaatcatctgtattttgaagtattttaaagatagaagtgacacattttatacagctatacaatgtaatcaccaaaagactatattgggatgactttttattaagaaatgtatgatacctgttactgtcatttatggtgacaactctgtaatgtatttattgctatgtttatttgtgttagtgtgagttagagagtaaagaacaatagtaaacatattctagtgcacaaaataatataagtgaaatttcattacgtacaaatcatcacaaataagttgttttatttttgtaaagaaactatcattctgaagacaaatttaagctaaaatatatggaacatatgtatgtataaatatggatttcttttcaggaaatcatacgttttagtgtctcatttaagttttctgtgtagtttggaaaatcctgaacggcattaaatatttgtttttaaattatgcataaggtttatctacagcatgaaatgcatgtgtgttctcactgaataatattctcctctcattttctcatctaagtctaagactaacttaaggcaacaattttgtgaatgtttttcaaataataaaacagtggtatatattcgcttaaaaacaaaaacatgaaatataaatatgtattataaatagttatattacttcccccttcatacttgtttcatttaagattatttaaaatgctggtgaattaaactgcttttgtattgactattcaccatgtaagactctaacatgtacacaaacacacacatctatttttatgtacacatattcagatagtttctcaaagattatttactgttaatttgtagcctcaaaataatgaactacagctacactttttgatatatgactttttaaaaactaggtaagcaaaaggtttacaattctatttacacaatttatatttagataaattaaaacatttcagtcttaaaggtataatgttaaaaaattaattttaagtaaaatggcttaaactatttcattgtagtaaaataaacacagctcaagttgaagtaatacaatgtctaaataactagaaaacaaacaaaaatatcattatttatattttaaaaataaattaattgatcagatatggagaattctgcacttatacctactctgttggtttcaaagttacatttttcagtgccataaccacgaaacaggctacaagcagtccttaaatgcctcttatcaacttcagctacatcatcttaataacttttttctacccagagacctcctataagttttagaaattcccattatatttgtaaaacctaacctaaagttagaaaaaatattttaacatataaggagactacatcaaaataatcaatacacgtagataaatatttatggtgatatctattctgatgaacaaacactgctaccaggaaggggatgtgacagcttttctccctccctagaatatgcgtctacctcttctccctcagcttgccaatgccaatttttaaaatcctctgattttggatcatagaggaatagaaaagttacttgattggtgaggatctcgtgttggagctctcagaactaaacacttgtttaaagtgattcttctcccctaggtagttttgtgatctctgtggggaagtcaacagtctctctctcccttgcacctttggttgagatatttcttcctgaagttcccctgacaagggtgaatgcagcagtcttacttagtccctaattatagtatctgctatactatactatactatgctatactatattataaagtcacttagaccctccagaccatcctcttagacaggacccaagataacaccatgccagttccttcctgtagcccacatctggtctatgggaaagacttcttcttcttcttagatcaactctgggagttcaacacagtttttctccaaaataaaggcaattagttagcttctttctcacatatcagtccaccatatcctgcaaaccctctctttaattttcttaaagacatactcatggaaagaatcatgcccacacccattcccttcttgagggtgtgagaatagaaatcaaagcttacaagaatctcacttcataaatcttaaatctccccctccattttggtaaagtatttaccaactttggtaaactattttgttctctctgtgatatggtttggatctgtgtccccaccaaatctcatgttgaaaggtaatttcctgtgttggaggtggggcctgatggcaggtgtttggataaggacggtgtttccctcatgaatggcttaatgccctccctttggtaatgagtgagttctctcaagatcctaaagtatgtggtacctccccacgactccttctcttttgctcctgctctggccatatgacgtgcctattcctgcttcaccctccgccatgagtaaaagctccctgaggcctctccagaagctgagcagatgccagtgctatgcttatacagcctgcagaactgtgaaccaattaaacctcttttctttataaatttcccagtctcaggtattccttcacagtaactcaagaacagcctaacaccaacatatcttggtttgttatttcaagtcaagcatgatagccttgtaccttggaatgaatttcctgttgtctttagatctcagctgagacttccattctaaattactcaattatatataaaatttgaagtgaggacactcttgtctcacaaagtagattaaatgcatttgtgtacaatgttagcatatttaaaaacaaattataacatattcattcactaattacccaagtttgctaatctacatcagcctgatgaacagaataattccctctgtattggtttgtgatatgtagagtattttttttctttttgttttttttgtttgtttgtttttttgagacagagtctcgttctgtcacccagactggagtgcagtggtgcgatctcggctcactgcaacctctgcctcctaggatcacgcaattctcctgcctcagcctcctgagtagctgggattacaggcacacaccaccatgcgtggctaatttttttttttttttttttttttttgtatttttcgtagagacggggtttcactatgttggccagactggtctcgaactcctgacctcgtgatccgcccgactcggcctcccaaagtgctgggattacaggcacgagccaccccgcccagcctatgtagagtatttttacagtgctttactgtaggcaaagtccttgtacttctactctcttatttacttgtgagtgatttcaaatcagtgaaaaagctaaatagccacatatacacctggctatatcattaaaataacacagaatgttaaaatttctcctctgttatatttcatttatttaattggataagccatttttaaccaagtttaatttaattatggtgatcataattaatagtgattggaagaatacaactgtaaaacagttctatggtttgtataccttatttgtcttatatgtgttaatagaaaacatctcagtaatttcaaaactagtaatacgatatgggaacagtatgttatagcagaaagggccctgggcttgaaatcattattcagttcatgtttgtattcctacttctcttataatttggactatttaataggtattatcaaaattattttaaaaagtatttatttttatatgacatgtacacacacatgtgcattataaaaagccacacaatacttcaattatcttccactgatgatatattatctatagtgattgttacagaaaaataaatcttcaaaatgataaaacaagagtacagcctactcaagtcatagctatagaaatcaggtatatttacttaatcttcagattctcagttttattcatctgtgaaatagtgataaaatgctggtttacaactttccagagttattgggatctcatgagttgacagtaaattgccccattaagtggtacatatataaagtggttatactgaactcttaaacatgcacacatgcacacaaacaaaaatattcaaaaacaactttgcatatctcatgggaattcatctctgaaaatacctgactgctattaaaaatcttttaaatttcaatagttacatgccttaccactaaatagcaccacttagagtactttatatagaggaatgttttgtaaaacttctcaattggcagattcattgctctattagtgaaaggctacaaaatttatgttttcattctatattcttttaactaaggacttttaaaaatcaaaatgatttaatatttgcaatttagcagcctgaatgcctttagtcggaagaggtgtcttgcgtaccagaagttcatctacaatttgaaaggtgatctttctctaagaattctgaaatgctgtaataactttatatggctctgaactgtttcattctaaaatctcagggcttttctaatgtgacaggcttaacgaaattccaaggctccaatcttagtattttaagctaaattgataaattggacccttaactttaaaatttctaatcctaataaaaatatgaggtttagcaattccttcctggtcctgcaatatgcagaaattataaatgagtacagactttctttatttcctagctttctttctgtttcatatgaatctaaactagaaagcatattgaatcgatttaaactggaacccacagaaagaagctggctaaagacatggaggctaactcacagtctgtgaccagactggtttgtctaatgatgtagttgttgtcacaataaatggctacacgcacagatttctgtctggttagacatttggcttgaaataaacattcagagaattgaatccagacatcgactttaaggccaaaagttgccttaaactctgccaacctgatgctaattcaactaggagtaacatgcttttttgtttgtaacaaatgagtccttgaatctattaaactgaaactgatgatgatttcagaaacatgtttgatgaggtcataatctcattgcagtaggtctggaacctaattttcttgtcaaacgtcacttacgtactttggtatcctagaagtgaaaggaatgatccaagaactgggaaaggaaatactttgggtctgtaatttgatttataaaaaaggcctgtttaaccacttactttgtgaatgcctgttttacaagtttagagattattccttgtctgaaattagctctactccaccatcctaaagccttaagaaaagcagatactattagattagatacttagaaaagaaaatactattaatgaaaaatagtagtgtaactaaaaataatttaaatagggctctgtttgtgtgtgtcacttattttggcatgctgtatacctgtatttgcagatcttttattcaatacagttaaaggaaatagcatttagaaatcattggaaaatattagtaaataaagaacgtgacacataaagttctttggatggaagaaaaatatgctaaacaagagacttttccaaattacttgaagactaaaaggacatatatgtataaccaagaataaatgtatttatttagaagacattgatatactataatattttatgacaaaataaagagaaaatactgagttaaatatgaaaatgagtgtctagttaaatatcaccacaatattttcttaactgagtttctaatgctatttataattctcctctttaaaataatttacaaagtgctagttttctgtgttgatatccaaatgtggaatgactttttatttggaacatccaacgaatagaaagttttatttttccattcaaattatgatatcattcatgggtccagggcaagctacaaaatttgtggaactgagtgcaaaataaaaacatgaagccccttatttcttgaactaagaatttcaagacagcagcaacaaagcacgaatctcttcttaacacaggggcctgtgtaattacatacccacaaagctagccatgaatgggaccatcaacaaaactttctattgactcgcatttgtattgctagtgtgattgaagagacatgagaggtagttactaaagcatctttctgtacaaactaaatcaacggaaagttaccctccaaatgagtccacccatacctatttatctgccatatccaaatgaacaagctgttgaaaacatggcagcaagggcaaaaagtagaggaattaagatacacatcaagccctgcagcttcctgcctttgatagaaatgtacaatagtgtactgtttgcaacatcctttcattcctctgctagagagttctggctcacacccactggagccttgtgaaaagatgcaacccgtacttaggaaaggggtcagacatgtttgttcattttcaatatcttttctttttatattaaaaaaatagaataaagatctataaacctgaattaaaactcttgagtttcaaactgcctcgttcttaaatcttcaacctcacataatatattcgtataaaatacaaataaagcccttaagaccatgacaagattaatttaactcatatatattaatttcatgaaacaccaagttcaacccttacatcattattagcactgcagtacattactgacatatatatgtagtctggggtcacttcagaaattggcaaaggaaattactcccttaatgcagtctacaggcacacctcagtaacaatgacacctttatctttcacttattggcaagttttattcagtgtttcaaagcttgactaatccacaagataacatcagcatatttaaatccttaatctgatcaaatccaactttatttggtaaataaggatgattttcacttcctttcatccaaactctcatgataagggctttgataagatagtatcataaattactttcctacagggaatatgtttctaagaaaaagtatactacctaaaggagagggaaaatggatttatactttaaaagaaattttgaaaaattagcgttcaagatagaaagatcaagagatgggttttatcttcctaagttttgaactacatactatcagtccaatttgaaagctcattttagttttacctcgtacatcatcagttaaagcaaatggtagataaatatttattttgtaatttattttatacttcttagtcataagtatttgtggcagatgaagcaatatctatcagtttcttaaaagaaaaacaagtcaagattgtccacttcttcacttatactgtcttaaattaacaagaactaaatagtgatcagaaagagaaaaagtaactacacattgagtattcctaatccaaaaatctaaaatctgaaatgttacaacatccaaatttttttgagcgctgacattacactaataacaaatgcccattaaagcatttcagtctttggactttcagattaggtatggcaaaccactaaaattgtctactgactcatttttaccaaaaaatcccaaatctaaaacacatcttgtcccaagcattttggataagggatattcaacctgtaatgtcagtctgaagcataacaattagcttatgcagccaaggctaagctatattagaatcgtaatagttctcaatgaaaactatgagctcctcagtatctttgaaacctgataaactactttatcaattagtacctatgtactataacagatccttcataagaaataatttgctttaatgacacagaaataagttacactttaaatcagtattccttttcagctaactattaatatttgtattctctcaatattcatatactgaagctctaactcccatgggatagtattaagagatggggccttttagaaataattaggtttagatgcagtcataagggtgaagctctcatgatgaaattaatgcctttataaaaagagaaagaggcaccagagcttccctgtaaggatacaacaaaaaggcagccatcagcaagtcaggaagaaggcccttacaaataactgaatctattaacatcttggtcttggactttccagtcttctgaactgtgagaaataactgtattgttagccattcggtctatggtattttgatacagcagcctgagcagaccaagacagtactccagagaaaatttagaaagtatgctgacaaattcccaccatattaatactaagtaaaaatatcaatggtatatgaagaaatacttattaatattgtaaaatccagttcttggtaatttccagtctaattcacttagttaataacattttctagtgttttccatattcagcaagtacaatataatgcctaaatatatcctttagagtagtttaaggagtattgcttagagtaatccaaaattgtgtgttctccacctgctaagagtctaaattttcacactagttttattgtaattttcaatcaatagagtctgccttgctaaaataaaataaaataaaataaacatatatatatatatgtatatttgaagtccataaaataaaatgctttagttcccttgaatcataagaaccattataaaaacaaaaaaaattaaggaaagaaattaaatacactttttgaaaatgctaatttactaacttgagaaatgcttcttaacaaaagtaattgtgcctccctagattgtcaattaaataactataattagaaaaattttcctctttaaaaggcataaatgatttaccacaaaatcttcataataacaaattttaaacactagattttaatgtaaggcaagatgtatctggaaaataggtgtttctgaagtgttttaaccattcattagatcccattgacatggtcctacagagttcattttactataattaagtttattaaatactgaatttcaatgcaaacatgaaagcttcaaagaagcagagcatttaagctttccttaaaatgtattttcatacgtgtgaaaagagccataccctatactctgcctgtactttattcatattcgcacagtatttgctaacttcttactatgtatacagtactcttccttcattttttttttttaacatttcagttaagggcacattcaaaattcactctgtttctacccccaaattgctatagaaaaactgttgaactgaacgttcaaaattagtgtttttcagaccagacagataatgtggttttcaagtcaatctacgaatgacactacatgctgtaacatgtaatcactagatttggaagtgggaggcaaagagttgcctgcatttgaaagtagtgaagacaaacatattaaataggaaaatttgcagacatccattaaattgtgtatgtatgtgggttccaatagactgacattttcagaatcatactaaacatggaaataagccaaaacaaaagagagggatttgactttgaatgattcttcatcctaaattagacatactacctgtgttaagatactatgtatgtgtgtgtttgtatacatatacatataaatgtatatgcatatatttgcctttaatgcatattataatatgccctgttttcaagagttcaatgtcattaatgtagtaatttaattgattcacttattatttttacaatatttcatttaataatcattttgaggacctactgttgtgaggaatgaaatgtatttcattggcttttatatattttatgtttaagacatctgaatatattaggcaatcaatccatacatagaactgaattaacgtcctattcaatagttaatagtatccaaaatattttttatgtctgagattctttaaaccttcttgcattgaaacactgctatcagctctggtagatgatattttctactttaaaatataatctctacttgtttacactattttcctcaatgtatttcttaaatatcttgtgctatactaaaatgaattcattctaagtgcaaagttataaaaactatgttactgcatacattatgaaaactgaaacatctgctaagctttcataaaaggtgctgagaatatgacacattcatgcctttctttaatacataaatagatcattgtgatatgtattttcattttatagcattcattcctaaatccaaatttcagcaatgttatatacaatattcaccaaaagtacagccaattatgtcttcttatacattaatatatttctgaaaactgttccaagaagtaaattcaagactgcacgatttattttccatttaggagactaatgttaggcatataagaaatgatatgctatagccagcccacagttatgctcaggaatggccccgccatacaaataaaattgaaatcttaggtcacatacatttaaaaatgtttttctgtaggtcagattcatttatttgaattattttgaaaccataatgtctgccttatttggtcagttattatacttacctcttcaaagtcatgcatgtattttaattatgaaagaatgggatctgcccaagttttccaaatcaaaaaatcaaaagtttgaatcataagcacacaggcttttgtcttttcagaaaaggtttttgcttgttcgttgtaaccatatcctcttatagaagtttctttctgcatctgactcaaaggaacactctcactattctgaggtcctgctctagccttcctaataaaccatcctcaggcgttataaagaattttgcaaggtaacattcagacatccttcatgacatgcatcaaacttatcatttcttgctcaatggctgtctttccagacaaatgaagagcattatgaggacagaggatgttttattctcagcacacatcacagtgcttgggtcaataaatgtttactgaaagaatggctagatgaaagcaataattgtattgataatgtttttgtttttaggaatcttttggtttctgcaaacttggagattttactctggactgacacttgttttctagaagttataaatatgccatataattggacacatttgtctccagtttgtggtgatgttttttatttcctatagtcagaaatgaaaattttttaaagcctaaacataattcatcaaccacatatcttaaaagatgatatatttcaaagaatttcagtggaaattatgggtcaatatatttttaagaaggtccttacgaagacaatattgccttccctatgcctggttatatttgtttaattggacattctacacttttctagagattttgcttacttacaatcagatgaattgaaactcattggtttgtattccacattgttccttctggaaaccctttttagggtcacattgacagctgccagttttcagactaaaggctcttcatgctgataaactgcatacatatattgaaccaacaattccacaatttcaattgacttaacacttttcttatgtcatctagtcttgttttctatatctagtgtcacaagtagtacaaaatgttcaacatattatagtatatgagaaaccactttccttgggagctgtcattttgggatattgtcagtaagaatgaggaattctccatcatgcctggtttcttacactgttcaactgaaaattagtgtttttcaaaaatgtctttaagaaccactaagtggaagaagatggaagattgtcaaaactatccacatcactacactaggaaaatttgaagacatgaaaaatggtgtggttttctgtagggttctctgtttgaaaacacagaattctgacctgattgcatagctctggataataatgtattggagtcatctgtgtaatcaaaagagattaaaaattcaaccactaaagtgaatcaatgtgtttaggaatactgttgaaaaagtctaaataatttcaaatgaaaagtatattatctacacaactctaattcaaagtttgcattaagaagatatctaacgaacaaacatgcagaaaagagttattacttcagggaaggcaaatatgatgatgtggtgtcataagggaaacatgcagttttaaagatgtccacagtgataattcaccattgaaaagtatcccagatttagaatcttgtaatatgactaaatagcagatttctaattgctcaatgggataatacatcatctgtccttaatatttcctgaatgctggtgaattgtcacaaaagcattcatgattaagaaacaacagggaagcctgggagcagtggttcatgctttaatcgcagcactttgggaggccaaggcgggtggataactggaggtcagtagctcgagaccagtctggccaacatgctgaaaccctgtctctactaaaaatacaaaaattagtggtggtacatgcctgtagtcccagctactcaggaggttatggcaggagaactgcttgaacccgggaggcagaggttgcagcgagctgagatcatgcccctgcactccaggctgggcaacggtgtgagacttggactcaaaacacacacacacacacacacacacacacgaagcgggaaaaattctggtgcttcgcaaagtcatcacaatacaaatcaaaataaatttgtcttaagccacttagacaatactaaccaactttcaccaggtgtaatccatgcacaaccaaaaccttttactgtgagagcgaagctcttatggagttctacctcatcagtgatctaccattataagatataaaagactagtagattctattcatgaaaccatttttcttggcttggtattaattttggtaagagatgagttaccaagttagaaattagtgtggtcccaaattaaaacattaaaaagaaccacctaaggtaaatataaatatgtgatataaaattgtcaaaatgaatcctttcagaccttacatcattttcaatgggaagtatatatcagtcattgctaacagctggttaatattatgtgaaataccacagagtacaatagctttaaagaattttttattcttaatatatgaattctatattccatatttttagaagaaaccaaaataataacttgagtaagaggataaacgatgaaaaatgtaaagtaatctgtgtaaataaatactctgagtaaagctagtaacataaccatatctatgacacttaagtatatagggtttaggtaagtgaagggggcaaaaaaaaatgcaattataagcaaattcagaatgatcagcatacatagaggaacaattagtcatatgggctgaaaacacgttacagtcaccaaacacagcacaaagaaaagctttgtaacacagccactatctttctaaaaagtgacagcagaagatgccaaaagctacagtgattatctgaatcacagaaaaaagaggtgtcacctttgagctgaaagaagaccatgtatagaggttcaactagtaatgtcaagagttggtaaccattggcaaaataacatgcatcttcagggagaaaatgccatattgatcatttcagttcatactataagtagaaaagcagcaactaagtatgacacacatgtgccttatttttatctacatataagttgtctgctgtataaagcttctgggttagtgtacaaacatatatatgaaaatgattaaatgttaattgctacccatatagcataatcaaaataaaaataattgtaatactgcatgcatatctatttctaaaattctttaattgaagtctgtgcatttgatgctgtctcttgatagctttgtgtttgtatattcaaatttaaggaaggtgatacaccatgcaaacagaacccttcattaaggtatactttcacctgatgagagtagacactcacttgactttatgatttgaattactgaaccaatgctacaggagagtgtgcctatggcccagattttgtacatgaggtattttttcccaaattcccaaaagtttattattaaaacctaaataactttttggaattttatgtttaatcataagcttttaaaagtaataaattctaaaatacaatctacaattattaattaatcataatcattggcaataatggcttaatataagctatttcttattagatgttgtttagcattttatcttagaattcattttggtgtctgagtctccttggggctaatacaaagttgatgtataggatacatcaagtcatcctataatcaactacctacttagctattagaacctaagagactatctttgttttactttcaagacttcagactgatgagtcattaaataaatatgtactgaatgcctacctactctgtgtctggtactgtgtctggaccttacaatggtaggactttccctgccactagggagcctacagaatgagtgaaattctgtgccattcctgttgactccccttcaagctattccccatgcacatatatccacatatatccaaaagaaacaggtaaagtccatctatgcacataaaagcccacttattttttctcccaattataagagaacaacttttcaaggctatataaaaaagagagccttgctattttctaacacgtatttttacagacaagtagtacatagtatatatactaaaactttgctaaacaaatcaagttgatgtcttactggagcaatgaattgacctctaataacagctatagctcacctatagtaatcagataaaactagattaccctggattaacaaatttttttttgttttctttttttgtttgtttgtttgtttttggtgtagaaggggaatgttgtgaaagagaacagttggaaaacccaaaaatatacaaatccacaaatacttagtttatgtctataaacaaagaaaaagccttttacttatcttcagaaatgaaagtataagcacaaagacaattgatcaaattattaattgtggtcttctactggagactatgacccatgtcattttagttatacataaagaaaaataatggtgtaggtgatacctaatgttatccatgtatccgtgaagaaaaagtactgcacagaaatatgaacacaactaatcagatttatcttttatatatgacattttatagatgctagcagatttttctaagctttcttaaaactgtcattataaaatatttgtaatactaaagtcaagaatttaatttagtatcatggatctaattcattaactcttttgaagtaaaagtaaatcaaattttaataaactttagtctgacaatatttgctcacattaaaaaaattatttagaactttaacatgtgtgatatataataaataacagatatatattttacatataatatataatatatatgtgttggataaatatataaggatacatatatatgaacatatatgtatatgtatacatatatatgaacatatatgtatatgtatacatatatatgtatatacacacatatgtatccttatatatttatacaataatcagtatattattacaaagtaattgtatatttctccaaaaataaggaggcagtggttatttaaaacaataatatcaaaaagtctcctcaaaataaaacacatccatattttaacataattgcaatttggtcatattggttatagtataaacataatattgatttagaaggacacatttttcagatcttaggaaaattacaggtaacaaattcatcattcctccatctccctcttcccttcttggttacactgtatgtatctttatcacttcactatttataaagtgatctatcaatgaacaacatcttttaaatcactgtccttgcttcattctttttcctaacattttcttgctagttggtatccatcattcttacccacatttggggagatagaaaagtttttgtattcctcattttgttgtacctatccacctaatgccttaaaaatcaaattattaacatgcaggataagtcacctaatcatgagaattagcagctttttggtttaattataatcataaacttttcttctgaatcaatgttcacgtattcaatcatttatcttcagaaatgtcttcttatatcaaaaattcaaatctgagactttatctcctttcacattttacaatgtctgaacttctttataatctattttagactctaacaactttgtaaatatattacttgtcattgttctctacttttaagtttgaatgtgatatcactctttatagaaggctccaagcaaatctgagaataagttttgaattgatttagttactttttacgtgcatttatttccaaatgcacactaaaatattaggttggtgcaaaagtaattacagtttttgccattaaaagtaatgataaaaactgcaattatgttcgcaccaacctaatagttattagaaagatggtggttatacaaattagatctctttcgtcacacattttcttctaaatgtatattttcaagtgtcttagtaatttcttgcagctgaaatagagaagctgatatttttattaaatagttttcagaaaacctcaatctctttatctctaccactgctctttggctttctctaaacatacacctgtatgcaccataaatatatttattgtgaatatgaaagttcctcaaggttcctgcgtgtttatatctaacatcactgatctataaggcatatattaaactttagtgcttctttagtaataatgatgcgcttgtaccaccacctatccacactctcacacaatcaccccttttgaagtaaagcctatattttaaaaataaccattacagattgtgagtgcagtctaggatcacatagcagaactaaaagctaactggcccacccacaaagtaaatgtgagacagagggctcggggtagccatactctagccaagtagtactgacagataccaatagatataatcaaatgttacacatttgtgtttgcaaacgggataaatattttcctgaccaatctatacttttgatgattcaagctacaggataagttttaaaaatgtcttttgcacttatctacattacttaatagtatcttcttgtcatagacaactgttttacaccattttagtaggaaatcaatttgtcattcaattccattttctaatgcagtagtccaacccaacccagaatgcattattgatatggaaatgagtgtaattagcagcgtaaatgatctgttatttatgatacaagtcagagcagtaaatcaccattggctcactatcattactatgcaaatagaagaaagcagttaatggtccatgtgtttaaaacaggccacttgcttgctcatttgcaaatgaaaggcaagggtgagagtttaaggtagagatgacagtttatcatattgtcagtcctggtacttggacttaagaaaaccaagacacaccaatcattatgctagttttaaacgttatcccctttctctactgtatattctgcctcgaacctattcttacagcaccttcaaacttattttgggttccctgtgatttgcacattggaagtggaaataattgtgagagtgcttgtaagtgtttcgcactgtatgagatagtttttatgccatatgggaaaaacacaataaaaattcactattatgaaataaaatagcatcactggtcatataattcacttccttttcctacaaataaattttattttcttgtaaggagagaaactagcaataatttgagtagttagagaataaaggaaatatttgtgagccttactggaatttattcagtatacctgaaagaaattggtctgcctgtcctggttgctctcttttcgtttaatattccagggaatgtgagagcttgtggggaaacgtgagtgcattagcagcaggccaatgcttgcttagtgaaatgggaacaaaggcaagacacatgaaaagctagaggaagaagagggattgagggcaaatgcaaattctgcaagcttcacttgcatagatctgatcattttttaaagtatttgacagactttcagaaatacagaactgagaaagaataataatgtctttatattgaaggtgtacatagtagaaaggatctcaatctcacataaattatctccattttgcaaatatataaataaaactgacaaatcacttatgaaaccttattttggtttgttgttatttttattaagctatggattcaagaatgacatacaaattgggcatgaattttatatacaggaaatgataataatatttaaacagtagaaaatactttttcttataccaacattttttcttaaattatatgtacagagtggttggaacaatgctttaattcatctttcttatcagcttatgttttgtaaatattatgtttttctttaattccaaggaaatagctaggccattatatttccttgcctcattggtttttccagagataatcttccttcttggcttttgtttttgaaacctaaaccaggaagaaagattatatgaggaatctgaaaaagtcaaattcatagaaccaaagggtgaaatgatagttgtccaggactggagaggagaaaatgggaaatggctaatcaatgagcatgaagtttcagtaaagaaaaattaataagaaagtctacagatctggtgcaaaacattgtacctatagctaataataccacattgtatactaaaaatgtaagaaaatagatttcatgttgtgttcttatcacaataaaataaaatttaaataaataaagtaaaataaaaccttaagtccagtgagaagtttaagctagaggaaaggtagatggttttgggttgagcccatgcatttgttatcaagaagagaagagacaagtgcatactcactaagtctgggaaaggaagggacatctgtaggcataacagatagagggatacaagtgcactcccaggcagcactcaggaaatgaactgacttcaggggaggggttatgtggaaccccagtgtatcagtcagattcccagcaactactttatgagacattcaaattaggataatttaaagaatgttaatataaaagttattaattttaagagtttgagcaatgtaaaggaattactagggacagtgcaggaatgagagcagtttatttgagctggcattagccccaggcccagcaagactaaagcagggaagagagagattatagaacaaagagaaacttacaaatgcagcttccttcagagcagcaatgaccttcccttgaaagacacagattaagaagatctcacagagagggaaccaggagaacaaatacttagtttcactgtcctttctctctctctgattccctgctggggctttccaaatgggtcattggacaatcctaaacaaaacccagaaagcacaggagtctactgataatcatccacacaggccagcttccaacaatcagaacacaaagccaggatttctgaggacacagtggagctttctgtcttcaacggattatacaagtgtggatagctgagtatatcaaaggaggaggctgtcataaaccaaaaactaagaatccccctctaaaatttcatatgacagttaccaaaatttactacatttactaagttcttatgcccacggattatgctaagcactttatataaattttcttctcccttacagtattttcaggtaggtcctattattattcttttttgacaaaataagaaactgaggcacagagaggtaattatcttcctaaataacacatgatgaacacatgatgaaaccatggcagttagattcaaacctgtctaggtctgaccccagagcctgttcacctaatgacctcatataatgcttccctatatttgacataaatatgctgataagattcccaactgtggaaagtaattaaaataaaatgcgaaaatacttaaaactattcataatttgaattaataggttcttttaattaatatctgttatagtttgccttctacactgaaacattaagttggaagagaggcagaagtaatgggattcatacatatgcagaattgcaccattactttaaaatgaaatgaagatgagagaaccacttagacattatagttgttggacagattaaataatccactttcctaaaatgcaactggtaaagaaaataaataatgcttatgaaaggaactagattcaggtctattatttagcttggctttgaatattaattgtttttcctcttatacttgtgttttatatacatacatacgatgtgctttatttaagtagaaaccacgtgttaaaaatgtgtaagtaaaatataactagcagtcatattattaaaatctacaccatgtctatatcaaacatcttatttaagccagaagaacatttttaaaacataaaacctgttaataaagagaaattccataaaatgaaaaattgctttctatctacagtcagttatgtctctttgcaggttgcaattacttcgcatgttggtttttttttttttcttttcttttaaatgaagtctcgctttgttgcccaggctggagtgcagtggcgcgatcttggctcactgcagcctccacctcctgggttgaagcgattctcctgcctcagcctcccaagtagctgggattacaggtgcctaccaccacacctagctaattttttgtatttttagtagagatggggtttcaccatgttggccaggctggtctcaaactgcatgctgtttttatattcgaagaatattatgttgtatacatattgagatcccattaccaatcttgtttagcatgagacagctaagtcattgagtacagagttattttccaaaagtattcaatctcatgttgagaaagcaagaggaaagatgaggtgggagatgggggatgggggaagcaagagagagtgagagggagagacagagacagtgacacaaagacaaggagagacagagacaaagattgagattgtggtgctgagttttaatgaccttctgaccccaaacctggtcacattgatgtaaataataaatacgcggttgcactgcttttccttagaaggaaacatagacttactcctgtatctcttctcatatccttgatgttttctgaattttttattcagactgattgacactgattccctctttgacagacctctctccagaacctcacgctcctatatccaggaggacgaatgctactcagcctctctgtttggatggcaggtggcataataagcatatgtcacatgaactcctgatctcttggtctatattctcatctaaacagctcctttcatggtcttcttcatctcatctcagttgatggcaactccatccttccaactgctcatattaaaaaaaaaaaaaaaaaaaaaaaaccttcgtaactatttttattcttgttttctttgaaatttcatatcatatctctcagtaattcctgcaggctccctctccctttaaaacgtatacagaatctcattgcttctcaccacccccactgcttctactctggataaagtcaacacaatctcttacttggaatattgcatttgcctttgactctgttcagagtattcttaaccaaagagcaagagtaatcctcattgaatgtatatcagatcaggccactccacttcttagcattcctcaatggcttctcctatgtctgagaataaaagccaaagtctactacatacctttccttcccctattattctatgatgacatctctcatgacccttgcattttcttatcccatcaacatatagtgttaactgtttccttgaactgtcatcacagggccttcatacttgctgtttgattagtctgcaccatgctttcaccagcatcttcacttccctcagatctttactcaaatgccacttcttcagtaaatctctccatggggcaccctacgtgaaactataatctcccaacattcattgtcctctttcctaatttattattctccataatacttatagtctaggcttccatatgttttacttattttgtcaacttttaagaaaatataatctctaccaaatcaaggatttttcactactttgtccatgattgttttccaatgattagagcatgtattgaaatcaattaaaaggcaaatgaaaaacaggacctcactgtcattttgtaacccaggttgtctgttctttggtctatctctgttgctatcaccttgagggatggcctttcctgaaaggaggtggaatcaaaatttcaatggtcataataaaatactaatttttttaggcttgttaataaagataaacagaattttataatttacaaatgccattttagacaataattgtaaatgccttttcttccagagtgtaatattaaaaaacagtcagcaattttatgtttctgtgaaatatattactggttgcaatttgcttttaagttacttgtaatatgattaaatagtaaatagttaggatcatggtgttatacaacttttccagccaactgtgaatcagtttatgtctaaaactttaatgggtgctctctctatatataatgtgatcagaggtgcattctgctaagtgttaagtaacttgacttctgtaaatatagccttaaattttctaattttaaggcaaaattagatttcaatatgtctaaatatcaccaacagcaggaattagcagttatattagctcactgcaaattagttgataaggatcaaattagatttttaaatcatcattgcaaattatgaagctctattttcaagaaacacatttaacatcattaataacccacagaagttgtgaaaggtgaaaactcttttaaagaacgacttctgagagacaatcctttagtttgcccattcactgaagaatcactcatgtaattaacttgcctcatctcttccctgagttattcagatggtcggtgaggatagtaatggcagccacaaactctggaatcatctcgaagtctgatgatacagtgttacatggtattttctaccacataaccaaagctctggaatatatgaaggggtatctagtgcttacatttgtaacatcgaagggttatatgtaccccttcatatgtcccagagctttggtgtggtagaaaagttatttataacatacaaatccgatactacagtatagagagttacatattatgcattcttaaagcacaatattttagaaattttatactgcatttagctaaatacttcatttgtagatagagtagccttcataggataattaatattttctaaaaacttccactaactgacatttttacaatggattttgttatttaagtttcagtttacatcaattataagtgtgagaattcacatggaatctgtataaaagaagagaaaattttctttttaccttcctattacatgtagaactttttcttctactgagactaaaatattcctttaataaattcagaaatcattggttaatttcaaatttctcacccctgcaaaaattatatatgattttgaaaaggccaacatattcaatcacctgtatttttatagatcgaaaaatattcacatttaaaaattgccaaattacaaaaagttgcaaatggtgttcctttaatacaactttcaggcctcatttattccttacttgcataccaggttctcaacaagaacagctgatccaagaaaaaaataggtccttcgcaaaagttctttcttagaagagctatgactatatacacatcgttggtagtaaaatatatatattaatatcttgaaacattagaaaatatcatctatcttaattctatagtaaatcaacagaaagacacaataatcttcaacataacaaatcaaacacattgaactctctgtatgttgaggtgatgaatatattctacgcatggcagtgtgcattcaaattcaaagccttgtttaccagtgatttttgtcatgcactctaatagtgtcattacatggaagagggatgctcaaggagatactttaagtttgagaattattttcctctgttcagctgttaaactacctctcaggaaaccaataattcacaaagggaaattaagcaaggtgactcaattatgtgactttatgttccagttcctgtacatgcttttaaaaagcatgtttcagatcattttaccccttaggggtcagcaagagaataaccaatctaaaatagaatttaatagtgcaaattcacatccatgtaatctaaattgtgtcctctggagttttagagaccactaacagttaaagcatagtggatatagtaaattctgaaatcccaagaatgaatgaatacaaatatgatttcatatgactggacactgtttgaattacagagctgctagaaagccagagatacagtcaagtgaaaatatttttccctaaagtatctagatggtgcttatggatactacaagtcttctacaccttaaaacattatgtaaaattgctagaattcctattttccctatataatttggaatatcgaagaactaagtaacacatatttttctcacatagactctcaggtggtctttggggtaagagtagggggagtgtggggggaaaaataactacactgctttttaccacgacttggaatccacagagtcaagagataccacccatttatatacacacagagagacacgttcatcttagtaaacttcaaattctcaaagggaatcctctcttgtggcaggcctagttttaagaatcagaacatgttccattctccttcaatgttccagcagacacttcttttgtaatcttataatatggaatcagaacaacaaggtttcacattcttctattacgtagatcattcttattacatacaactgagaagagcaatgtaaatgtgcagctattctaacctgcctattggataaaaatgtaaaatatcaacaagtttactgctcaacattttccatcttttattcatttgcagaagaagaaaagaaaattttcaagaaacaaatgatttaaagtccagatttctttgatctgaagctgaactcaagcttttttctacttacaagcatatttaacaaataactgaaataattttttaggcattcattcatatttcttacaggaaagaaacaatttcatttctaagtctcataggaaattgtttttaaagctatgagtttagaagagaagatctgaaatcaagacatgaccagaggaaattacaaaaaaagatgacgttgatattccttctggtgccctcctgttttcagtgcccatctcctaccatactacctaatccccaggagaaaccttctccaggcctattaccacacaccttgatttccaagtatttcttttctagctaagggaatatcaacggagttgttgtcactctctgagtagcctccaagacttacaaaccatagacttgatgttaaattttggacaccataaataattctgggcaacacttgtagagagaagaagaattctacacaatgtgaacacctatttatttttatcacataatattgcctttctctggaattctaaatggtgatatcaaaagactcctgtttataagaaactaacatacattcttgttaatttttctatcagaggaacatggaataaatggcataattagaagaaatctatagtgcaagaataaaaacattaataaagccaatgataaaagctaaactttatcatgcacacacgaaatcccaggttctagatgaagtcttttccatgtatttcctaatttactcatatttgccccaagatatatgttaatattatttagataagaaaacatagtcttaaaattatacatggctcaagctccagacctaggatttgatcccagggttctctgaccccaaagctccagcttttaaaaattatattttaatactatgtaaattgacttagcacttataaatttatatttaaatattttggtgaaagaaaaaaaataaataataatcctttggtgtgtcccagaaaattcccagatatgccaggggttaaaaatgattctctattcagaatcaccctcaatgaatagaaaattcagtacatggcccaagacaacagagtaattataaccataaaagcaggaaaatgtgccatcaaaatttgtcaatcattgtatataacatagagaaaacgagaaattgatgaataaatgagtacatgtaatctctagaataagtttctagtcaacactgtcagccatataaacaggacatggtaaataaaaaacctcagaaaaagcaatcggtaagatcttaaaactgaactgaatcaattcatttagaaaccaaaaagtttatatccgctatagatcacatattaaaagaaataaatatgacatcattctacaaatgaaaaacaaaaaatttagaaaggcacattatctccaagtaggcatgactgacatccaccaaatatgataagaaaatatctacaataattaaaagacttagccagcttacactggtaggtgattcaatttccaggagaaatgcactgatatttcctcaagaggaaaaagaataagataaatatttactaagtagctatgtgatcttgtgtcaatctctcagagatttcatttctcctttctaagtctcagcttctctacattcaagttttaaatacaacagttttatagaatattatttgccatttttgacacatgggaagaaaatatataaatgaattctatatttattcagctcaagtaacaaaagttaaggttgacaaaataaaactcaaactatatttgccagtaaaccttcaaacagtaatcccatgaacataactagaatggccgaacctttctcaaaccaaagagacttttgcaggttagacttaagttaaatgcttcatcattaattccagcaggcaaagaatggaagtgggtagagcacaccagagacaagaataggttggaggccaggcaaactagaggttataaatggaagcactagaggctagaaaagagtgggttggagactaggtaaaccagaggattttagtacaagcaagagagtaaggctagagatcccagggccatgtaaacgccaaagactggttgtaaagcaaaccgtataatctcagggcaaggtaaattatctacaataaggacattcacaaaacctagcaaagaccaaatgtaaggtaaaagaacacttgcattgtgcccatccttggtggtcttttttctgcattccccccattaagtactgctcctaaataagtttggcttagaaaatacagagagattactaaacaaagcagtctgctagaacttattccagctctctgggatacaaggatttcccttactcctacctgctctcaaactaaaggatttcacattaatggtaaagttctcagctggagaatgaacttggcagtaaaatcagatggcttatgtagcaatttttgagttctaaagagctgtaataactagaattctcctttcctgtacaggaagtgataagccttttaacctatgctacttatattcatgttctgatacaaaaaaaaaaaaaaaggaagattggtcaaaagtaaatttttaggataaactcatttatctggccctgtctgcctaattatgcctccccttcccactaaaagctcttaagtattctctattgtacatgctacagaataatgttcaaatgcctttgtaggtcacaaaaggaactccataattgggttaacatctaccacctaggcctgattctgtagtgactttctgccttgctctttatgccttagaaacactgtactgtctatagggtagtttttgtccacaccattctgtttctttcctccatgacttttattctatgacttcctctaattagaatacctcatcttccttttcatctatcttatttattctttatgacttaccttaaaaaaatcaactccttaagaaagccaccctgatatttcatcacaatcactctctggttcctcacagtacctactcattctctagttctgcttacatagtatcctgggcataaatttagccctatgtaccatgttatctcatgtgtatctgttcgcacatgtttagagtgagttgtacatttatgaggctagccctatggtggctgctttgtttgtttgtttgtttctagactagtgctcataattcagataacatctaccaggtaaatttaatacatttttataactgtgaggacagatgtgatataacattctataatggaaagaaaaaaaaaatgtgttttggagccagacttagatagtactcctagctttaattattgcttactatataaattctagtaagttattatccactttcagttgtcttcacgtttataaataccaggagaaaaataccattaaatgttggttcttataagatgtcttatgaaaagctactggcaaaattcctggtgaacaaatatcgatcatttcctttaaactataagctccttgacggtaaagcataatgctgtgtgtgttgtgtatgaattttaatatctacaacaattagtaagcacacagtatgtgatataatatgggtaccctataagtgtttgtgaatgagtaaataattatgaataaacacatacataaaacaattacaagttaaattcctaataatcctaactttggaaaatataaattgtattgaatgaatggaagaactgagtaaatgcatatcaaactgttaatgataatataaacactttccttagcttcccgttaatctgtatatttaatataatttcaatcaaaattacaatttggtaagatggtggttttggagaagggatgaaatttgagggatattgtcattaaaccagaagaatgaatgtatagcaagagccattacatcttttaaaagttaaacattatgatactggctcaaagacagacaaatagaataaagaagcaaaacagggaatccagaaacagatttatgtatttatgtgaattaaacatgataaaagtagcataccaaaccagtgagacatggtgcgttttacaataaattgtgttagaaaaactggatgccctttcaatattcagacagaccaagtaactctccaataatcacactgttagaaagtaagtaagcactagctttgaaaggaacacactttcaacagtgtttcactacttctcaagatttgccttagatagtgtgtacaagtccttgctgagataggctcaaatttacagatgagtaaaatgaggccagaacacgtaaaagactgcttcgagattattctgctagtggttatgttgcaagaaatacagctggaatacctagctcatcagcatacaaaattaaatattctgcctcacttctacgtttgcaataaaatgtatctctaactttatcaggttttccattaactcaaccaaattatgaagacttgatctttaatacacaaattcagctatgacaaatgtaccgtctccaaacttactatctagaagacatccattggttatgaattaatggattctaggatatacctttctccccatgaaaaaaaaatctacacattcaggttactaaggtatgaaattctgctgctatagctttggtattttaatttaacactgttctctattgttgaaatgcattatttctgtaggtatgaaacttacaaaatattagtcatgtattattatgaagaaaacaataatgcgatacaaagtttctggtggggttaggataagaaagtttttggtttaataaaaataaccagaaacagccttctggaggaggtaacattagaatttattctaagaagatgcaggttgtcattccaacacctgaggaaagtatttacgaataaaaaaatataagaagccctgtataaatggccctgaaatttattaaaaatgagcttattttacatttgaaggacaaaaacaaggctagtatagtagcatggtaaatcaggggtggggagatgtacttgagtatactactacagagatattcaactatcggaatttggtgccctataggatataataatgagtttgcaactcaaaatctgaaagttcaaaggaggatttgtgtgcaacacatttagtagaaagatagtaacaataccatcactaacttatccaaagaaaagtagatgtccttaattagccaggtgtgatacttaatactgagtgtcaacttgattggattgaaggatataaagtattgatcctgggtgtgtctgtgagggtgttgccaaaagaggttaacatttgattcagtggcctggggaaggcagatccactcttaatctggtgggaacaatctaatcagctgccagcaaatacaaagcaggcagaaaaatgtgaaaaggagagactggcctagcatcccaggctacaactttctcccatgctggatgcttcctgccctcaaacattggactccaagttcttcaattttggtactcggactggctgtccttgctcctcatcttgcaggcagcctgttgtgggaccttgtgattgtgtaagttaatacttaatacattcatatatatcctattagttctatccctctagagaaccctgactaatacagattttggtaccaggagtggttctggaggaacagaatattaaggatggagttctttcatcagttttggggtttctagagttggctgcttaatatgactagaccccaaaatgctatggaatctccttctaatcatatggagaacactgatagtacttgacatgaactgtttagagagttatgcaaaataaatgcacttaacactcctgattcaccactcgtgagaggcaaagagtttagtgactctatacatacataacacctttgaccatatgtggagaaccaaggaacgtaatgaaactggttgcttgctcctaagtttagtggacaaagtgatgaaagaaaatgatgaactcagggattctgtctctgggctttagaagcagatactgagcctcagatctcctaagattgccctgagggagagtcttatctcctctagagaaagaactgaaattgtggaaaaatagacatgctatcatgtgagtggctgatctgcaacgaaagatgcatgcacagcctcaccaagtgtttattgttaaagtgagggcattgattggaaaagaatgagaccctgcatctcggaatgggcacatgtgggaggattctgatgaagctggggatactgagtttgtaaactctgatgaaccttttttgtcaaaaggaacagcttccccatccccagtagtggcaacatcccctcccaacccatgctgtcatcagcttttccatctttgtctgaggagataaaccctgtgctgcctgaggcaacagtgatagccttcctgctctgcgggaggcaatggtgatagcctcccctgaggcagttgccaggcatgataatgttgattctcctcaggagccacccccatcacctctgtttgcttctagacctataactagactaagttctggtaggtccctagagtttagtttgacaatgtgactcatgaggtgagctacactcaaaaagaactgtttgagttttctaatctatataagtagaaacctggagaacaggcatagaaatggatattaagggaatgggataatgatggaaggaacatagagttggatcaggctgaatttatttatttgagcccactaaataggggctctgcttttaatgttgcagcttggggagttaaaaaaaaaaggttctaatagtttatttgcttggttagctgaaatatggattaaaaggtggcccactgtgagtgagctggaaatgcctgatctcccttggtttaatgtagagaaaaggatccaaaggcttagggagactgggatggtggcgtggattaatcactttagacatactcatcccagctaggagggtccagaagatatatccttgacaaatgccttgtgaaacacatcggtgagggcagcacctgctctttgaagagcctgtaattgctcttctctgtatgtcagatctaagagtgggaaccacagtcactcaactacaaaatttaaatgcattagagataattgcactcaaccatcaaaggcaaggtgggcatggctaccataatggacagcagagacaaagcagcaataagaatagtctgactcgtgtagagctctggcattggctaattaatcaccgtgttcctagaagtgaaattgataggaagcctactgcattcctacttaatttatataaggagaaaacttctaggttgaatgaacaaaagactaatttgaattacaaaaaaagggaatcatggcccctcaacaaatttccatacttcagtcactttacactcccagaaccccttgaatgaaggggaggctgggtccctttgaggaaggaccccactacattactgacaatttatgcagtgcatctttctcccatccttccccaaggaaacttaaggccttttaccagggtaactgtgcacaggggaaagggaaatggtcagatattttggggactcctgggcactggctctgaactgacgttgattccaggagacccaaaagatcactgtggtcctccagttaaagtaaggtcttatggaggtcaggtaattaatggaattttagcttaggtcctacttacagtgggttcagggggtccccagactcatcctgcagtcaattttccccagtgccagaatgcataattggcatagacatacttagcaattggcagaacccccacactgactccctgactggtagggtgagggccattatggtgggaaaggccaaatggaacccattagagctgcctctacctagaaaaatcataaatcaaagacaatatcacatccctggaaggactgcagagattagcgccaccatcaaggacttgaagttgcaggggtagtgattcccaccacatccatgttcagctctcccatttgaccagtgcagaagacagatggatcttggagaaggacaatggattactgtaagcttaaccaaattgtgactccaattgcagctcttgtaccagatgtggtttcattgcttgagcaaattaacacatctcctggtacctggtatgcagccattgacttggcaaatgcctttttctccattcctgtccgtaaggcccaccagaagcaattttctttcagctggcaaggccagcaatgtacctttactgtcctacctcaggggtttatcaattctcccgctttgtgtcataatcttattctgacagaccttgatcacttttcatctccacaagatatcatattggtccattacattcatgacattatgctgattagatccagtgagcagaaaatagcaaacacactgaacttattggtgagatgtttgcataccagaggatgggaaataaatccaactaaaattcagggaccttccaacttcgtaaaatttccaggagcccagtagtctgggagtcctgttgagacattcctactaaggtgaagcataagttgctgcacttggcccctcctacaacccagaaagaggcacaacacctggtaggcctatatggattttggaggcaacacattcctcatttgggtgtgttactccggccaatttattgaatgaccaaaaggctgccagttttgagtggggtccagaacaggagaaggctctgcaacaggtccaggctgctgtgcaaactgctctgccacttgggccctgtgacccagcagatccaatggtgcttgaagtatcagtggcaaatagggatgctgtatgaagcctttggcaggtccccataggtgaatcacagcagaggcctctagaattttggagcaaggccctgccatgttctgcagataagtattctccttttgagagacagctcttggactattactgggctttggtggaaactgaacatttgaccataggtcatcaagtcaccatgtgacctgaattgcctatcatgaactgggtgctttctgacccatcaagccataaagtgggtcataaaaatcagcattccatcaccaaacggaagtggtatatacgtgactgggctcaagcaggtcctgaaggcacatgtaagttacatgaggaagtggctcaaatgcccatggtctccactcctgctaccctcctcctcttccccagcctgcaccaatggcttcatggtgagttccctatgatcagttgacagaggaagaaaagactagggcttggttcacagatggttctgcacaatatgcaagcactacctgaaagtggacagctgtagcactacagctcctttctaggataaccctgaaggacagcagtgaaggaaaattttcccagtgggcagaactttgagcagtacacctggttgtgcaccttgcatgggaggagaaatggccagatgtgcgattatatactgttcatgggtcatagccagtggtttggctggattgtcagggacttagacaaagcatgattagaaaattggtgacaaagaaatctggggaagaggtatgtgggtggacctcactgagtggtcaaaaactgtgaagatatttgtttcccatgtgagtgctcaccaatgggtgacctcagcagaggaggattttaataatcaagtggatatgatgatccattctatggatactcctcagcctctttccccagccacctccgtcattgcccaataggcccaggaacaaagtggccacggtggcagggatggaggttatgcatgggctcaacaacatggatttccactcaccaaggctgacctggctacagccactgctgaatgcccaatttggcagcagcagaaaccaatgctgagccctctgtaaggcaccattcctcagggtgatcagccagctacctggtggcaggttgattatattggacctcttccatcatggaaagggcagaggtttgtcctcactggaatagacacttactccaaatatgggtttgcctatcttgcatgccattcttctgccaaaactaatatctgtggactcgcagaatgccttatccaccatcatggtattccacaaagcattgtctctgaccaaggcactcactttatagctaaagaactgtggcagtgggctcatgctcatggaattcactggtcttaccatgttccccagcatcctgaggtagttggattgatagaacagtggaatggccttttgaagtcacaattacaatgctaactaggtgacaatattttgcagggctggggcaatgttctccagaacgccgtgtatgatctgaatcagcatccaatatatggtactgtttctcccatagccaggattcacgggtccaggaatcaaggggtagaagtaaaagtggcaacactcaccattaaccccagtgatccactagcaaaatttttgcttcctgttcctgcggcattacattctgctggcctagaggtcttcgatccagagggaggaatgctgccaccaggagacacaacaatgattcaattaaactggaagttaagattgccacctagacactttaggatcctcctacctttaagtcaacaggctaaggagggagttacagtgttggctggggtgactgacccggactatcaagatgaaatcagactactactccataatggaggtaaggaagcatatgcatggaatacaggagatccattagggcatagcttagtattaccatgccctatgattggggtcaatgggaaattacaacagcccaatccaggcaggactacaaatggtccagaccccgcaggaatgaaggtttgggtcactccaccaggggaaaaaacccacaacctgctgaggtacttgctgaagtcaaagagaatacagaatggatagtagaagaaggtagtcatcaacaccacctacaaccacatgaccagctgcagaaacgaggactgtaattgtcatgattatttcctctttcttttgctgaaaacatgtttgtgtatgtatacacttgtactaagaaaatatcttcattttatttccttttcctttatcatgtgacataagatttattgacttcgtatcagcatttaagtattgttaactttatgtaatagtatttgagttggggattggtgcttttccagttgtatgaaggatagttgtattatgttaggcataattatgaccttattgtctttacttggatatcatgtgtgatctcagcagatctgtatgggttcaagttgacaacggttggacttgtgatggttaatactgagtgtcaacttgattggattgaaggatacaaagtgttgatctagggtgtgtctgtaagggtgttgccagaagagattaacatttgagtcactgggctggggaaggcagatctacccttaatctggtgggcacaatctcatcagctgccagcaaatataaagcaggcagaaaaacgtgaaaaggagagactggcctagactctcagcctgcatctttctcctgagttggatgctttctgccctcagacatcgaactccacgttcttcagttttgggactcagaatggctctccttgcacctcagcttgcagacagcctattgtaggaccttgtgatcatgtaagttaatacttaataaactcccatatatatatatgtatatatatatatatatatatatatatatatatatatatatatatatcctattagttctgtccctctagagaaccctgactaatacaccagggtatgtgaaaacttagcatagcctttattataaagaaaaagtaaaattcagcatatttaggctccatgtgcttcactagtttttctaaaatctggtaattttaccaatggatgaaatgtaatttaattaggtaaagctgaagttcaaatatagagtggaactgataagtaataagcctaacccatatgattgtattcaatatatttgaaaagtgtcattggaagttaataggaggaaataatatgatcaattattttgtaaggaaaggaagtcaatggaaagaaaaaaatactaattaataccaaatttttcttttttttttttttttattttgacggagtctcgctgtgtcacctaggctagagtgcagtggcgcaatctcagctcactgcaagctccgcctcctaggttcacgccattctcctgcctcagcctcccaagtagctgggactacaggcacccgccaccatgcccggctaattttttgtattttttagtagagacggggtttcattgtgttagccaggatggtatcgatctcctgaccttgtgattcgtgcacctcggtctcccaaagtgctgggattacaggtgtgagccactgcacccagccaataccaaatttttcaaaaggtgaaaaaatacattccacttaacatttccagtcaacttctccactttgtcctacaaaaagctattttttctattttaaaaaaatgtgacttattaaactaatgagaactaataattactttttcccagaaaacaaagtcaagatttccaccctctcttttattatgagctagtatttgtagcatggaacatgtttttcataaacattcttaggtatccttaaaagttaatagttagtgtccatcctgaacattttacctttcatctgtattcaattaatccagttttcaaataagtaatcaacataataagcactatgatagaggtttaagaattacagaaattttaagtaagtgtatggatattctaatacacattccagtatgggccaatataagtataaagctaattctctgtcacttacatagtacactaaaatataactcttcataaaagattgtgtgtgtgtgtgtgtgtgtgtgtgtgtgtgtattcaacatgggcaactaacatttctttcttcaacattggtcttcaaactgccaaaactcttatactgtgttctaattattctcatatgcttagctgagacctttcacaaaaaaagctcttcaaaaattgtcattatatggaattgaatcaaatcacactattacttgtcatgaagtagaattcagtatcacatagaatgtcatgttaacctgtcctgtttcagactcaaatccagtgatttcagcggtattcacaactgactttttcaaaatattccataatgagaaggtacttaatatggtttctttaactgtaatctctaagataatattatcatgacatgtcagggtacaggcactcttttaaggtatacttgcacacaaacaaacagtaatgattttaatgcatgtgtcaaatctaaatctttgtccctactgttttgtgtacccaacagaggtgatttcaaaggaagaagactggaagagatacacacatgaattgcgtacatcagaatgaaatgtctatataattttgaaaatcaaactgtttatacactgtttgaaagattcatttcggccttacatttgctaatcgcacaagatgttacagaataccaccatttgttatctacaaatccaaagaacaaatgaataaactgtattcagccatgtgtataatcatccctcagttgatcctcagtgcatttatagcatagtgggagtgtggctttttctgcctcttctctgtaacatataaaaggtattaactttcacttaaaaaggaaataatgaaagaaagaagcagcagcttctgttggtacataaacatcaggcatggagattctatactgcatcctaggagaaaccagggaaccaaaataatgagcttaaaaccgcagaaatcattgtttatgattcaattatttgaaagcagttactaaaaaaaacttacatgatactagtatattttcctttgtaatatatgctactttgtttatccatcccagaaatttgtctttattttaattgctgttaagctctttgctggaggttttagtttcatcctctcatactcccaggttttctatttggactttgtagcttgtggtcactgaggttacatttgcttttcctcttttatgtttagcttcattgcctcaaacttttctttccactgaatgcatatgaggtcatttatctcttcatatttctattcagtctaagcacagattgtatgtgtgtgtgttttgttgcttgtttcttttaatagaagtgtggcttctatcattctttcctaactcattaaaatatccagatttcttttactagtgcttatttcttctttatcatggaatagcacaaaacatcaccactatgtattactttgaaatggatttagccatcagtttactgtatcttagaaatgtatttccagtttgttataaaatcaaatgcacattaatcaactaaaatacatcagcagaattattttattgccaacgataagtatcagcagacttctgaaattttattggtaggaagaggtacaaaatttactagacactagctgcttttggtaatttgtgattttaaaaagcaatttatataatagcaagtaaattttattgaaagaaaaagctaattaaatcaaatgtgcatttctgttaaaagattgcaggctgtatttaattacgtatagctttccccaataagatgataatgataaatattactctaaattacaattgctaccatattttttccaatctggtttgactacatttcacaatttttattattgcttttattgtcattatttgtatttacctaagcttctttgtagactatattagctattcacattgcattaatttttgacccacaagggcaaaaagtatcaaattctgttcactgatccatgagcagcatgaaaaatgacattcataggtataaaatattcttggacaggtaccaggcttggataaacaccccctactatcacaaatttttaaattataatttataattatagctactgatatagctataatattaatacagccaaaatagacacttattgtaggtttgagatatatgtaatttttgtaagcttattgtaatatccattcctttttctcccattcaaggcattagcagaaagagcataagttatgggaatgaccttgcctatacactaacgtgtttaaaaaggaatgaatcatttaaaaagtctggttacaaattacttgctatgcacttcagaggtgatgttgacatgctggtgtgcctcatgatcctaagaaccactaaaccagaattttatttcaaacacaacagaagaagaacaatggcaataataacctaaatagcaacagaatggggagaaaaagtatgactatatcaatgtccttgtgataggcagaataatggctctccaaaatgggcacacctcaatccttgtaatatgtgactatattaacttacatggcaatagggattttacagatacaataaatgtagggtgcctgagatgggaaattgtcctggattatctaagtgagcccagtataatccttttctgggtccttttttgggaaagaaaaagaaagttcagagttaagaggagatgtgaggacagaagcatactggagtgatgagattgctgactggaggccataagccaaggaacacagatagataggcaccagaagctgaaaaagaagaaactgattctttcctagaggctcaaaaaatacagttctgctgactccttgattttagtctaatgaaacccattttggacttctgacttccagataacaacatgtgtgttgtttgagccactatgttcttagtaatttgttaaagcagcaataagaaacctacacagtcttcaaaccagtaaaagcatattactatatactgactctatcttctgaatgacctactgcctaataagaattttgtcgataatgactccattacagatttaatgcaggaagatttcagccgagaaaaaaaaaaaaaaaaaaacaaggccaggcatggtggctcatgcccataatcacagcactttgggaggccaaggcaggaggacctcttgagcctaggagtttgagaccagcctgggcaacacagcaagatcctacctttacgaaaaaataaaataaaaaattagccaggtgtagtgtcacatccgtgtagtcctggctaatttttttatttttttgtaaaggtgatgactatatactaggctccctattatgaagtagaaagtagagaatgaagaatattttaagaagaatccgagaaggaggcagactttttatctcagtccagttggggagaaggccgtgaaaataaatgtatctatagaattgttgaggattatgacaaagacttggtatatgaataaaccagaaattttctgtgaagctggagagtatttcaaagaaaagttcatatttgcactgtgtatacaaaatgaaagtatgagaagaatttatagccatgtatcataatgttggaaaaatcataaactacttgttaagaccatttgatattagatagaatttaccgattgaaaatatcctcaaatagaactgaccaaattgatacaatcatgtctttgacctatgtaagggcctctttataatcagctatgaccacctgtcctcatatgttttgatgcaataaaaatcaaattatatagtcatcagtaagttgctgtggattaaaagagtagctctattttcattagttattaaattttaacttagtattaaaattgacacacacctagtttatctttaatagtgttttttaataacctaacagtgctacacaaataaattatagcaaaactagaaaacatatatttttaaaacttcaccacttcaaatattattaactctagtatctgaagtaatgttccgatattttccaacatttaagtatagccgaacatcaaccatgtagtaaaatactatactgcagacttaagcatacattcctttcatttctgtctagttgctacagggcgcagctattcatatctacaaagccagttagatttacatgtgaggggcaactgggttgaaatgaaggttgcatcaccagagaaagcatgtagcacaatagaacaacagaaggattgtctcaggcacctctttcctacattgcatggcttgtgagtgtgcaggtttttttttttttttttccagatatttatcagaggcagttactatcattctttttgttgtagaaaataaatggatgggtgggaaaaatgtcatgagtagagcagaaagttatgtgtggaatgaagggggaggatgaagggagggaataacttaccaaggttctttaaatcatgccagcctaatgaccttgcatattttattaacacatacactttccaacccccagagaaacttaaagccttgtgacaatgtcagtcttctgaaaagattaaactataattcttttaaacttaacattttaaaataagtaaaaataacatttaacagttttttgacacctttgtatatgaaaacatttgtgtctacaattttggtcagtttacaaattacaaatgttttaaactactacacacactcaaatgtgcaagggaatatgacctagaaaccaaaaacaaatttagctttcctggccaatatataagtcagtgaaatttaatggtagctcaggacatttttataggaatgcgtgggatgacatgagtaggaaaattagtatttaattggagagaatagaatctgttatcattttaatgcactcagacctacatatttaaaaataattttaacatatatacacaaacaatatgtataaaaatagagcttagaatcagcatttaaaactgcatcttacaatttgcttactctgtataagaatagaaaaaactgactctaagtttaaaattcatttgaccaattaattcctctccacagtgcttatctacatactagaaatattaaaataagagataaaaagttaaaatttgtttttaaaacataaatattttaagacatactacaattatttccattcaaggaaatgtaaaaggtagcattactaatatagttctcaaaactgtataatttctaatagaaaaatttagttctctgttaacatttgttaatttatcttactggaacaaatagaccctacaatgagataaaacatgttcaaactcttgctctgacattttaaagttgtataacttggggcaaatcactcgactagtcaaatacttcttttcaactagaaaacagggattatatctacatacccacaggattgttatgaggattttctgactataaaaatgttatatgatgataatcaagtatcaagcatataactctataggtgttgcttcttatatcttccccttaccccctccgcatatagactctaacccttgcaagtctactttgtaaagaaagacctacattgatttcccatttaaggtccatgggacaaaaagagatgctcaaaggcagacagaagtgatacaaactccttctgccttcaaaaatggagatattcaagaatgcacccaagctatatctagcaattgtactcattgatagaacaagtaagagaatttccaaaacaaataacacatgatcaacattgcacttgttaggttcagtgttttgttttttgtttaaatagggttcttatttaaatatattgcattgatatctaccaaaatttgatattaggttaatttcttttgtttttgtgagatttgtgttaagcaacttgtcacctctttgtatagcaaacgaggtatgctttttaatgtttccatatgattattacaccagggtcttttgttattgttgttattttaaaattttaaaatcattttacctagttaccatagaaatgttagttacacattgctaaaagaaatcatgaaatgagaatgtaggactacagattttaatcatgtttaacatatttaaacgtagttttatcaacctgtcagacatctttgacaaagagtactagaaaaagtattttctcttttctttccagaatcactgggtgcatgaattgcaaatcttccatatataaacagaaacaatactatattccttaactttttttttttttttagacaaagtctcactctattgcccaagctggaatgcagtggtgcgatctcagctcactgcaaccttcacctcccaggttcaagcgattctcctgcctcagcctccccagtagctgggactacaggcatgcaccaccatgcccagctaatttttgtatttttagtagagatggggtttcactatgttggccaggctggtctcaaactcctgacctcatggtctacccgcctcggcctcccaaagtgttggaattacaggcatgagccaccatgcctggctatattccttaacttctataacttactgtggtgacgcactaggaagttggcaatttgtcttcttttccactgagaagacagactaatttaagacaatttctctttcacacaacccaaaacatgctgtcatattgaaagactcaatgaatgcttagcatgaaaatgccaattttaaaagctagctattatctgtgggttttcccacctctgcacttgatatatttcagaggagagtatttatgcataaaccacagactttgttagaatctctataataatatgaaaacttttgatttgtgagctcctgtggaaaaatgaaaattatttctgcaataaataatattttatctgttctaaaatagcttaatgattcccataagtctattatgagaactcttcattaatcaaaattttcacttctagtagacataatcacaatctattaaatttatatttcctccagtgctaggagtaagagcagcaaataggaccaatgtaatcaagtattgtggagagcacatcaactgtataggtagttaaatcactttcactctaggtctgtttccacatcaacaaagtgaagcagttggactcaatttttgtgaaaaccagcttgattctacagttcctttaggttttttttttattcttcttcttttaataaaactcaggagaaatgaccgccacctcacttcattttagggaaaacaatgtgtgacacacattataaaacagaatgcaaagtgtcaatattattatgatattaagatgtaatattcatttagcatgacgaatttgatccaaatcaaataggtcgtgagaaattctccatcttcccacctttgggggctaagtcataacttaatggaccttgctgctgtatttgaattgaggacttcattacctttttccattcaagaaacagtagagacttttgtttacatgatgctattttctcatttttctcccacctttccaacaacctgatcaccttcaaggggttatttttaacacctaggtgcctcccaggatgtaaggcttcaatcattcaatcacctattatgcttctttccattctctcattaggtgatctcatgtatgaatatgcatcaccctcctaatcttatcgttttctcagtgtcagtagcagcctctagccctgagttagccagtagaactttctgcaatgatgaaaatattctctctgcattgtccaatatggtagccactagccacatggctgttgagcatgcaaaatgtggcaagtaaaaaactgaatgagaaactgaatattttattttgacactctaaattccttcaccttaaaaaaaaaagttttgctgtgtactcagctcctgctgctttccatcaccaaagatggaagagagagagattttgaataaaacttactcttactaaagtaaagaaagaaaattctaaacctcagatgcaaactattttttttactttattggatagaaaaatgagtttttaaagtgttactttttaaaatcttagttacaaagcaataggtaatacatttccattttatcctgtaagaataaaataagtatgaaaaaatttattgttaaaagtataacatttattcatttatttgtttaaaaaatatttattgagcacttattatgttcaagggaccatgctaggtgctgggcatcctgcagaaaaataaatgatcatccctgacctcaacacctttaacgtaatggcttcttcccccagctgtctttctttaatggtttaaaatttcaggtttatttcacccttgaaggagaattgaaaacaaaattaagaaaaaaaaagcataaatatttttatcttaaggaaataatggtttaccaagtaaactgtagtacacacttcctctagagcatttttaaaattaaatctgatttttatagcaacattttgcaatgaagaaaatgtaatttcaaaaacagcttcaaaataattcttctaactccctaacataaaataaaattggtataaagaatgacaacaatatgtagattaagaaaaatctgaattgatgtatttcacttttatcaaaatcactacaacaaaactgtatttcagtcatcagaaaatattgcatacactaaataagtgtaaaatatttttggagcccaaatctgatgggataaatagagtacaagattaagtgacaagtagaagaaatagaaatctgtaagagatgattaattattacagaattatattctcaactgattgttcttaagtataaaaagactgagtctgctgtttataaataccacaatgcttccttcattagttatcttcctctcttaaaaaaaaaaagaatatgaggttgattaatcgtgaaggttaggaaacaaatattcttctaggagtttttaaatgtagaactaactcatgattaaaataacagaaaaagtatagtgtcatttatatttaagggatacaatttttgcagagcttttaagagcaagaaatgttttttatcaatttatataaaaatatataaaaacaacatatatccattcagaaaattaaaaaataattattggtggtgtgttcaacaatatgttatcaaatagtaattgtaagctgtaattttcccattaagtagacagacaaaattgattataatggccttttttctcccctaaatattccatattttacatgttctattatacttaaggttttctttataactttgccccaaagtctgcacagctcatctaccacagtatttactctacaggtgccccaaaggacttttttcacagaaatgtgtaataactttcattatgccaacttgaaatggtaaaacggcaggggtacctaaaagatatcctagtaatatttaatgatacatcacaaaataaatatttttaaatgtttgtataaatcattcctacacctatgaaccatttcaggctaatagagacaggtgttgtttatatgtttttgctctaaatatatatatttttaagcccaaagccagaaataatataaacaaaatattttaggatttttgagattcccaatcatagcacatttctgttctcttccttcctacatgaatgtttgctggtttaattttctttatccaaccatctacactatctttcagatatttccaaccccttctttacagactgttccaaattttgttatatattacttgcactgttatcacacagagtatcctctcagaaatggataacccccaagctttctacgaaggtgataataagcttcatttcatgttaattgctttcttgctgattgtcctgtgatatctctagaattaataccattaaatcactacctatcactctattggcataatttggcttaattacttctacatctgttatctttaatactcacattaaaatttattcaacattgtttaagcaactcagacaaatttctccatgaattcctttctctttggctagaaccatttgaaaggatgattgagataacttcctggtaaagagtattgactagaattaggcctatatgtgaaatccaaacacaatattctttttaatttgcactaacatcctggaatcagagtaaagtcttgatcttaaagatcatttttaaaaataggatactggcaatatccgtaggcaccctagtaatatttacaaggatttttctttgctaaggtaaatatttattatttattattttttattattcagatttaatattatttatgatacacaaagtattcaccaaataatgttcttctattgtatgttctaatttaataggaaataatcagctagtgttctgcctgtcttgattccctactgttttttaaaataattcatgtcaacaaatattattagatacctactatgtgtcatatactttgccatttgctgagcatgtaaaaacaaagcagaaacattggaaagcaaatgagtggagcaggagagaatgattacgacaaaaaactgtaatatcttttgaaaggaccatgcaaaggcagccaaggggaaaattccatttttttttagggggtagggaatcaggaaaaaaatggtaagaattctctttttagttaggctctgaaagatatatagaaatctgtaagggacatatggtgaggaaaggtggattacggcattcaagtagagaaaggtgcatgcatgagaaagtgtatcatttgttaaagaaaactgagaaacccaattttgcaataaggaatgaatcaggcatatagagagaggaagatgagtcttgaaaggcagaatgccaagaggctgtgaaagacctgtaggttgtgcctagaaatttggacttgattctctgggcagtgaaagttttaggtacaagagtcacacaatcaggtctctactgaaaaaaaaaaaatcattcgagcacagtgtaagacagatttaatggggagatgctggagggactgatttggagacaatggattataagggttccagacagaaactactgtgggcaacaaataaggcagtagaagttaagaaggagagaaggaggtgaacagatgaggaaaatgtttagaaacaaaaattaataaactttgtagatatatttgggtcggaaaagaagagaataatttcaggagtgtcctaaggagaagaacatatcttgttcatgtttggacccattgtgtagcacaggcatattataggcattcaaatagctgagaatgaatgaatgagttacattcattcttaccattagacatttattaaaagctctatattttcattcgctaattagctcctttggataaccaaaatagaaaagggatttaagtataatcaaatgtttgacaagtaaatttgtacagggtgatttctgaggccatatatctgaaggcttttgggttttatatataagaaaactttagccttcatatatgaggacataattagtttgtactctttgagttgtttttttttattttatagtattagatgtacacagaatattcccataatcttatcaagttaattatttccccatacacaactgtcaatttattaaggaaagtcaggatgacaatctttggtaatcaaaactacacataatttacactagccacactaatgtaaaatacaaataaaatattaaaaggaataaatttaaacaagaaggtgaaagatctctaaaactgtaaagcactgatgaaaaaaattgaagaggacaaaaataatgaaaagacataccatattcatgaattgaaagtaataatactgtgaaaatgaccatactaccaaaagcagtctacatgttcaatacactctctctcaaaataccaatgacattcttcacaaaaatttctaaaaaattttgaatggaaccacaaaagacctcaaatagccaaagctatcttgaccaaaaaaagaacagtgctggaagcattatactaccttacttcaatttaatacaaagctgcagtatccaacatagcatggaaatggcataaaaacagacacgtaacccaatacaacagaatagagaacacagaaataaatccatatatttacagcctactaatgttcaacaaaggcaccagaacatccatgtgagaaaggacaatcttttcaaaaattttgctggaaaaactggatacccatatggaaaataataaaactagacccctactgatatgatttggctgtgtccccacccaaatctcatcttgaattcacatgtgttgtgggaggaacctgatgggaagtaactgaatcatgagggtaagtctttctcatgctgttctgatactgaataattctcacaagatctgatggttttaaaaagagtaattcccctgcacaagctctctctccttgcctgctgccatccacataagacatgacttgctcttccttgccttccaccatgattgtgaggctcccccagcatgtggaactgtaagtccaattaaacctctttcttttgtaaattgcccagtgtcaggtatgtctttattagcagcatgaaaatggatgaatacagcaaattggtaccagtagagtgaggcattgctgaaaagataccccaaaatgtggaagccaatttggaactgagttacaggcagaggttggaacagtttggagggctgataggaaaaatgtgggaaagtttggaacttcgtagagacttgttgaatggctttgacaaaaatgctgatagtgatacgaataataaggtccaggctgaggtggtctcagatggagatgaggaacttcttgggaactggagccaaggtgactcttgttatattttagcaaagaggctggcatcattttgcccctgccctagagatttgtgaaactttgaacttgagagagatgatttagggtatctggtggaagacatttctaagcagcaaagccttcgagaagtgacttagatgctgttaaagcactcagttttgtaaatagagaagagcatacaatttcagaaaatttccaactggacaatgccatagaaaagaaagtcccaatttctgaggagaaattccagctggctgcagaaatttccataagtaatgaggagtcgaatgttaatcaccaagacaatgaggaaaatgtctccagggaatgtcagaggtcttcatggcagcccctgctatcacaggcccagaggcctaagaggaaaaagtggtttcttgggcaggaaccagggtccccatgctgtttgcagcctagggagttggtgccatgcatttcagctgctacaatcatggctgaaagctgctagatttcagaagatgtatggaaactcctggatgtcgaggtagaagtttgctgcaggggaagggctctcatagacaccatctgctagggcagtatggaagagaaatgtggggtgggaaccccccctccacagagtccctactggggcaccacctagtggagctgtgagaagagggccaccatccaccagaccttagaatggtagacccagtgacggcttgcaccatgtgcctggaaaagtagcagacactcaaagccagcctgtgaaagcagccaggaaggaggctgtaccctgagaagccacatggacagagctgcccaagaccatgggaacccacctcttgcatcccactgtgacttggatgtaagagaaggggtcataaaagatcattttggagctttgtctgccccactggatttcagacatgcatgggacctgtagcccctttgttttggccaatttctccatttggaatgactgtatatacccaatgtttgtacccccactctatttaggaagtaagctaacctgcttttggtttcacatgctcataggtggaagggacttgccttgtctcagatgagacattggactgtggactctgagttaatgctgaaatgagttaagactttgggggactgttggggaggcataattggttccaaaatgtgaggatgtgagattggggaggggtcaagggcagaacgatatagtttggctctgtgtccccacccaaatctcatcttgaattcccacatgttgtgggagggacctggtgggagataactcagtcatgggggcaagtcttccccatgttgttctcatgatcgtgaataagtctcatgagatctgatggttttaaaaagagtagttcctgtgcacaagctctctctctttgcctgctgccatccatgtaagacgtgacttgctcttccttgctttctgccatgattgtgaggcttccctagccacgtggaactgtaagtgcaattaaacttctttctttttcaaattgcccagtgtcaggtatgtctttatcagcagtgtgaaaatggactaatacatctaccatatacaatatacaaaaaccaactttatctggaataaagacttaaatggaagacccaaaacaatgacactactagaagaaaacattggagaaacaacacttcaagacattggtctgggcaaagattttatagttaagctcttaaagcagaggcaacaaaagcaaaaatagacaaatgaaactatatcaaactaaaaagtttctgcatagtaaaagaaacaacaaattgaagagacaactggcagaacgggagagaatatttgcaaactattcatctgtcagggactaatatgcagaatatacaatgagctcaaacaactcaacagcaaaaaaataaataatccaatttcaagatgggtaaagtatctgaacagatatttctcaagagatgacatacaaatggcaaacaagcatataaatatgttcaatatcactacttattagataaatggaaatcaaaaccccaatgagatatcatcacaccccagttagaatgggtattctcaaaaagataaaaaataagaaataatgacagggatgccaaaaaaggagaattcttatacagtgtgagtggaaatataaattagtacaggcattatggaacacagtatggatgctcctcaaaaaagtaaagatataactaccatatgattcagcaattccactactgggtatatatctaaaggaaaggaaatcagtaagccaaaaacatatgtgcactgccatgtttattgcagcattattcacaattgccaagatgtggaatcaaactaagtatctattaacagataaataaataaagggaatatggtatttatacacaatagaatactcttcagccataaaaaagaatgaaatctgtcatttatggcaacatggatgagccaggaagaaattatgttaaattaaataagctaggcacacacacaaaataaatactgcatgttctcattcatgtcgaaattgaaaaagttgatcttatgttaagtatagagtagaacagtggtttgaaaggctggagaggatcatggaaggaggtatgggtagaggttggttaagggatgcaaaatcacagctaaataggaaacataagttctagtgttatatagcactgtagggtgactatagttaacgacaattatatattttcaaagagctaaatgagaggattttgaattttcccaacgcaaagaaagggtaaatgtttgaggtgatgaatatgctaattatcctggtttgatcactacatattgtgtaagtgtaaaatagcacaatgtactccagaatatgaacatttgtgtcaattaaaaataataattaaaaacacatatatgtatatatgctttagattaagatatatctatctaccatctctatatctctatctcactgggccatatactaatctcattattgacatgtttttctgattataaacattaaaattatttcatctaccataaaatttccatattatttttacatgttaaactttatttatacctgaaaaggcttatttgatagtaaaagaaaaaaagcctcagaagactgaaattattattctgcattagtgttcttctacgtggtaaaatgatacgttacaatgccccaatactgacaatctgagaggcacaaactaattattttgtgtgtaaccccagccagtttcattcgattagcttcatgaatcagttcaaaaggtgattaattggccctgtttcatattgcagaattaccatcctatttaggatacatggaaagacattgagaaactttaaatttaagtttaatcaccttgtctaaatattaaagagaaataaaaggaagggtaactgacatgcaaaccttctcttagctagaacaatttcctacctgctcttacccagtgatacattctgcacacaatatacaatatcagcagtcaacacctctgcaagtggaatacagaaactgccacttctgcttaactagttggagtgatgtgacaaggattagttatgcgtgagagggtatcagtagacccatgtggtctcaaaataatgactttccttcttaccctgaaatcaaatcatcttagctgggaatgattaaaaatatttaattattgctttgaaatcaagtatgttatttggttctacttttttcactattgtgtcatatttttaactataattttaagaacctcacaaaaaatattggtataattccatatatactgtaaacagatttatttctgagaccagaagctctcttttttatgggtaagtaaatatttgcaagcatggttccattccggtagaatcattttgcagtcatttgttttgtttgttgttcattatttttgttttatacatttgtaaacaggtaagaacagatttttttcatagcaattatgaaattaatacttagacattttaacatgggagtgccagtttagctgcctgagaaccaataaagaatttaatttcctattctcattttcacatttcatggatcgtagtttcaaaggagttctaattataagagtaccaatgtctgtcaattagtaattcaatttgacatagctagaagtacattatatattttaagcaactatgtcagttttctagagtgaaacttcgagcctattgaccccaaataagttttgttacctacaaagtttaaactgtttctttcccacaaaacaaatggtggtcaattaataatgacttttgaaaacagcaacaatgatttacatatagtcggcactcaaaactatttgttttaatcaaagatcataaaggttttgcaatctatttagaaagggaaacatcacacacacacacacacacacacacacacacacaccccttagaaactaacacagtacaaattgacagtcaaagacaatcagaaatattataatacaacgatagtaaaactctgctcttgcctagttctgccaacatctacctatgtgagattttccaagccacacacttgaaataaatgtaaagtgaagcggacagaattacaatattgaagaattagcccaggaggctaggaaataagataccttggttagcagtccagcatttatataattctctctagacttgtttcccgattttaaaaggagggttgaacaaaatgacctcctaggtcttttccatctcaagaatgataaattttcatgaagagaccaagaccaatggcataatcaaaattgctaaagttaagccctgacaacttcctaagtttgattttacttaaaatttgctgaagaaggcaaatatgaataaatgaaagggaaagcgaacagtcatggtcacagcgcacctctttgctgaatggatgaggaagcagaatcagaatgacaatgataatctatattttcatatctctgtataatttacaaagtgttttcctacaaaatatacacacacctattttagcctaaaataactatttaaaaaacttagtaagcaaattacctaggatcactaaagcatatgaaaattggagccaaatttcaaagcaaagcgtttatagtctagccttgctgttaaccatagtagctgtgactcaaatcagtacctttttctccacttcctattttcttgctcctcaaagcttcattacctccctaaccaatatatttttgtgctttccaccatttatacctaaagtagtcatcccctggctatgtgtctcaaatattgacatacatccattttattgtcctcttttccccatccacagtctattctctaacctagtttgctacaaacaaacttcgaatgttaagtggaatttcaaatagaagaaatacttgaagttcttctatttgaaattctatttaacattcaaaagtaacacaatagctaataagttaagctctgtgttctgacggcaaataataaaaaactttaagtgagactagatataagaaccagagccaccaatttctacacatcctgaaagcatcttaaaattttgcaagacactttactgttttaaatcaatgtgttttacaccaatattcaagaaactattattattcaactttaaaagcttaaaatcataattataattccaacagtagtgacttttgttgtattattccatcttcattaaacataaaattactgttgacccttgaacaacacaggtttgaactgcatgggtccacttatacgtggattctcctcaaccaaatgtggattgaaaatactgtatttgcaagatttgaaacccaaatatatgaaggaccaacttttgtatatacttggtgatatggtttggctctgtgtccccacccaaatatcttcttgtagcttccaaaattcccatgttgtggaagggacctggtgggagatgactgaatcacgggagtgggtctttcctgtgctgttcttatgatagtgaatgggtctcatgagatctggtggttttaaaaatgagagtttctctgcactagctctcttagcctgctgccatccaagtaagatatgacttgctcctacttgccttctgccatgattgtgaggcctccacagccatgtggaactgtaagtccaataaacctctttcttttgtaaattgcccagtctcagttatgtctttatcagcaggtgaaaatggactaatgcagtacattggtaccagtagagtggggcactgcagaaaagataccccaaaatgtggaagccaatttggaaccaggcaacaggcagaggtttgaacaggttagagggctgaaaagacagcaaaatgtgggaaagtttggaacttcctagagaattgttgaatggctttgacaaaaatgctgagagtgatatgaacaataaagttcaggctgaggtggtttcagatggagatgaacttgttcagaactgtagcaaaggtgactcttgttatgttttagcaaagagactggcaggattttgcccctgccctagagatttgtggaactttgaacttgagataaatgatttagggtatctggcggaagacatatctaagcaacaaaacattcaaaatgtgacttgggtgttgtcaagggcattcagtttcaaaaggaaaacagagtataaaagtttggaaaatttgcaacctgaaaatgcagtagaaaagaaaatcccatattctgaagagaaattcaagctggctgcagaaatttgcataagtaatgaggagccgaatgttaatcaccaagacaatggggaaaatgtctccagtgcaagtcagagacctctgcagcagccccttccatcacaggcccagaggcttgagaggaaaaagtggtttcatgggccaggcccagagtccctatgctgtgtacagcctagagatttggtgccctgcatcccaggttggcccctttcagctgttccagatgtggctgaagggccaacatagagctcaggctgtgacttcagagggtgcaagccttaggccttggcagcttccatgtgatgttgagcccgccagtgcacataagtcaagaattgagattggggaacctctgcctagatttcagaagatgtatggaaatgcctggatgcccaggcagaagtttgctgtagaggtgggatgctcatggagaacctctgctagggcaatgcagaagggaaatgtggggtggaatcctccacacacagttcctactggggcaccacctagtggagctgtgagaagagggccaccgtcctccagaccccagaatggtagatctgctgacagcttgcactgtgcacctggaaaaactgcagatgctcaacacccgcccatgaaagcagctggaaggaggctgtatcctgcaaagccataagggcagagctgttcaagaccattggaatctacctcttgcatcagcatgacctggatgtgagacatggagtcaaaggagatcattttaaagctgtaagatttgactgccctgctggattctggatatgcctgggtcctgtagcccctttgttttggccaatttctcccatttgggatggctgtatttacccaattcctgtacccccattgtatctaggaagtgactaacttgcttttgattttacaggctcataggcagaaggtacttgccttgtctcaggtgagacgttggactgtgaacttttgagttaaggctgaaacgagttaaggctttgggggactgttgggaaaacatgaatggttttgaaatgtgaggacatgagatttgggaggggccaggggtggaatgatatggtttggctctgtgtccccacccaaatctcattttgtacctcccataattcccatgcactgtgggagggacccggtggaagatgattgaatcatggggtgagctgttcttgtaacagcaaatgggtctcacacaatctgatggttttaaaaatgggagtttctctgcacaagctctctcttagcctgccgccatccacataaaatatgacttgcccctccttgctttccaccatgattgtgaggcctccccagccatgtggaactgtaagtccaataaacttctttattttgtaaattgtcccgtctcaggtatatctttatcagcagtgtgaaaacagactaatacactcagtttctcaaggctgacttcaggacctggtatatgcacattttggtatttcacgagagtggtagaaccaatgctgggagtatatcctaggagaaccgtactttttttgtgggcaagactgaaaactgtcagttcaaaggagaattataaacatccagcagaattcaaaattcaacacaaccatttgaacaggacaggatatatttcctttataagttatctgccacattaccaatttacaaatacaattattcaatgattacaaattgttcccttattaggaaaaaaattatcttctctctgtatcagtaggccattgttgatttgtagactgctatggggatcaatcaaatcttatttttctaaaatgttaactgtgtttcaatatttaatatttcaaaaggtgaatcaaaagaaatcaaatatccaagaaatagatttctttctttatatcatttaactcactaaaaagaagtgattttcaaaatctacatataatacagtgatggtatttttcaactactaaacatctgaataatctgattgctaaaaatagtatcctttcagtatttatagacataacataaaataatcttttaaatgtttagggccaaaaatacttcaaagttttctcacataatgaaaccattatgaaatttctacatttgaatgtctctttcaaaaacatagttttataagattaggcacttagaactacttaggacaaatttaaatggatttatatttctacactaactgtaaacttccttttcagtctatgtcctgataatgatgcatctgctacatatatattactggaactctttgaatgtcattgctagttcagagaaatgtgattgtcactttttagtggctgttctaaaaagatattatgtcttgcgttccaacagtatgcttagcaccataaaaagctttttgaattctcttatttcctcaataactgcacaggtaaatctcttacagctattcatgatattactgatattactgttttttaattttttggagagtactacctcaaatttgagaccaaacagtatatttttttaacaatatgcacacattcagatttttcaatgccttccaaaattctagtgtgatcatgcatacttaatctttttttccacaacaatttccaacactacaatggaccagtctcatggtttttggcacatcctgcacctattcctgtttctaaaatattccctatgctcctcttttcggatggaacatcagttatctttagctctttagctctaattattaatactgtattattctaagttaagtcaaactgaacttttcaaaaccttcagaagactatagcacatagtaatcctgaaattctctgaaaattctattgtacatacagtcttcaatatcacataagttcacaatatattttttttaaatgtccggtttgtctgttatacacctacaagtagattataaatttctggtgaataaaggcaaagactgctaattcattatttgttgtcacccatacccaaccaagatataattagctgtaagccctcatactgcttcaaataaagtaaagattatgttcttacaacacatctatctggaaaatagtgccagcctctctgtgcttcttcacccagtaactggcctatcatcattagctttgaggtgaaaaaaaaatacgtgccttatttgaggaacctattttctgcttactccaactacgtgattaaaataaggattgcctatcataggaccaactcctcccagccacacatacagttttacaatgagacctgggccaatcagagaccttctctgaggttttccaaattggaattaagggaagaagagaaccttattctttgaatggcaaagttaagaagatatgagactggaagatgttggcagctattgtccaactttgtagagttaatctgtgagaataacactaacacatggtgaaaagcatagatagatgagaaggaagaagagtggtttctggattttctagttcctgtttcagttatttctgaggtcccgaaatgtctttgcccgttattagctgggtaacttcaaccctttgggggaatatacactaaagggctaacaatctaaaagaagagattatggattatctcaatgtatttcttttttattgtggtcttttcctaaatttaattcaaggaacatttctttaaaaagaagcagataccaataaaagctatcaattaacatgtaaattacattactatttataagtaaaatagtgtaatagatcaaactaatactctttcctacaactaacctagatgctttataaagtatggaaagacaagaaaatactacacaggacctagacaagaataacaacattcatgtgaatctttgctatgattaacataactcaaacatgagagagaatgagggcaactactttgccttcaacccaatgttttggctagagacatatttcacaaagaaaatatgattgaagtggtgcctttgtctgtaacagtaaccttcattcttgaatcaaaattaatatcttacaatccatttcatattggagaaatgttctaactggtttttagaaatattttattacttaaatagtattgtgctcattgtctatgttcatcaacaaacttctaagaaagagactctttgcagagtctttagcctttaatcttaaaatatccctgccaactagacaaatagaaatccattaatacagaaatacaataatctactataattaagaaattgtccaaaatattcttgcaattgctattactatgattactacaaccaataaatcgagatctctgcaacattgaaaattaagtatgatctatccaatgccttcaattttactttctagagcagtcctttcttatccatctgtgcaaagaaacaacctagcttattttagtggataagaccagattgtttttaaaatctgttactataatataaatgaaaacgcacaactttctaaaaataatctattcctttttgcacttattgctgttgttattagttctggaacaaaaatcataaagaagattcaaagttacattttgcatatgtaaattattttgcaggtaatttgttaatgctaataacactgctatagtatatttaataataattgttttctgttttgatgacagccaaaagcaaatctagattatatttaccaaattatccagtcagttaacaagaaaatgaaaggttttaacacctgttgtttgtcacctcctctgactcaaattaggggcaatgtcacaagtacttgaaactctctcatacttaagtaagtaacatctattttctgtaataaaaattaggaaatccatttgtaaatcaactatcattttataactagttgtaacttattaaatatttaatcatgcaaaatccaacacgtcatcaatcaaatatgttcaacataaattaatagtgttcatgcttctcaattgtggtttgttcaataaatgagtatagtacattataaaatgtgtatctataaatattctttattattcaactttcctactaaaaggaagagacccaggagagagaggacgctaaaatgcactgaaacctaaaatatattggcacaacaaccttttaccatagacgttattatctccatttacaattagggaaatagaggctcaagaaatgtaaataaattgcccccaattgcacagctagaaagtaatatagcttatttgaatccagatgtacgtggctcttaagcctttcttttcttttttgctattgcttcctgacttctcatactccttacaaatagacagataataaaaagttattaagcaatttgagatgttttgagttccatattaaaaaaaaaacctaccttaagtaattcttaatgaaggcaaatgcagagaggtagaaagtatataattggaaagagcggtacttctcaaactatctacacgtaaaggaatagtttgttttagtttgaaactgctactctacaacactttttaaatatagtaaaaataaattactagaaaaaatgtcatgtgtttgcatgttataacaatgtcaaacttatataaaatttcctaaatagtctcaattttagtacttatatcatagaagagcagcaccaatctgtggtccatactttcagtaatactgagctatatgatgaatgagaataagccaataatgttaacgtatattaacttgtatattaaaagtatattatgcatctagcttttattgaaataaaaagtgattcctatcccccaaacaattgttgcaaattcttcttacttcattaagctgctgttcatgctaatttagtatgaaaaaacacaaaggtctgtttaagaaagttgaatatagaataaaatgtatactgtcttaataaaccaggtagagagaaaaaatggagacctgtcaattctgatgatgttcatttttgttttgattttatatatattattgttaataagcattaacattgctaattaattttgaatatggtttattattattctgtagttaaaatcatttcatctttctgacaggctcgggggtgtgaattattcttactgaatatattgataatcactgcaatgggaaaataagatgactactgttgtctttatcctttctgtcaaagctggcacataaaaagaggtttccacacttgccattttccaaaacatggcagcagttcataatacatccctaactgcattttgacaaagtgaaaatttgttttacatcataagatctgggcaatgattctaggaaaaaagtgccaattaaatgaagaaaacagaaaaacatgaaatagatttttcccatagcatagtaagtagctttgtatatcatactacataacaacactgtgattcaatttttaattttctttttcaaatgttactaaccatagagtatactttaacaacaatgcatatggtaatgagatcagtatttactggttaccttaaataattatccattttttataactttggaataaaactatcttattaattttggtatatggataaaactacagcttactgatattggaatcttcatttatttcatattttctttttctcagagttcataagatatctaatatgagtttatggtaaagttttgaattaaccaaatagcatccatcaaaatctatgcagagctatattatgaaaataacctttcatgacaacatgaaatttaaccattatatgttttaatatccatattaatcctgaataggaaaaaaggtggctttgacaagtacttcataatagctaacaaaattcaaccaattgtagaaaattccttaaaattatactttgatagtgaaatacaatattaaagtttgaaaatcataaaatagataacgaacacttttttcagttattttgtagatgacactatttccacttgattgtcccaaataaagaaaatagtaaatttgagatgatacagaagccaattaatggaccaatatgactcaaaaaatacaggcaaaatagtgatttttttttttttagtatttgctcagtgatgtcacaaatatggtactttgcaaataggggtccagtaaatgattgtttaattgaaacattttaatataggaggcataaacgagtaataaggttcaaagtagctattttctggttactgaagtgacactgactgtgcctgtctcacactggtattaacttcatattgtgttggcagagaaaagctttaactgatgttagtattactgaaatggccagcatggtatggtattagtatgtctcagaagccaaaaaaataacgtggcacagaaacaacttgtcccaagcttcaaggggggcatgggctttggagacctgtattctgtattaaaggcttctatgaataaactttctgagagtcttgaggttcctgaaggttttgtccttgtcttgctcctcctctccgtctttttgacccactcatctactttataatttccacatccacaagactctctagccttagtctctcctaacacagtcaagttcttatgttgggtaggcatttccaatagaatactccagagatatcttaaaataaacttgccaaaacataaactaatcaccatttcctgacacccggccattcttttttttttttttttttgtcaagacaaggtcttgctctattgtccttcaacctcctgatgggctcaaggattcctagcagctcagcctccagagtagcagggaccactggctcacacctccatgcccagctattggtctcaaactcctggccttaaaaggtcctcccgcttaggctttcccaaactgctggaatcacaggtttgagccaccacaatgggaccattctccatcttatagcctctatttctgttggttgcgtcaatatcacctaagccctcaagtagaaagcttacaaatctcaattcttctttcttcatagtctacatctccaacttactactagcacctctagctatgccagctttatagacaggcaacctgtgcagtcacacagagtcccttgcttggaagggtccagtgcttctctgtgctctcagttgttctctgctctgcagtcatcatgaatcacttcttaacaagaagctctgcattttcttgcacgaggccctgcaaattacagagccagtcccgtctcccatgtccttcatcctctgtaaaatatgtgttagcctctaatcatgccattaaatttctcacttccctatctttgtgttcattttccctctgctgagaatgttccatttgctgatcaaatcctcaaatacacatttctggtgccacctcctccagcaagccttctctgcataattaagctaggttaagcactcacataataattctatcatttcaattataagaatatgctattattacctactcatgaatctctttcattctatgaggggaagaagtaggaattatttcacaactaagctagtgacatgcaaaaaacacacaattatgtgttattgtatgaatgaataacatgatgaaaaaataatataactctgctattaagtcttatgaattagaacaaaagttattggggttttattttttatttaaaagaaaataataataataattgtattaccaattctatatcctaaacagttttggtatctatccacttctccctagtcccttctttacccttactcagtccaatcactttcatctctgaactatattattgtaatggactctcttgccttcccccagtcctttccccacaatacagcaagagggatcttttgaaatacaaatcagactgtgtacccatagcaattattctttgcctatatcctccatatttcagcttaaatattacttcctcagtgatgcctggaaaagttacttagccccataaattaaaacatgccacatccccaccaaacacacatacatactctctctctctctctctgtcacacacacacacacacacacacacctttaatgactttcattgcattttctctttttaacatttagctgactttgtaatttataaatttaataacttaataaagtttgtctccctcactagagcaaaaactttaagttaggaattatgtctacttggcttgctattctatcactagtatacctagcagatagtaggtgtcaaaaaacattttgtcaaattaatgtgcatagcagtattaggtaaacacacggcatagaaattttaaaaaactcaaaaatgtacatatcctgatgtcaaaatattattctctctaccctcttcaatataatggtttatgttggttatactgattcatggtacttcatattgcattgaatgaaactgcaactattttaggtatttctgaagatttctaaaaattattaggtagtgtctttgtttagattgtatgtctcagtttttccctgaagacgctattgagcagatgagaatttaagggaactaatgccaaaggtaccaaacaaaactttatgaagagtaaatactactttcctcatatatacattaacacaaattaaaaagttttataactatgcaactgggatccataaaaatattttcctatatcaaactgggcttcaaacattatttttaagtatataccctcaagacagccacttgagcatacaataactcttgcatcatcacgaagcaaaaccaaaagacaataccactctagcagtctatatagaattatgaagatcttattaactatttttagcttctgttcttttcataatggcctttggaacattgattcttccacattctaactgcctaagcgtcagtttcctcatctataaaatggtatagtaatggtacccacatcatagtgtaattaaaaagattaaatgaaatgatctatgtgaaacacttagcataatgtttgccaacttgtgagtatccaataaatctgaacaataataactactcaaaacttcattagggtctagaaatcacagaaatagaaataaaaatgacaaagtagtacaaaggtctagctggaaggcaaaactcaaagattaaagagtgtctgtgtctgtcaggcagttttactggttctcattagctactttctggcacgtttttcttcctatacttctgccactttgatagccaggcaaaattacacctccaatgtaatcagataaggaatgcgaaaggaaccgttacaattaatctgactgaaaagtagacatggacgataaatgtgcagtacaccctcaggaccacaaacactttacatttatctgtatttatccacatgtcaattaaggaaccaacttgctgtaagtcttttaataagaagtattcatttccaactaaagttgccaaattcctataattcaaatctgtatttgctggtgacttttaaatgataagaaaacatgtttttaaaagcaatgttcccttcttgaatatttccactttattgcttttgaatcgctcaagttgaaatgagacaattaaatgctgtgtctttttttgttcagaggcgagatgaaggtaatttgctgcttcatgcatctgtttcctcatcagcacagtgaggactaggctaattaggggatgaaaacaatatggtcatatggataggccagattgcttgtcactcagttattcaatatgtgggctctgttttgaggacaggaaacagataatgattctctggcatctctcttgcaatgtgtgaaaagaaagaacagggaagtgttcagatgtttacctgcttatttttagccttcatcctagaaataatcttattgggctgtgtcattcattttgtctttacaagaataatctttattagaaagctttgaccatggccagtaacatccaaagagaatgcaagaacccaatcaactaacttgagttctgttcaactcattcaagttcattattctgtaatattctatgggccagaaaaattttgtccaaacacaagtaaatgtgccccaatttcagaaagtctaatttacctaaatagatttagcaagaaaaaaattaacatttgaaagtatgagattaattacagagcttgtaccaggcatgttttctggtaccagtctgtcctcagtcatttataacggggagaattcagactcaaggacagcctttcccaggcctggcttggaaaggtgaattagtacaactagattctctttcagctatttgaactacgaaatcccaaagaaagttgaaaatatgcattgagagtttcataggtaagcacaagcaaaagttatgaataaatataaaatataagtgagcgagagtattcagtgatagaagtctagaacagatgcacagaaataagcagaaacattctgagacagagagagagatgaggaaagggaaagaacaattcctatttctgaaagctttaggttcccattgtcctgaaagttccaggtccctgatgccaggaagcctataaatatcagttccaatgggcctgaccattctggatgccctatctttgaattttccagagaccactgtctctcttattaataatatcataacctaaatgccaccaagacctccaactggataaggtcaccagtttctcaaaagataagtaaaaactggctgacataccttcatctcaaatattgtcagagactctgcatctctccccaaatctccaaagatgagtttgtgggcaggaatgatgatttagcttgtcttcttcagctctggctttgggttcccacttttcctacattctctaactgcaccctaaatttcacttacagcattgctatgcttttgttgtatcattattgccccactgggcactatgccaagcccttcattccacaaagtgtcatatatttagggatgtttgtatggctgactctattaaaatctggaaccagaatgattgttacattacagccaataacttcaatgccaggcatccctattcttaaaatttctcagtcattcttatcataaaggaacttctattcattatcttctctacttaagccccatcttcctgccatgttgacagactccctttatctcccctgattgcctctttaaagcccccaattccttatagatctcttagagctacctctttctctctctttctctttctctttctcatagccacccaggctatgaccagggcatcctatacttgtaaaccatgaaggataccaattaaaccatgctctgaaacatagtaccttgtacccccaagaggacttcttaatttgcaatttaagaaaagcaactttttataaacacaagagcacccaatattgagtacttactgtgcgccgagcactacgcttgaaagtcattaactcattaaattcctctctctctcttagtatgaaggttctattaacatccctactttaatgattaaaatttgtgtgcagctcacaatattaggaagtaacagcatctgaactagaaccaaaatatccactcacaatcaccgtaattctgcctgtctggttgccctacatgtaacattacaacaaagctgtgtgctgatgatagaaaatgcatttaaaatttatctgagatatatgtttggtggaaaccattagctctaaaactggcaagagactagaattgaaagaggtagcacacagagaggttctgatgaaagtgaatgtcattttaacagaggacttcatgatgattgctgcctaatggtaggtcatggcctcacaaagaaaatctccaatgtacattcctgcatttatgataattctacttttttctgttatgttgacaaacaaaaaaaagtcctatacgtatttcttcatatttgaacttctcaattaaagcaccattaaattctcacttttaactcttgtgggaattaattattacttagatgaagaacttattttcaactctgtctctaggcaagtgaacaacctcaaaggaagatggtacttaaaatacctgataacaatttataaaaaatattttatctattcaataaaatatgacatttcattgaacatctatgtaaaacaaagactcctgttacttgtgaaattggaccttattaatatatgtatactatcaagtacactttactggaaagaaacagtatgtaaaaagcttggcacattgaaaaaaccaaaaagaggccagtgtggctgtagcacaggaaagaggagcaaaagaaagataagaaggcaccagattatggatgcaaggctttctcggccacgatggagattttggatactgtttaaagaaacaaatataaaacttctaaggatagcttgatagtattttccttgagtcttgaaataagaactaaagagctactctattcttatcccagccattcaaagatagtgcctccttatataatgtgtgccatgcagcatgtaagtatcatgtctgtgaattgaattgtagtgtgctgttgcttgtgccaatagcagggagacaccgcagcaaggcaaacaagcaagccatatgtgctgttggcaacattgacacactgtacagttatggcatatgccttgagtatctcaaaattatgttgttggtagtttcattgctatatttgattatgtatttaagtttatttgaaggcttttaaaaggaaatgatttcacactactaatcttatgattatgcacttagcagctaataacaatgtgctatttgctggaaggaatatatgtttgtagacaagtttcctgaattagctttttaatttacataaacataattgccctctcaattttaaagcctttaaaattttgtcattttgaacaaaatttagtatgctgatgtaaagtcactttaaacatctattctaaaaccttgactaatgttggattaagtgtacatgtgtgcatacaacacatatatacatataaatacacatgtgagttataggtattgtattatatatctctttatatcacatttatgttatagaatatatctgtaaattacatacaacaaattatatcatatatgttatatatgtaagttatatatacatctttaagttatagatatatatctcatacacacacatacatgactttgtatacccatatatatgaatgctttttgaaagcagcttttaatgcattagtatgttaaacatcttccaaaggtacaatttgctcattattttatttaaaaaatcactctatgcaaattttataccaaaggataaattctaaacagaaagcacaaagaggggtactttttaatcctagcataaagagattctagtagaacatttctttctttctctgccaaataaaacaaatgagaagctctaaaagaagtcactgacccttgaatcaaattccaatttctctaataccaagtatgtgaccaatgggaaatgtaccccttgagctccaatcttttcaacgctaaaacaacaatatatttgcaaagctgcagtaagattaaaggagataatgcctgacacccagaagaagcacaacaaatactaattttcttctcatctagtttggaaaatgtcttcagcagcattccacaaaaaagtattcatagcaatgtttctcaaagatgaagtacccacaaacaatacctgcaaaccgttgcagagctgtaaagtatttaaagaaagctgaaaaaattacattttcatccatatatttccagattgacatattgcatgtttaaaagagttcagcaccagcaaattacacttagctatttagagagttattgcttttaagtcttctctatacagcaggcctggtaatggtagcagcaattgagtcttgtgcacccaaaatgtaaacctaagttaataaggcaatggcacacatcccacttctctataaacagtctggagatttactcttcagtttaggtacatttctttgaacatttagagtaaatttcaaactgtgttgacactgaccacactacagactttcaattcataagcatgttggtaaataagatgtgcttcacttgcaaatgatcgaatgctggctgagctaaatttaaaaacccaaatcaaaaacaaaccaacaaaaactcccaccatgccgctgattgaatgtgttaaagtctgcagaaataaatccacaactgagttttcttaggaaatagaatacttcttcagctactgagagaatatgaataagggtttgaaataagaggaaatgtggtatatcaatcagccataacttccacaatttggatagtattttagaattattttaaaatctttaatctcatttgattcttgccaacatcctgagatgaattttattattttacaaatgaaaacctgagactccaaaaggtttagtaacactttggggattatgcaaggtaaataaaccttaggagaaatttaacaagatacttgtagttagaaggaagtaaaatatttaactcaacttctttgtttgtttgtttgttttctgagacgaagacttgctctgttgccaggctggagtgcagtggtgctatctcagctcactgcaacctctatctcctgggttcaagggattcccctgcctcagcctcttgagtagctgggactataggcatgggtcaccatgcccggcaaatttttctttttttgtattttaatagaaatagggtttcaccatgttggccaggatggcctcgatctcctgacctagtgatctgcccgcctcagcctcccaaagtgctgggactacaggcgtgaaccactgtgcccactcccttgttattttttgacaacttaaaaatttgattaggattagataggtactagaataagcaccttctgtttcccagcctagcattcttgccaccatatagttctgccttgtgagcagatagatagaacaggatgaatggccagagaggccaatcatttccctactctcagtgagcttaaaacaaaaagacaggtacccacagagtgaccacttaacccactcaactctcaaagcaaaggtcgtaccatctgctgagcttctatccctgtcttcctgtgaaattcactggaacagatgactgacgtgatgctctcagtgctcataatttttgcaggaggaaaattaaacagataattaagtaaagagcattcaggattcataagtattgttgattacattttagaggtgaatccacatcaatcagaggtaattctcactgaatttccctttttacaatacttctttttatctaaagaaaagttatctggagtgtcttttcctaatgttagacttttttgacattaagtttttaaaaacctcataagtgctaaggacgctttctaaatttcttacgtatttgtacctagtaaatgaagttcttaactaaaatatttcagacccaatagccaatgctccacatttctccatagaaagtatctatatagttcagaaactaaatgttttctcttctctttgtctaaagagaatatcttgatttaggcctttaactccttctggaactctttcaagaagcctcacccattgactctttctaaatctgctattaatttcaaaagcatagaatctaatcttgtcatcatggtcttttttttgagactgagtcttgctctattgcccaggctggagtgcagtggcgcgatctcagctcactgcaagctccgccttcagggttcacgccattctcctgcctcagcctcccgagtagctgggactacaagcgcctgcaaccacgcccctctaatttttttaatttttaatagagacggagtttcaccgtgttagccagcatggtctccatctcctgacctcgtgatccgcccacctcggcctcccaaagtgttaggattacaggcatgagccaccgcgcctgacctgtcatcatgttctttaaacacttttcagttgcttctggagaggtattaatgttcttttacatttttctatacatatgctgtatttcaatgaaaaaaaagctaaaaataaaaactcagtgttctaaatcccagttgtgacttctggaccatcacttgaaaccttctataaaatacttgtttcatttaactaagtgaagggacaataatagaacgtaatctaaagttcagtcttccctaaactcaaagtaagatttgcttgtggatagtagttacttcctctccttgcatgaaccaagttgcttgtattttctctaatctttttatgagttacccgttcacatatataatagaatctagaaaaaatagaacatttattgtaaggtgaacatataagattgtcagaaagcatcaatattttgaggttactctttaaatgaaaggaatgcatcttttgttgctatcttaatttttcaaatcagctactcaaattctcttttctgattccacagagaaaatcatttttaataaggtaaaaaggtttttaaaatagtgttgtacataataaaagttatttgactaaaacaaacaaacaaaaacctcagtgtctcctttgactggaaaataaaagaaaactgccttggcattgcttcaaaggctttttaaggttaggcctacctcaccctttccatctttatctctgtctccttcctactcacacgacccacacgcctcaagtattctggtaacactaaaccatttactgtttctaaaacttcattttcacccctcctggacttcatttctttcacatgctgcccctgctgcctggaatgttgtggtggcccctgccttttcccagggctccttccacccacaactcttagaacatgactcgttggaccaaataaccacatagtgctccctttctctggccacagtgacaattccagagatgtgcacatcatcaaagtacagccttctgaggtcctgctccaatattttatcctagagggaacaggaaagctataagattacgatttcattaacagtaaaaccagagaataaagatgagccagaaagcagcagagaaagaaacagcgaccattttagtagcagcaagactctgattccagtcaccggagttccaggaaataccctattttctatagttttttttcttcaattctattagctccacatcacctgccctgggaagccctctctgaccatctttatttccagttctttacaaaggtagagtcagtccctgctctgtatcactatgcctctctcataaataacacaaaactgaagttatttgttttacttttctacattctcaactagaaatataaactcttggaaggcatgcattaatgtcaggcctaatgtatcctttgttcttagcacacaagagaaggctgaacagctacggaatgaattgtcaaaatgaactaaccagaaagagaatatagaaactggatgacagcagcagtaagtgaagacagcaggggaatttcaagtactccaagatgaatatgtcagtaataacatggtgctgttaaaaaatttattataaaaactacaatagttttcatttaaccagcacattatcttagcccactcaggctgctataacaaaaaataccataaactgggtggtttacaaacaaataagtttattattatttctcagagctgtgtatgccgggaagttcaaggtcaaggtacctgcagatttagggtccagtaagggctttctcataggtggcaccttctcactgtgtcctcacatgctgaaaggtgcaaggtacctctctggggcctcttttataaaggcactaatcctattcatgaggactccatgctcatgaccaaaccacctctcaaaaggccccatctcctaataccactgcctcagtaattaggttttcaacatatatattggggtgggagacctcaacattaaggccacagcatacgtgatgagaaagaacatgccagtaatcacactactactcaagaaacattggcccttaaaattgcacaacagtttggcagtttggaaactttatggggatggtggaaaaacaaaagcaaatattaagaaaaaacatgcaaacaaaataagggaggtataataataataaagagataaaaacaaaacttttaggacattaaagtaactgggggtgtataacttggtaaaatgaggggagaaggagagattacaaaaaacataaaacacatgaagctaaaatatctacagtaaaaaggcagataatgcaagatttttattagaactaaagtaaaatctttaggtcataatgcacggaaaatcaatatttctcaaataaggcgggggaggtggcatctatgagctttcaatataaataatgttgtatttgttttcatgttcagggtaatctgaataatcaataagagcatcattactctaagttttaattaagtttgccccacacttcagggactgaatttgcagctcccattgcctctaggtagtaccttttttactgtaatgtattaatgataaaagaaaagtaggagttctaagacacagataaatttgaaccaagtaaaatggggatgaaaagcacattataaaaaacgtgtagtattctggatggagaaagtggtgggaaaacaaatcatctcagggcagacagaaatataaacacaacagagtgaaatccaaagactctgggtctatggcagtcaggaccacagttaccttgtaagcagcaatttggtttcagaaaaataacactactgctttaaagtacagatgttcttttgtattctgttggttttattattttatttgaaagctataatacatttataattagctttttaagttatactactacattaaaaataacattttaaaacacaagatcttaaaacaatagtacagagaagaaataactccccactttggttttgcacattttccttctgaagtttttactgttactcatgtttgtgaaaaatatctcttaagcatttttttaaaataccatgggactagaggcaactactaaattagataatcccttgatatttcttttaattctctgattctacaaagacagtactgtgccagaaatgcttggtttgctttgactggggagagggaggcaagggattgtaacagcattaaatattctgtttaaagctgtaattcagtaatataaaacatgtcctaattatatattgtaatattttatataccaaataatttttccatttctatttccctgaagtttagaataaataaaaaataacttttatgtcttatctcatggaaaaacactataaaatccttatcagaatataaaattcactttagcaaacttttttttataggaaggaaacttaaaatggggaggtgcgacaaataaaaaattaagttttaaaagttctgtacagacagagctgaaacaccatagagaagaagaaattaacatttactacactcccaccaggttaggcatgtattttttttttttcaaaaattcagcaaatatgtgttgagaacctatatgtggctgcaatattccaagaactaggaatgcaactgtgaatataatccatattacatgccatcaaagaaatgagaggctaaaggaagaacgagagaaataacaaatgtctatttgctataatagcataaaagaggagcaccaaaaagtgcagtctaaaatatcaagcattgagcttagcctaccttattctctaccctcacaaacaccttgtgatgtggatactgttattccagttttactgatgagaaaattatgatgtatttgtcttaaatcatgactttgctccacttactttctagcttcctcaaatttttcatactttgtgtctctaattagtggcttctatatttttcactttgctcaataacacgtgctctcttctcagccaagttcattggaaaagaaacctgcattttgtcaagttgctcacctccaaatcagtcctctgaaatgtggcttctaaccctaccatttcacctgaattgctcccagttcactgataacctccaaacctccaaactctatggatgatatctaattttaattcttcttgccctctctgtgctatttgaccctttgaatcactccttttatccctttgaatgtgtgacccttggaatcaccatttgcaactcctctcttggcttcttgaataccactctgctttgctttttttcctacctattttcacttttttctaagtttcctcgctcctctctctctctctctctctctctcctctctctcacaatatgctaaaaataacattggccttttaattatagtcatccctctagttttaacctctatagtctgtcatccatattgttgtaaaaatgattttctaaatcacaaatctcatcaggtcacttcttcactaatgcctgggaatagtttgtgatctaacagaaataatttgtagacactatacttcaaggcaccctagcaaattgcagtcaagatttgggttacaaaggatagagactgactctggttaactagagcagacaaaaaatttattagaatgttaccaggtatctcaccaaatgaacagtaagtttggacaaccaagctccaacaagaatcaaaggaggcaaggccaaaattcctaccacagaaatactctctgcttataattaccccattgttacaatggtcactggacaccgatgacctcatgaacagctgttcactaccttgtctctaaactcttgagttcattgcaaatatattgaaaaatctctactgaaccttcccacttgtggtcactccctcaaactgtaagtctcagcaggaggatctaactggtcagcaagagagagagggaataacttcccacttcgccattcatactagatggccagaacctgccacctaccttttttaggataccccccaaagaagaattgcatttgtatggtaggcaattgataaaagttaattgcacattcccatatggctcaaccaaattaagtactctaaagctaaagaaaaaagaaaaggcattcagaagtttaaagaaataatagttaagtataaaataagacagaattggcacaaatgaccttttccccttatatcccacacgtagatctgacgcccatgaagatattttcttaagagtagatggaacttgtgagagatatcgtattaccaacccaacatgacttgcttttccctgtcagctcattcttagttgttttcttgtcctcataggtaacaaggcttgaggctcaattaagactgaaaacctcactaaataagaaggatacttaccaagagaaccctactaaccaagactcaagtccttatagtactttttctattgctcactcccccaaactctgagccataaaattaaaatcaacattccatgggatattcttcctcaagtccattaaatcagaaatgaagtattaagtagaggatgtttgtatttctttgggtcatcagattcaccaatgtaagaaatataaatatttatcttgctagctcctgatagccaataaaaattaactctaacgtatggtatatttaaatagaaacaattatctgaaccttaaatatcagtggagctaggacttctctttttgggaattgagggaaaaaatatatacatatatatatatattattctatagaagaacagttcagcagagttctcacatgctgtatttaattcacattctcaagtgtaaatatgaactttaagaaactgtctaataatatacaacttcctctgtgacttaaaaccaagtctccccattgcttaaagggccatgctcctttttatggtcacagaaacctcctggtctaaaatctcgagttgtcttttactacttccttcatttttctttcagtgtgtttctaacaatattatgttctaagaatattgaactacttgcagtttcccaaacccattatactgtttctagccccatctcttaccactacctagaatgatctgggctaattagaccttctgtctaattcataaatatcttgcaagagcacctttgtaaaggtttctctttcttgtctcctgggtgtgggatgactaatcattttctttgttctatctctatttcacacgcatatttctattaatctatatactatagtttgtcataactgaagtctacatcttatccattgtttcatctccagcttctagcacaatgccttgcacatagcgaactgtcaaatacacaacaaacagatcaaataactgtttgacagcattgccactgtttctctttccctctgcttttcattccttttattaatttcactttgatattttcatgccctcactgtctagttcttttccccttgtattctacccagaaaattacatctgaagttttacatctctgtatctgattagtatattattttttactctagagttaaaaaaccagagtcctcactatttaatgacagtttgagaaagtgttttgaatcaaattcaaaatgaatttttgaataaattatattctctatacaatctgaatagtgtgtgaaagacattttctataagtaaatttgatctgcacatttgatagtgttgtcaaacataaaaagtatcctaacggtcttggaaatatggtgaagttcaataatattcaagattttcatgtaaaatcttttcttgtataattaactacgggctttaatagcccttgcatagtttatgttaagagcaatcaaacagtaactttagcagtgtttagtaaatggctttaaggcctccacaaactaaataagcctctactacagtttttaaaacatttggaaattactgatactcttgaaagtgaatagtatttttgttttgaaatcaatccaatttcttattcttttgagtcagtctaaactgatttttttcagtcttctccttttcacagatgctgttattactatctttctctttttttaaaagtaagataatcaactattaaagagtagtgtttcaaggtattctagcatctgaggctgtctctgtaactaaatcaaatggactgaatgatcataagtataagaaaggacccaaacgtctgtattgttttagccctagaacttgtgaggttcgcaaatcagtttactgccaagtatttctagaaactgatgtatttgcatacagaacctattatgtataaactttttaaaaaagcaataataagaattcattttgtttcctagactcactttatttcattaatatttaacattacagaatcaaagttagggtcaacacacgacctttataactcaggatccccaccattttgaaggcaatagattcttcttacaagtacagtaacatgttgtttaatttgtgtttttccctttgtaccataaaaggaaaggaactcatttcacagaggttactgattgaattcactgctttaaaggaggtggactttgaaaaacattatgcttgaaataggtctatcttggtagatataatttcagtggaacatttaaatttctctacagagtatacggagaaatagattactgcctttcattgattcactgtctagaattttcttctttcaaaattatagtctagtaagttatttttattcctactatttaaaatctatcatttttggcatgctcatccctcagtttctacgatttcttctaatttacaaacttaggtgcaatgctgttacttattttatcaccctaagcaatatgaacattcaaaactattgacattccaaagatcacataaaaatctggattatatgaattttctaatgctggtctccatttcacaatgttcctgaataccctccctgtcataagaacagacattctttgttgtacacaatgttccatacaaagacatttataagcagattcttataatactactttaaaaaataccaattttggcatgctcttttaagcagagacaaaacagatattttgccaggaggattcagtagcagagaacaaaaataacgtaaatttggtggaatcagaaaatacatcttataaaaacaaatataaaactctgaagaaataatgcaatttacttaggtaaaatatgaaattggataggatgttgaaagctgtgtacccaaataagattatctatatcttcaccaaaatgtgaatatctaacgaagagcaacatatattgaattttaaaataatagaattttcaaagaaatagaccagattatatcatacagtgcttaatgaccaaaattagattaattttattggaattaaaaaattatagcactacctggaatctggtcattaatctaaaataaatttaaaaaataattttcaaactccataatatgtaatttcatacatgtagcaataaattattctacataaaagaaagaaaattaattgcctacatttaatattaggactggattactaagtacatgttgatttaaatgtaattgaaaatagtatggcctatgtctttatgtacaaaaatgataaatcataagcaaaataaaggtatcctgaattaacatgcctttaaaatgatcagatctaatatgtttcaactataaaactcaggtataggataaaggtgtcaggtatggagaaaaaaaccctatgcttcagttttagcactagacctataattttggaactctgaataagccatttaatttctcaatttgagtcatccatttactaaaagagaatatgtttctttggcagaaagaagctaaaagtactttatagactccacaacacatggtaaatataaggaaacaagctgttacagtaaaagtagaggtaattaattttttactccatacagtagtcatttattaaatattttacagaagaatcagtttcaattataatcattgaattttgttggggttttggtgtttagaagtctgctaacttctgtcaatgtttatttcttatgttaaatccttcagtgaacgtatggtgttaaatacattctgattatttggttcacatttcttgaaatctaggtgtacctatacttataaataataaagaaccaaagttattatctaaatactcaatagcaaaaaggctaaattttatgcttaaaatgactttagttatttattgaaagctgcttttataaatgtgtcgctatgtatacacaacacacatataaataaatgtactttattttccatagtaacttccactaattaaaaatcatcttatatatattcaaattttattaatatttaatgcaaagaaatagacaagtatagaagtgttatgtagagataatattaacatcatcaagtatttttaaataaaaatacaaacatttccaggacttacaaacatatttattatgatatggtaaatattgctaatattgtttatgtttaagcttcattactctgcaaatataacaattattccacatactaaaaaacttggctcagtatcagtcatatttaggatacagattacttcgcagacacatagttcaaatttcataaagcaaatttaacttcagcaatttttaatttatgttctttgaatttagtcaagcattaacattagaattcactaaaatcaaatcaacacaattccttctgtcttgacagtagcaatttatgtgctaacactcattaaattaaaacttttatgtaactttgccttttagcttctttatgtaatgtcttcattacaaaatgtgattttaagtagtaatctcagaatttttgttaatcgattactctcttcagtctgaataagcccatttaactttggactttttacagtagaaattagtagcacattaataaaaacaaagaaatgagtattattagaatataccactaagagaaacacaaggaaaattcttattcttattacggattaaaattcttattaagaattcttacctctaatttaaattcttattaaatttttattctttgcatcacaaagaatagtggccagtataactattatatgtatactggatacaaatattacacatagctgataacaaaggcaatctttttccacattgaaacaaggaaaaaattagtaatacagataagaatcaacaacacacatatgtctatcaaatgtactaactgacaaacccaagtaaatcaatgcctttgtgtattggttttactatttgaacatgtccttctcatcaaacaggttttattctaagtatcgtaggtatgttccacactaattgagtgcttatattaaaaagaggtaactttgaaatgtgcacacagaaagactccatagatatttctcattattgggtatgtttcaagataataaaattgacctgggattaatattaaaatagttgaatacattttttttcttaccataaaaaaatgacctcagttagaagaaattcctagggattagtgaccaactgaggttaatggcctgagactatactttaggcaattaactccacccagctattcattaatccccaggaaatgcccaggtctacaactgttactgcttaattataacccgaatggaaccatgagagttgagactggcaatgtgattcactaatgtacaagaattaagttctccatgactgctttgtacatatcaattaaaattgcatcacccttaaaaaaatccacatgcctgtatttcttttctagttttagtttataatagcaataatgacttcaatgctgggcattttctagaaattaatggccagcagatgttaatggcccttggctgtaccttgagctatctactcctccctgttagtcattaatccctatgaaatgcccagctattgcttaattaactttacaatagagttaatgcagatatgacacaatggcaagatttttatttataagcttccaaagaaaaataaaccttcaactccaaaaatacttataaaaattagtttcctatttctgaaacttacattgaaaattaagaatgggaagaaccatgggatataatgtatttaagactgcacttcagacgacctcaactacctttcaaggaaggagattctagcccatggtgaaatattatcctatttcccttagttacttatttctattgttatttaacatcatcatgtttgtcaagattgttttttcctcattaaaaccttgttgaaataaaaaagaaagagtactgttcttatgtaataaaatcccctgtctctcacccatgtgcttttcctctgtgccctgtgattcagagtttgcaaacaattccaggagtgggaatcacttagttgtgtcagagtagtttaaacttggtaagttttagcacccattcttcctcaaaggaaaaaaataaattgctttaaattatgaacctactattttatttgcctattaaaagggcattttcaaccctactagcaactaattaaaggaacactgtatgtgtcttaaaccatctggtcccaagtttgtattgacaaaaaaagtatatgtagctgaaactttttcagttaataaatacttggccccaatagaaatgtacctggcgaggcacgtgctatgtctcacctgacagcatttgtgagagccccattgatgcctaaaattagccctggcacataattatagccttcaggaaagatcagctccagaatacattatctttcctacaaaatcagatcccttaaattacatagacgaatgtcatacaggtacagaattggaaagttaggattctatttttacctattaagcgtatagactacaaagataacggtgtaatatgtagttactatttatggtgcttaataatttatacagctctctatgattacttactttgctgattctccctcacaaaaataacaaccagagatttgtgatttttgtaattatataaagtgctatttccctatatttggtattacttgatacggcatcaggtagaatttttatcaaattttcaaagattctcttagataaacctttgtattttggttgaataatagttatccaattgtagtaatgatcaaattgcagttaccaaactttcagaggttgtcttagagaaatctttataatttgtttaaaacatttcactttaaacattttaggatgtttaaaacattttaggatgaaaaattttcaagcagaaaaccagaataaagaatcagtctaaatatggaacagacaaagtatatcgattgttgattgacctggtaaaaaaaaaaaacaaaaaaacagacatacatcatgtagattatattcttcatgtgcacgtgcatgcatacacacacatacacatatataatcaatttaagtcattcatggatcttcaatggatcacaccattacttgcaaatattattgttgctaattggacaaagtattaaaaaagtagactctgataaaaacttacgggcattatatattgaacagagacatctggcaacccaaaattctgatgaactagagttcacaatagttattttttaacctttcctaacacacatattataatgggagactactataagataaaattttgtccttgtgtaacattcacgatacattatttgaagatactggtaaataagcatttgatacacaagctttattttcccaagttttagaaaatttgtcagtctccgtgagtcgtcaagagtatctatctctatgctgacttcataaaattactttgatggaaaataatatggtttaaagagttactaatgttttttcctaatcctgcttatgctctatatcctgcattttctcttctgtttcttggaccacagtcaatactttatttgctttttaaaaataactatatttttagccaggtgaggtggttcactcctgtaatcccagcactttgggaggccgatgggggtggatcacctgaggtcaagagtttgagatcagcctggccaacatggtgaaatcctgtctctactaaaaaatatgaaaattagctggtggtggcatgcgcctgtaatcccagctactcggaaggctgaggcaagagaatcacttcaacccaggaggcggaggttgcagtgagccgagatcacaccattgcactccagcctgggtgacaagagcaaaactccatctcaaaaaaaaaaaaaaaaaaaccctatatttttaaaagttaaacaaatttaaaaaaacaatatttatagtcaactatttgaatactaatttttatttaattatgtttattttgaaacaggctctcactctgttgcccaggttggagtccagtagtgtgatctttctatttgaaatactggttttattctgtttttctttatcaaaatgagattcaatcttaattgagaattctcatatttgaatcctaagttttctgtccattcattaacttagacactagctgctgaagacgtgacagtgcagtgatataggcaatgtgaatagtattgatagattgaacatgaataaacttttagccaaatacctttgttaatgatgtaagttctctggatgaaggtctagaaagccaaccacctttactttcaatctccttttggaacatacaagtcctacattccagtttcgtttcatgaagggaatattactcttcccttcacagcttatctaaagtatcaattagtcaaataaatgactacaagatctgtgaaagaaataaaaaaagatattcacatgtacacaattccaagaatacctaagggcacaatacagcaggcggaacattggaagccagtgaccaaattcagccagttcatgtgctgcttttcctgcataaagagtaaaaattgaataagttgtggacattttaaacttgggtatatttacataaaatttcatatttccaaatgtattttttgaaaaattactaaatttgtaacaataaattggcactgtttagagtccttccctttagataggaccagcactcagttcctaccacttttattgcttccctaatatattttatttagccaatcattatttacattttcatcctacagggaaacaaaagcctttctattgtgtgtgtgtgcatatctatgtgtgtgtgtgtgtgtgtatgtgtgcacagccgtgtacacaatgggatttttgatgagtgtaaagattttgtaataaccccttccccaacttcctgcaagtcccttttttgaacctccagtctttcaaatggaagtatccaaggatcaaagaggctacagctttactaaacaaagacggggattaatttttcttggtttttaatgttggaaagtgacttaccatttcccaacttgactaatttaccattatatttaagctatttaaatcctaaaatctattagaatatgctttagccaatgtagaataaataattaaaaatgcctttcaatctctagaagactctccaaaggattgagatacattcctattgcaaaaacagttcaagtattttcagttaacttctattattttcactttcttatatattccacctagggacaggattttcatcatgattaatacttttagtccaagcaattatgattaattatattatttcattcttggagtcacccaaaatgtagtgaaataatgtttttattaaaatatattaatatttagacattttgggaaatacatcaggatatttgagaattctacaagaaatgactcataatctttactttccctaccagtccatctacaaaaatgtgcttttcttcagattgaaagaccctaactactagtagtaattaattaatagtggtctaatgaaggagaagtatacaggggcagtacatctctaaactagctgagcatcagaatattcttgagtaactacaaaaatatactcctaagccctatctttgaagattctggacaagtggatctgagtaagtcaataaatccaaataacccacagcagggtcatggcaacaatattttatttaaagatcttcatataattacaatttcagtaggggtcgccggactagataaaagcaataatatgaaaattcctttcctgaattattcagattatattcataaaatgaaagttcttagttcaagtaatcagttgttaattggttttgttgaaaccgcattaaatgctacagtaggttcctaagaagtccttcccatccttgagggactctacagtctaaaacgggaagtggtgagacttactatgcattaaatagtattacaaagttcatttcagtaattttttattatctataatattaaatatataaagtgctaaatctctgtgaatcctttcttgtttcatagtggttaggtagtaccaacttaatgaagaccttgaaattgaggcagaatgttttatatattttactcttgatgtaataatgaaagaaatattttttaatgtagaggaatcaggtataaatccactgttccctatttaaataattatttagagacatgagaatatttagtcagcaacagctgttgcagtagcttagctgtgagcctgtgggaatctggataggaatgatagcccaaatggagataaaggtactggtatacgaaatttgccaaaagatgactgacagaaagaggaggatgatagcataaaatcaataactataaccatccatgtttgaaggaatgttgaagtggtggttcccttggcagagaggagaacatagaaatttggtaaagaagctggtctggtgaggaaattggattcgtttagaactgttgaagttaaaagtgatgggacacacttaattggaaatattcagaggataactgcagatgtagaaaaggagctcaagtaaaaaactgaagacacagaaaagaatagggatttattcatcctgtctctgtgcctcaagtctcagccatatttcatatgacaaatgtcacctgataagtgatttctcatgagatgacaccatacattaacacacatgttaaatacaaaacatgttgaacactgattgctaacatataatccctttccccggaatttatttttttctcatagaaacgataaagtgtagttcacaaataaatggtgactttagcatttcaaacttactttttattgatcaaatgagtaaaaggatatagactgcctcaggtaaattatctaccatttcactgaagcagtttattcacatggcctttctgtatttatttcataggtttgcataataaggattcacatacacagttgagctctccttccttcgggctagttacctagctgtcctaatcacccggtaattaaaacaaaacccactccagataattggcagttttctctaattgaaaactgggtagacaataatttggtctagggaaatgccctactctcatactgtaatatgaattaccatctgtccattaaattagccaccgtaaaatattaacatataaatgactactatagggctattcttaaagtggccctaacatttaattttttttttcattttgttgactcacccatttctttctagggaacaataaggaactgtattctagggttgatggcaggaaagggcaataacttttgtcccacaatgcagacatgttaagaatatttagaatatctaaccttgctacacaaagtatttgctctttagtgaataacatgaacattgaaccaagaagatagaacaaattacacaaaaatattcaatccatctatcaatatacagctgagagatcctaaatgcttcacatactactacacatttactctcagtggaagtaaaagaggaaaagaaggagatttaaaaaagcaacctgctaatcttagaaaatgtccagtagttcagaaaattcttggaatacacctggcatatattgagaaaatattctaactcttcaatatactaactctgttcttccttaaagggtgattttatttgaatgagaaaagggggaaattcataaatatcaaaagactctcaagggaacaatagacattatcgaaggaacaacctgattttgtgttctctgtagacagatgggtaagctacacaactctctcttcagacacatttgtacacagcaaataacaccagtagcagagtctttaattagagaggacaaagatacacagccacacatctaatgacacaaagtacaccaaagcagcatgaatatattttcctttcctggtcacaggcaatcctagcatgaaaagaatgtttccccaaaagttctctgtggtgactttctgctgacatcttaggatgcctgatttgtctgtttgctggcaaggagtgagccttgtgaaatgtataacagaattagaatgtaaactgatgatacttcagacaaggtcaaaccctgatccatgtaaatactcatcaattgattaggcagaaattattaagacactggataagtcaaacaatagctcaagagctgcataacaaatccagggaaaacacaacagcagtgaaagtgaggaaaactcccaaccacagacttcgttgaccagccacagaaaagaaattttcaggattttttatttaaaacacaaatatttgtaataaggattaagtatgtaccctgaaaatcatacctgtcttgaaatatttgctccagtctaagcatagaataatcactctgctacctaccattcatcgcccactgcaatgaaaaggttgagctccatcttggactttcttcacagaacctgacataaactttagtgtactctagagacttggtgatgataagatgttatgtttcaatacaaagacaaactccataataaatcattttatcaattaagatgaagaaagccatcgaaatataaaactacaaatgaaatgatcaaaatttatacatggccaaaaacctggggtttctgaaagttaaacagaaatctgaattttattcagttattaaaataaatattttatatttttatacttagttttaatgtctttttctcaagattattttatatacaaaaacaagtagtataaaaatcaacttatttctgttaattaatgaaaagttgtgctttccctataagtaaattctcatggattgtttacactataaatcccaggacattaaagtacagagcacatttttctcctttattaatgtataactatataatgagctatagcttattatgcataaaataattctcttttttaaaaactgctctggtgttgaagtaagctaatgtcaaattaaattatatttattaagaatcatcatagaaaaaagtgtattacttaacaataaaaattaaaaccatcattttcaaatgtttaaaacttgccctgtattgtgctgggcaatttatacaaattatatcatttaatctttatattactcctgtgaggtaggtattattttcctgttctataacttagcatactatggcaaacagaagagtaatcatttactcagtgtcacttggctcaaaaatgaccaagctatatttttaccttaaggctgactgacctcaaatcaaaatctctctgatgcaacagaacctccccttgttaaatttcctatagcagagactgctggctgttaaccaaacccaattctaagcacacagcttgatcatatttctcttagagttgggtatgtcaatgaactaaattctagccaagagaatatgggaaaaaataacatgtcatttttgtctaagagccaaccttagctcttaaaaactttccacatgccaccttccattctttctttttcattgtttttttgagacagggtctcactctgtcaccctgcccaggtatagtggtaccatcaggactcagtgcagcctcaacctcctgggctcaggtgatcctcctacctcagcctcctgagtagctgggactacaggaacatgccaccatgcccagctaatttttcgtacagacagggttttggcatgttgcccaagctggtctctaactcctgggctcatgtgatccacccacctcaacctcccaaaatgctgggattacaaaggcaaccttccattctttttcccccatttggcctcagactttcaccaggctatactgagaatctggtgcaaatggtcctagggagaaattcagccagaaacatctgcattgaactgttagtaatgagaaataaactcttactgggttaagctactgtaacacagggtttttgttgttgttttgttctatcagctagtattattcttaactactacaagttatatcattttagagttaccaaatcaaaatatgatgttaaggtttttaattaaaatctctcagttaaaacttaaaatatatttccctgccagtctaaatgttgtcctccacaatatccagtaataatatagcctcttttcctactggcaaacacaggtgttaagtaaaaatggtaacataaagacagaaaatccaaatggactgcatttatatcacttcaactgcaaatagcatctcaatgcagttttgaagtgatatctagatactttttgttaccaaattcaggtgtcaggaataataaaggaatcgtttacttgatgcatataatactttaaagaaatcagtgcaagcccccaaaggaaaaaaccaacagcatactcaggagcatatcatcttgaagttgatgtaacaatgctgacaagtacaaaagataactactttgttctgtcatgctgtgtcatgttgtagaaaacacaaagcattacgtgacctttagaggaacagtcaaaagtagcttactttgtggtatttaccacgggtgtttttgaatttttgaaggtcctgtcttttgccagttacagccagagttatgtcttaagggatctcaaacaaaaagagaaaaaaaaaatgctgatgcattaaacaagtgtaagagtaaggtgaaatactaggaggaaaattcactcctagtagaaaacaaaactatttgttaagtatctatatgtttgtagacaccttgaaaatgtccatctatttaacatccagttccaaaattagcttaaatggatgtatatgggccatagttggcctgagaccatagagagacgagtattgactaattttatgctcttacatactgattagagactactactgcaattttcctgaattctagttgtattaaactttagtataatgcagagtcctcagatatcagaaggtggtatacataagccatagattgctattaaatcttatttttagacatcatctctactcctcaaaaccatagctgcatttttatttatttattaaattgtatttattttcttctacattaagtccttaactcaaaggaataactagtatagcaagatttcagccccctaaattagtattccttaaaggaagtttatagataatcacactggaattacttaaatatatatgtcttaatctctagagtaaccattaaaaaataatacaaaaagagatcctgaaaaagcctatagagaaatagaaaaaaaaaattttcgttaatctcaaagaaggaagaaaagcatgaacaaaggaataaatgaccaatggaacaaatagaaaataattaacaatgtcaacgtatattaaatgtaaatgaaccaaactcccaaataaaattgaagatacatagtctgaaccataacgtatagaatggaatctgtttctgcagctgagcccagcgatttaaaattttaacaaatatattagttttttatgtacaataaagtttgattatgatttgattattatctgagctatttctgagttgtgtttgcatatgatttagagttaccaaatcaccttctctccaagctatttgaatagggaataaaatatggatagtatcaatgaagttggtacatgtgtgccaggaaagtaatactgtaatattttaattaaaaaaactgaaaaatatgtatgtaaagttatggttgtagatttttgtaattataactaaaatactagtaatacaatgcattcttagaaagggatttgaaacattaccagataactccattaaacaaatatacaactgtttgtttcttactcttgcttttgtttttgtttcttttgtttgtttggttggttgtttttgagacagactcttgctctgttgcccaggctggagtgcagtggcacaatcgaagctcactgcaacctctgcctcccgggttcaagcgattctcctgcctcagcctcccgagtagcggggattagagacacacaccaccatgcctggctaatttttgtatttttagtagagacagggtttcactgtgttggccaggctggtctcaaactcctgacctcaggtgatccatccccatcggcctcccaaagtgctgggactacagacatgcgccatcacacccggcctgtttctcactcttgaagagagtgagtattaaacatcaagtgaggacacaatgaggtcatatgtgtaaaaactctttgtaagcaggaaaatgttataaaattggaaagtatcattgggaaacacagtcttccaaagggtctcctgtgcatctacacatcttgctggctatgccaaaaaggcgatgcctctttatctgagctatttctgagctgtgtttgcagtgagaaaccttgacggatgatataatgtctcctacagggacaaacagcaggcttgtttgattgctgtaaaagtaggggataccccaaagtcagtgttgcctataatacaattaggcaagaaaaattcatacaagcatgccaatgcttatcttgcttgctgcaacatgagtaataaaagtcctttgtttctgactcagtactctcatatcttctgacaccatctacgacacagtacaaggctacttagtaggaggtatatagggtaaaataaaatcccagatcaaacatttaggcatatctcattttattgtgcttcactttattgtgccttgcagatactgatttttacagatttagagcttgtggcaaccccgcatagaacaagtttgtcagcaccatttttccaacaacatatgttaattctgcatctctggacacatagaattttgtgaattttggaaattctcacaatatttcaaactttattattatatctattatggtgatctgtaatcagtgatctttgatgttactattgtaattgttttgaggagccacaaatcatacccaaacttaattaataaataggtgtgtgttctgactgcttcactaggccatttccccatctctctccctctccttgggtttcccaattccctgagatgaaataattataaattaggccaattaataaccatacaatggtctttaagtgttcaagtaaaaagaattgcatgtctctcacttgaaatcaaaagctagaaatgattaagtttagcaaggaaggcatatcaagagagccaaggcaggcaaaagctaggccttgtgtgtcaaacagccaaattgtgaatgcaaaggaaaagttattgaagaaaattaaaagtgctgctccagtgaacacacaaatgataacaaaaaaaaaaaaaagtcaaacagccttattgctcatatggagaaaagttttaatagtctggatagaagatcaaaccagccacaactttccctgaagctaaagcctaacccagagaaaggccccaagcctcctcaattccacgaaggctgagagaggtgaggcagctgtaaaagaaaagttggaagctagccgagattggttcatgaggtttaaggatagaagctggttcatgaggtttaaggatagaagctgtctccataacaaaaagcaaggtgaactaacaagtgctgatgtagaatctgcagcaagttatctggaagatctagttaatattattaatgaaggtagatacactaaacaacagattttccatggagataagacagccttctattaaaagaaatgccatctagcactttcatagaaagaagtcaatgcctggcttcaaagtttcaaaggacaggctgactgtttttcagggactaatgcagacaggacttgaagttgaggccaatgctcatttaccattccaaaatcctaaagcccttaataattatcctaaatctactctgcctgtgctctatatggaacaactagcctagttgacaacacatctgttgacagcattgttatgacagcatgaatattttaaacctactattggagacctattgctcagaaaaaaaaaaaaagattcctttcaaaatattactgctcattgacaatgaacctactaaccaaagagttctcgtggagatctacaaggagaataatgctgttttcatgcctggtaatacaacatctattctgccgctcattactttgaatcaagaagtaactttaactttcaattcttattatttatgaaatatacttcataaggctgtacctgccagagacaggattcctctgatggaactgagcaaagtaaaattaaaactttctagaaagaattcaccattctagataccattaaaaatattaatgattcattggcgaaggttaaaatatcaacatttataggagttcggaagaagttgatttcaacccccatggatgacttggaggaattcaaaactacagtggaggaaacagctacagatgaggtagaaagagaactagatatagagcctaaatatgtgactgaattgctgcaatctcatgatcaaatgaacagatgaggaattgcttcttatggatgaacaaagaaagttgttttttgacatggaaaccattcctggtgaatatactataaacatggttgaaatgacaacgaaagatttacaatactatataaactcagttgaaaaagcagcagcagggtttgaaataattgattccaactttgaaaagagttatattgtgcgtaaaatgctacaaaacagcatcacatgctggagagacatttttcatgaaaggaagagtcaacaaatgaggcaaatttcattgtcttatattaagaaattgccacagccaccacaacccttcagcaaccaccaccctgattggtcagcaaccatcaacagccaagcaagaccctcccccagcaaaatgattacaacccattgaaggctcagatgattgttagcattttttagcaataactgtttttaaattaaggtattcatattgtatttttggacataattgtacactttacagataacagtatagtagaaacataacttttatatgtgtggggaaaaaattgttgacttgctttattgtgatactcagcttattgtggtggtctgaaactgaatctgcaatatctcttaggtatgccttcatattattatatagaaataaagttggatcaattttaaactgatcaaactgaccaggccatacacaaaaacaaactaataaatataaattacttatgggtttatgcattgtgttataatttagaggtcacattttatgaatcaattatcttgagataatttttaaacttctgatttttcagacacatgtctaaaaaagaagctaaactcacatttaaaggcataagtttctctatatacttatgaaaaacttatataagaatcaacagttgaaatacaattagagagagaacacaagcctaccttaaatttaatttttcaaatggtgtacagaatccaggggcatctaaatatatatcttcagaatataaatagcagtagtgggtaattatcctaatttcagcattctggaacattttctttagtagtctttctaaaagactcttaataatcacaatagcagttatgtaatcttcctcctagcatttctcttaagctttaaaaatgagtatatttttgacatttttccactattgcttttattgcatctccaaatttctttgtcattgtcatctgccaatttcaataattgattacttctatactttcatgtctgccaaaaacctctgaaaaactgtaaggctttgaattaatgtggtaattatttattttctaatgtccttaagacttataccatttcttcttacacctttccgtacatgctgaaattttagttccttcttcttaaagtttctctttccagaatattcccataacttagaagctgagaatagcctaaataaaactttgcttccagtattttgccaatccatttggaattgttgatgtgtaagtaattaaaaaccctactattcatggataaggccaaagcaaataattgtaaactttttaaaaatctcagagtgaaaatatgtgagagtaaatgagattcggaagtttttaaatgatatgttgtacaatcattttcccattatgactcttgtgtccatttggtatgtgtttttcataagattgctttcgtacataagtgatactaaggtcttaattaatagtaaggcggtcaaattctgttggtgttattattgggcaaatttcaaataccctcctcagcctgtaatcacgataggttaacaatcttaacatatttatttaattttgtataaaaattattacatgttctgtgatcctacatcatgcattgttactattaagaattacctgtaaataatttaatttaaataagtttatgttccatattcctaatatagaatatgaaaatgggaataactatacctaggctttggagtcacacaaatttcaattctgcctcctgttcagattcaaatgaaatcttgtttatgaagcatctatcacagagcccctgcttcagaaactgtaggaaaagccaccattgttaccattgatattgttcactgattaaattattagatgtataaaaagctgttgaacttacagtcagttagtttctatgtattaagttatgatatgagtttcattttcattagtgcttatctaatccttatgaaatattttattaaatttgtagtcttcagactactttcaatgcttaattaacagttaaccatgaaatatcccaaaattttgttgtaaaatgtcagcacgtagcatgtatttatcaattagaaacattttaaacccaaaaagatataccacagctatttcagttcgccttgcagtcaaatgtatacactaacataaatagttacatacagaacgtttaactactagacatgacacagaaaggtaagatgtgtgtgtatatatatacatataaatatatatatatataaaagcctaaaaacaccttccatcctaaccacacagtatatatatatatatatatatatatataactactcccatccaatgtattcatacaacaacttgagtgatttccaatactattgcacaatataaataaaacaagtgtacagaaggctacatgtttatataaactatagaagtaataacctggtttgacaaggtgcagaagaaaggggaaaatgtctacaggtaggtaaagcattttaaaacacttggagactaagaccttactgaccttgtcacctcacatcccacttttctgttttaaataggatttggctaaagggttttccataatccaatgatatgattttactgggcatttaaaaagttataggaaaaacaattaaactttaaataaaacatcatgtcatggtaggatcaaaatgaattatcacgctatgaaaatccttaactaataggagatcacataattgtgagtagatagaataacagggcacttcaaaatttgtacattatacttatctgattgaaaagcctaacatcctatcaattttcaacatataagtgggacatctgttaacatgacataatatttcattcatattccaccaataaaatgtctatctggaaaaataatctatgaaacaaagtaatagccattttgtagttcaagtgcccgttaataaatagaaaactaaagaaagattattttccaagtacatgtgggatccccaggaatgtccaacgacattattttcatgactatttgatttatagccagtaaaattataataacaaaatactaataagaatatatgaccccaaaaatggaatgcaatgatatatgtaaatgactaggccaatttcttatacatggcatgtactcaaaaaaacggatattttagacaaggaaggaaaaagttaatattctttctctaaattattttacctgcaaatacactgaaaagattgacataatatagatgtatagaagaattaaagatgccactgtaacttttttgtcttgtcttacctcattttagaccttcggcaaacagagtatcttttcattgaaagctgatgagcattccctattaggcttccaaaggaaacattttgtgggcacaaaacaccttccatcctaaccacacagtttttatgagaatcaaatagcttcacctaaaattcaagtgcagtgttcagtggataatcaacacttaaaaatgggcacatccaaagaaagagtcgcttagtttattatttctcttgaaactattacaaaatttaggacaattttaaagcacaatgaaattatattattgtacaacagcttggtaatttataactgtgttccttataatcttaggtaacctaccagtcttcactctttattttcacgtctctttcagaccaagattctgtgaaacgaatagatacttattttttttcaaacgtatttatttctttctaatgaccaagaagggggagtcaacttaaaggaagaggaatatatttgaatgaatctgctacttaggtaactgaacaagtaagccaaggtattgtaattgaacatttagggcttgtattaagtaaaataatttggccataaacgtggcttaaaaattagagatttaatgtcttgcatgtaaaaattcagaagctcgacaatgtcatgaagaatccattttgcctttttggggatggcattcgtgtcaccatccagtaccaaaggatgggctgccagttccaggtgtcatatgcagacataatgatctttagctaaaatgggtagtgcttcccctgtgtttctcttttcattagagagtttctctggaagcctgccagatttcccctttcattgatcagaattctatcccattttcactactgaactggcatgagaaatgaaatgacgataataggcttagaacaataatgattctctccccagggatgggggacaattgaattaaagtttattctgccagcaaggaagaggtaaaggaagtaatcattgaaataccctctaatagtttctacactacacctttggagtcaggggaaagttgacttaaatcctgacttcatacctttagaactctttatataagtacttaacctctctttatattgggagaaaaatatacatattgagtatatatatatatacacacaaatatatatatatacacaaaaaaaaacaaatatgatacaggtattttaaacaggtctgtgttgtcaggaatgtgtaatttatgcaaaaatacctagcacagaacctgatacatggcagaacccaataaatagtatttaaaactgtttgcatggtttttgtttgtttgtttgtttccatttctaggccctcctcatttcttgccttctcacaacaaagcccaatacctttctgagaagtatggcctaaagtgattattcaatctctgcaaaattctcagttttaaaaagtattttacttgatattttcctatttcattctgcatatatcaccgactattagggttgtcaaatactagtttgatagggtatcatgcaccttgattataacacacataaattttccttatcagataattccataaatcaaatcagcatataaaataccatcaattattttaagaaaaaaatgaaagaggaaaaagaaaagcccctagcagaacatgaaagttcccgtggcctgtttctacatttcactctcttcctttgtgcctgacatctttatgctttaatcactctaaataaattgtccaaattacatcttgagattatttctttcaaaactattgttgcagtttcccctatcagaaacatcctccgcaccacttttccactcttcatctaattcttatcatcttcataactcatttcagaaactgtctttcccagaagagttttccagactttagttatactaagttattccagagtaacttttgcttaccatttaccataaaatttggaaagtatctatttttgcatctgtcttcctcactagattgtttaataaactcctgatgcctttactggtatggaagtagccacgcaataagtatgtgctgaatgaaatgaaataaattgatttgttttatatattcagcactctaaaatggaatactaaagacaaatctcctaaaatactgagatgataaaaaatagcattaaaaagttaccgcctttatagaaaaatacagtaacatttcacaagtatttacagcgagtgaaatgtcatgctaaataccttatacatatttttcaatttagccatcagaacagccctgagaagtaaaagtatcttccccattttaaatatgagagtaaaacacaaagaagttaattaagttttcaaggcctggcgtggtggctcacgcctataatcccagcactttgggaggccgaggcgggtggatcaagaggtcaggagatcgagaccatcttggctaacacggtgaagcccgtctctactaaaaatacaaaaaattagccgggcgtagtggccagcgcctgtagtcccagctactccgggaggctgaggcaggagaatggcatgaacccaggaggcggagcttgcagtgcgccaagatcccgccactgcactccagcctgggcgacacggcgagactccgtctcaaaaaataaataaataaataaataaaaagaacaatttaagttttcaaagaccatacaactagcaagtcccaaatctgaaacttgaactcaggtttgtcgactctaaagtgtatgttttagttactacactccaaaatacagaccactttccacatgctactttattttttacccattcctaataagaagtggtcttaaatagctccaagtcatctaaatttcataacaaaacaaaacaaaaaaacacttctatagacaggagaagacatgatagcattttgttccaattcacttttttctcactttatttaaaatcttgtttgctcactatcaacagtaactgtgtcaatgcattgcactgaaattgtgtaaaaaaaaaaaaagctttgctgcactgtgataaaacttcccaaaaaaccattgacaacatatttccttaaacaaaatgcccaactttttcacatggtaaaagtatttttcacatacttaaaagtagaatgtcaatgattacatttgttacaaataaagttaacaaggtacttaaaagtaatgatataaatgcctataaaagttacactttattgtttaaatattatcctgtatttacataatttttcagcattattcaaatacattagttgtcatgtatacccatgaaatattatatacatacatcaactctagtaatgtgtgttaaaataaattcattgctaggctgggcacggtggctcatgcctgtaatcccagcactttgggaggctgaggcgggcggatcacgaggtcaagagatcaagaccatcctggccaacatggtaaaaccccgtctctactaaaaatacaaaaattaactgggcatggtggcgtgcacctgtagtctcagctactctggaggctgaggcaagagaatcttctgaacccgggaggcagaggttgcagtgagcagagatcgcaccactgtactccagcctggtgacagaccaagactccatctcaatcaatcagtcaatcaattcattgctacactgagaagtaaactgatgcaaaaggaaaaacaacagaacagggagaaagcaacaacatggagtcggtcacaaatacatattattgcaaacatttcattaattttgaaagattaacagcttcttgtatgagggaaaaatgtgaaaatatttttaaaaggagcatatatttaatttctaaatatagtagtaaacattcactgatttatataataggaaatataaaatgataaaatagaaatgactgcaacttcataaatgtcaaaatctgagtatgaaggaaaggaaagctgaaacacttttggttatgtgtgcatatggctcagtgctttgactacacagaacacagagattacttgtaatggtgaaagtattaatttatgaaaaacattttcaatatcagttcatcactattcagttaaataaattatcatatttagcaattcgtacatgagagcaggttggatttttaaaaatacttaatcctcacataactggtttgtagtccacagattaattgaacattcaagtttacaaatttgaggaaaaaggaaagaaaatctttttatttccttttcagtgttaaatttaaaaaagatataataaacttaggaaatataaatgttttaatagaatctcagaattcatgctatcatataaaacaatactataaaacagatattttaaaatcaattaaattaaagataaccctcagtatatataattcttaagactactatatccaggaaataacatttatatttcacatatctctatatgaagataaaaaataaagaaaaggttcactagtatattgatattcaaattattcattgatatttgtattcacctaagaaaacttaaattttaaaaaaacaaaaaaaattttgaaatcaattgttaaatgggtagcagcaaagtaaatttacgcaaactttcttcagggtaatgaaccattaaataccaaaagcttaaattcttaatttttgaccttgcaaatatttattctgaggaaatcataattacctgtaaagatgtaactcaaaagagttatctccagcttcttaaacataaaagagtaattaaaaatgaaaaataaaacaataaaagcataaaggacaacattaaaggaagtgaataagtaaactgatttcatataataattctaaaaattgtatcactaaatgtgttggtccaaataagaatttcagaaattaaaatttggggtataaaataagtacaaaacctggttattaaacataatagaaagcatatcattttgtaagtagtactatagacacacacacagacacatacactcatgtgcacatcaagaaagtatttacaaacatgtgcaaaatgttattagtacaaagtactaatagtagtgattatttctaagtgataagattacaaataatattttcttcatttttgctatatgtatttctcaatatttctgaaatatattattttaataataacataaaagttacctattaaatgtacaaaataaatccagtataagaactctaaagtgatctattatttctcctccatttgtatggagtaattctttgggcagtagaaaaatgtcagacaacatgagttccagtctctgccactgactggcaacctattcttaggcaaataacatctctaaatcttacacttattttctgtaaaataactggaaaagatgatcatataagagctcttccagcaaacagtcccatgtctcatatatattagaaacagagctaacgttaaaatgtatttaacacagtgagaaaataatctgcaacctcattagagtgtgttgaatttatatgtgtttatgtttaaaatcacccagatgttgtggatatttaaagagttgctgctgatgttgttttgtgaatagtgaatgtattaaactctatactcttgacgtcccatatagattcaaatcattgaattaaggagctagggccaaatattcttggtctttgtctttgtacatcaggctgtctgatttcactgctatgcaaggcctgtgaggtattgaagaaatgaatgtctaggcagaatgtgttgaatgtctatgcagaatgaactgaattccattgaactatgtttgcacgacttccacaaatttcaaagtgagataactcttagtaaaggctttaatttcaggcccacaatcactgcaaaagttttctatattctctccacaacatctgttcaaagtcttagaataaaataagagtttgtgaattacagatgaaattcgaaattaacaaacattttgaaattttcattgagaaagaatttaaaggccttaactttggtttgctcaacagcatatttcttattcttcctttctttatacaacatttccatgtttacaattcatggcctgtgtcagaaagagtagacagcaatgtgaagtagatgatattgtcttatcctgaattacagaagtttaaacatacattgcattcttgcccagaaatggtatttgtaatgactgcatctttatattcaatcagtaaaaccttttcagtacaatatttgggcaactgatgaaacattaatagaaaattatatagaattaagggacatggcaaaagactgtttactatattcccaccacaccattattatcaatgattatcccaatacttagagtacaagggttatttgcaatgtgttgagtggtaagttcaatgtagtaaaaatagtcagttgaaactcccccttgttagcatgagagtgactgcattccaaggttgctcttttctttcattctcttctttcttcttctccttccagccatggaaatagagttcagttatttctgcatggatgcaaggtgaatgaggctgtcgcttctccttgcagtgctattgattacaggtcactgacataatacagctattttttaatgaaaaaagttatatagcattatctcacttacttgggtatctgaaaggaatgtgtggagtgttatttatttatacagaaatctgccaaatgagaggcatcatcttgctttgaggggcctcctgctggcaaagtgagcaaccttgttattataagaattaaatgctgtacactgtatgaaataaaacacaaaacaatccttcagagtagagctgtgctgattttcaacctgtaaaaatacattattctaatataggaaaacttagaaaactccaaagtgttattaatatcacttgttaaggccacctagttttcattgttctcaactacaagatacatatttaatttatagtttctgatgaaaatgtcaatagatctatttaatttgaccataaatcagtctaaaacactataagctaattgataaggaactgattttctagataagcacaataagcacacgtcagcttgcagttttcaagggacatagtttgtacatagaaaaataaccttagaaaacataattctaataattgtctctgatctcaatcatgagagtaattagttcttccttcataaagccgtcactgcaaattatattcaagaatgaatattatgtctcagttacaaattatatgatttaatctcaaaatttcccaagacccatttaaaaaccttgggagataactgaacatttaataacgtcagggttattaaatatccttcaacatttgcatacttgtaaaaactatatagcatagcaaaaggtactaacagaattgccatgatgcatgaaaccactaagaatcaaatatttgtgtaaaaattaaccatttatggtaccacaagcccctattagaaaaaaatgtgatctttttttgcgaagatcaatcttgacaatctacttatacttaataatttccaaagagtttagaaaacagacagcccaagttgttaaatgcacttgtttagagttaaaatacaggaacgggaggggaggaataagtactgtgttgagataatatctgctaacacagtatctccatccaatatctaactccttctggacaaacagtgattccagggagaaagtagggcagggagtaaatgtcaggtctggggacctgaatagttgcatgtcaggcaataatcctagagaagatttttttcacagtcctgagactactccaaatagggatcacaggcaaaaaggacagctgttatatcatctcccctgaaaaaatgttatatgggactattactaatgccatcctgtgtgtacccagaatcacaggcactggtgttctaatcaagacttctgactgggaaaaatgaaaaacttacaaaacctaaactgcgtttctacactctttttctcaaagcacaaataaatccagagaggcttactagccttctcagaaataagaatgtagtatagatctcagtcatccctgaattgtttcttaaaagtacaacaaattctatttaatttgaatgcttaaaaaaaatcttaataccattagaaaagtgagagacatgattcaactttgagttacaggttttatgtaatataaatacactaaaatttaatcaagcaatatatacaatttcccaattatcttcctggaaaaattacaaatcatcatattctttttcaagaatgtattgatggctacagtggtctgggtaatattaaagctactgcacaaaatgataaaggataaataaaatggctgttagtcatgaacacagggaggggaacatcacacaccagggcatatcagggggcggggggctagaggagggatagcattaggataaatacctaatgtagatgactattcagccattaagaaaataatgaaattgtttcatttggggcaacctgggtgaatctgtcggacattacgttaagagaaataacttaggcacagaaaggtaaatacaaggagctaaaaaaatgagctcataatagtggagagtagaattttggttattggaggctgggaagaataaggcacaggggaatatagagagaggttggttaaagaatacaaaattatagctagataggaataaagttctagtgttctgtagcaatgcagagtaaatatgtttagtaatttattgtatattttcaaaaagttaagagaaaattttgagtattcacaattcaagaaaatgataaatgtttgagttgatggataggttaattattctaatttaattattatacaacatatgcaggtactgaaaaatcactctgtatcccataaatatggacaattattatttatcaaccaaaaacaaaagaaacatatatcaggataccttaattggaaaaatataatttaaacatatttgtcttaaaatatgttgttaacacttctgtcttctatttatgatcaatcattggttaaacagaatgtcataataatgctaaataatacaacggatggaggaaaatcagttgtattgattttaattatagtttaatactccaatttattgctttgcagtaaagtaaaaagttgagttgaaactacatgaaaacttcatcccagtctagttcaatgcctgcatctaaaacacatttaaaatgtataaggttatttgcatgtaaaaattattttattgggttactattcttgcacataaaaatttcggtaattcaactactacattaaaaggtttttatcttaaaggtatagctcatggtttgtcccagaaactgatggaaatctaatcacacatccccactgcccatattgttctggagcaccacctgtcagctgaataagataatgacatgtggtggagcttgtatacaaaatttctacctatctctcagtctaaaaaaatagctttcattgttaaatttgttcttatcttttgcaaaaatgaagaattcacagcatccttgaaaaagtttccacattggttgataggagaaataactttttagaaattctaacccacggactgtagggagtttgaggttgttgcaaaaaagcaagcactcaactgtagaagagcagaaatcgcccttgccattactaatatcttttttaagcatgtacggttttgtggcacatcaatgttaattagcaagtggacaccactggcatagctctgtgaagtttatgatgtcatgcatagcctttacctgattccttaataaatgtgaaaaactgtaatatagggaaagcacttaataatcacaacaatttacagattatcttctatgtgacaaattctgtcagtgtttgtgtatagatgtggatgattctgctctagcatgcagaaatttttccaaaaatacattcagtcatacattgttttagttgtgtcctatattgaagtttaaatgcctataaaatgtaacataaaaagttatctcatgaatttgattaaaaaccattttctcttgaaggcactttaaaaaacaataaggatgaaaggacagaggatttgagtttgccaggtaaacataaatctttggaacaaaactgtctctctaagctctttttttaataccaaaactataaaaacagaatatgaagaaaaaaaggatttgagaaaactgcccttcagagagagccaaattcttcctcaaatagtctacttaaagttctcatgacagtccatgtgtacaataattctataaaccattattgtatcacctgtttatattcataggacacacaaaagtcaagttcaaattatgaaaaagagaaagttcatgctcttctcatatttaacgttttctaactttaaatttatgatgtttctattttgcctttaactgccctagttctctcctactactactatagcatacaaaatataattaacatttattgggcacttactatgtacctgatgctattttatatgcatttacatgcatttcatttaaccttcacaactatgaggttaacattaatattcaattccctttttagatgggatgattgaagcttaaaaagattaagtaattcacctatactcacatggtggactcaaacctgcactatttaaattctcagattcctctattttactccttgcaaagttttacttcgcatgatcaattccaaaaagttactgcaatggttactctatttgagttattataaatataatgaaaccacaatgttaagttagaagagtggcacctattgttaatatacttgatcccatttccatatttgatatattcacaaatattcctggttatttagaattattatgagtatcaagcaaaatcactgtcaatgacctaaaatacttaagaaattcatctatgttgccagcatacttcttaggagttttcatttatcgccatatataaaatgttgatatttagactatgtgaatttaataggagcctaggcattgctgatcagccacctgcacaagtgtggccatttgcaagttatttaatttctccgagcttctgtttccttgtttgtaaaataaggatggtagtgtccatattgttaaggtcaggtgagatattgtataagaagtgcctagcacacttcctgatacagttggcctttaataagtactagatattatgatttcttggctttttaccaatgaagagttaatgtgtgatgtacagaagtttataacaattaagataggaaaagcacattaaattatgaaaagcgataagtaaaacgttgaatagcttgagtcggagatgctgtgacatatccaagtggagatatcgagcaggcagtagaaacaggaaggtttagagctctgtataggggtaagagcttagaataatctacgcagaggtaagacaggggagggcatctggacagtaagaaaaagatgaagaggaccacagccagacagaagcattggatagacttacttcttgttgagtgcattacctttattcattgcctccttaaaaatagtaaattaaaatctaagtctaatatacacccaataatagccaaattgattgttagaatatcgcctctgttgagaaatagctgtgtgatttgtccaattacataactgagtctcattttctttatctatgacagaggattaataccatctaccacgcaggtttaaggaggcaccagacgtaatgcataaaagtaccagcaacgggcttggtgcctcctggcattaaagtggatatagactgtagaaagtgaggagaggtggtagatcagaaagcctaaaacagaacgtaggcatcacagaaatgcagtcttcatacaggggaaccaaaaataatgttaaaagaatggccacaaatggaaaaagcaaaacattttatttagaaggtttatagtgtagatccaaaagtggtagtaaaagagaaatgtcaaaggccttaaaatatttccaaagctgactaataaaggtctactttatttgtaattacgccaggcatgcatatgtacatctgtctttttatctccttttgattttcagtttccctaggaaagtgcttctcttttgctgttatttcttaacattttatctcccagccacaaatgcaggcccagttttctaaattcctgctgtgcctaactatgttcccaccttcctatatatttctccttccagtttagttaaatcagtatttagttataaatacctgctggcataaactgaagagcaaagtaaagtgtatatattttaagcttgtatgcttatattctctattgttttttaaattgagaatgattaattggtgataatataatggatcagaagtgtgaatatctaatatgaagactgttaagaaaaaggcaaaatgtttatttaagaatgacaattaaaaaaaatccttcacaaatctactaatctatgaagagcaggtaggatgatgaggagcagatgggtgggaatcctagccatagagacttgaaggatgggtttcatctgctctaatttttagaggctatgaaaagatacttgggcacagtgtgcttacgacaagttctcagaaatcacagaactcaatcctcacccccaacattgtggaccagttgttcctcagctgcctcactcatttcttatcatcatagaagaggttagatcagagcttaccaccccacacatgaaggaactcactaactcctgggacagaccattccgactttggttagctccaggagaaactccttgatggtgtttaactgaaatctgatgccttacaatttcaaacagctgttaatgtttctgttctccaaggctatacagaacattgctaatccctcgtatatgtaacagccctccctagctattgaagacagttatcatgtccccttcccaagcctcctcttttccatgcctggcatctccttatttctttaatcattcttcaaattaaatagtatgctattattctgttgtaatatgaaatttaaaaaacacatgtccaaatctaagttaccaaaattataataattaagctgacgttcataatttctaccataatattgtattttaactttgtaaaaataaaagttttaattttaattttttcctctccttatctaccacaaatgaaaattgtagatgtagtgacctccagggatagtcccatatctaatacacacacctgcagcagctaataccttgccaggtaactattcattctgactaataatatgagcatgtgatatggttatcaccacatagatgatagtcatcatatattcaaactattgtgagtacttgcagcctaatttatagacacaaatgacccatcagcactcatactcactcttgggaaaatgtatagcatttgctttaaatgtggacagaacacccctgtccacatactaaattacatgggtgattttctcctaggcctcactcatatgattttctcctaggctaattcaatatgtgggcagtggcatcctgtctgttgtgtttaagtcattttttttaacttcaactcacataaaacaggtgtctatgctgtgatacacttatctcagaaaaatgcatttctcgaaccggctaatacttaattgtggcaaagttactgtgacactattcatatttctattattttaaaacacttatggaaaaattatttttatatgtaacagtaatatttacagtatttagtgaccgtaatgtcaaaggcacattagaatggatcatagcatatgccagagaagagatatgaaggtccatcattgtgccacgtattaactctttacttgtttgattgggttaagtcagagaaaggggttccagggaaggtaccagggaaactcaatcaggtaaaacagcatttcaatgttttaacaatcagtaaagttgtaagaaatacactacttgaatattaatcctggtatggaatatactttgttcatcacatcctacacaagggtttacggaaatttgaaaacgtcaaaaagaggctccacattcctagtagaaagaaaaaaataaacagtaaagttattttttttcatatatttgagtagaaaagcattggaaaacatttcaccttgactggttacaaaatcaaagatgtcttcaagtttaaagcatacatgtgctatcagcacatgtacaattactgaaaaccttaatcaacagagaagctatctgaaaaaaattaaccttgaaataaccactggaaatatgatgagatgaacaattcatgaatgagaattattctctacagtgaacttgattatggagaatatagtctgaagtcatgacaaatccttaacagatatataaataacattacaactctgaatactctacaattcactgtgctacaaaaggctgttaggaacacatcttgacattccccaatatagatattattgtacaaattccaggttttctctagaaccacatttccacaaatgttacacatctggtgaacattttctcacactagttaaacctcattaagaaatttcactaaagtttactctgttggataatacttttccacaaaaataaggttttgagttttgtttgttttgttttaagcaacttcctgattattacagtggattctattctgttggctcatctggcaggtgaatgactacttttagaatatgaaattctaccagattcaaatcacaaaattatcataaaataatgggatttctgactgactcacaagtagtaaaactcttgaataccaaaagtccactacaaatgtccttgaaacaaagctattactgatattttgacatacaggtattttattttctgcagatctggaacaattgaaatatttttggttctccttttttttcattaataaatctgccttcacagagctcatcctgccagtaagaaatatgttacttatagaaatttatttttatatagcctataaatattgagtgaaagctgttaaactgtgggagacaaacttcatctgtacttctcaaagagtgactgagtcagtttgtaggagtgaaatagcatgtatcggatctaaatttgccaaacaaaattagctacatgccattctatttgtcttatctttttctctggctcatggtgtgctaattctggccacaagcaatacagtaagcacagaaaaaaataatgaatgccccttttaccaacagttgcataaaatgttttgtctatttcaatatatcttgaagctttttatactttcaatttttatcctgtatttagaagaaagaaaagggccactaaagaattatatctgaataccaatcacttcaatttccattaattccgaatacgtttttaaaggtttcaatatatcaccagggacaatgggctgctaaatttgaagttaacaactgggaaatattattaactgtttagttgatatttttttaaaactgtgacttgaaatactaatctttttattgtttcttaaatttgttaacatattagttaaaaatattaccaaagatctacactctctattattttaactgaaatgcattgtttcattcatggctagcaatggtatctattctagttaaaattttttaaatgacattaaaagaatactttaggtagtaaaacattagtggatgttaattgtctccccacctatatttatgggtgttagcgcaactgctttgctagttgcacagctgtattatcagagtaaacgtgtatttgtaaactgtatgggaactaaaaattaggaataaagccattttcttattttaaagaatggtcacatttaacttagcctgagggtaaaagtcaaaagttgacttttatccactctaaataacaaatgattaaaaatccagcgagtccagtaagctatatttcaaggggtaagaccttaataatatagctcttgtatatccaaactggcagggttcctttaaagtacatccaaccattataaactacagtactgtgtaagggacagtactaaataaaccatcttaaaaacataatgtcaagaaaatagatatatacctggattaggcatactcatatttagagagaaaatattctaaaaattatctctatatagtacattatttcatccaaagatatacccaggtactttacagtgtgattttacactacgtaatattaggttggtgtaaaagtaattgtgatttctgccactacttttgcaccaacttaataattttcttccagagcaatgcattcttcctcattaataatggacactaactacatgcactagaaaaaattacaaaaaaattgtataatgacacccaaaattcacagttaatggaagagcaatattcctaaaatgtgtaattttcaaccataggcagacttaccacaaagtttctaaaacagcttcagcttcagaacccctctattgtactggtacttcacaagaccctgtacttaatttgtatttctatttcaatactgtttttaaacaggttccccaagttgtataaatgcagatccccaaatcttttatttatttatttatttatttattattatactttaagttttagggtacctgtgcacaatgtgcaggttagttacatatgtatacatgtgccatgctggtgtgctgcaccattaacttgtcatttagcattaggtatatctcctaatgctatccctcccccctccccccaccccacaacagtccccagagtgtgatgttccccttcctgtgtccctgtgttctcattgtccaattcccatctatgagtgagaacatgtggtgtttggttttttgtccttgcgacagtttactgagaatgatgatttccaaatcttgcatacgcccctgattcgaagttttctcaagataaggcttaaatggcaaagaaagaaatctgaagaatacaatggaggagggaaactacagggtaacctaaagtagaactccttaactgatagatttattagacaagtttcttcatgtagctatagggaaagcaaaaagagctgctgacctgaaggcactaagatctggcatgctaagcatccctttcttgcacagtgggcaggtagagtggagaaaccatgcctttgagaagcataactagcctctgccgccgtgagaaagtcgtgcaagaggctgagaagcagaaggcagagccagctggctctcaggacagggcagatatgtaactggaccagactagtgcaccagttaggcttcaccattacatactacttcgtatctctagtccctcatctacaaaataggagcatctacaaaataatccctgactcaaactttcttctcatggattcttaaagtaaaaaaggtcaggaaagttctaaaagaacttcaggcaaagtttctaatatctccattcccaattttctcattaatagattactcggcagactgttaggtaattttgaaagttacattaactcttttaggcaaatataaattaaggtacaattagtgcaccctagtggcctagaaatgttgacagttctttagaatctggtaacctgaaaagaaatgtctagaagtgcattttccctggtagactctgactctataaataatataattatttcaccattttcagaacgtagagtgaatcatctaaaagagcaactaagagaatccccatcacctctcagttcagttatactgcaagtgcttcctttataggatccttttaaaatggtaagcatatgtctagttgtctattttaagatactgagaaatcttagctataacaaagttgtattatcacatatatctaggaatagaaaatgccagattctatctggaaccctttttcatgaaatatttattaacattttatctggaggcaaatattcctcccaagagtctgcaaaatcacttaataacatatttttgtattgtgttttattggcctcatctattcttctttaaagaaagaaaaagctggcatcttgagcttcttatatttcctcttcagttcctaacatggtcctgaaatacacactggtggatcagtacatgcttattgcttaaattgattaaatgtttaaatggcagataagtaagaaatagcaaaataatagccattaacattaaaatactgaactacaaaatatttacatgtttaaaagtggtatccacattccacatatatttaacttgccagaaataaaaccaacagaaattgcaccatatttatgggtagattctaaaaatggggatagggatgaatgatagcgtcttagaaacacaccacttgaagaaataccctaggaagctcaagaaagcaactaaagaaatttgcagggtaaacatgcccaatagctattattaagaattctataattatgttattcaaacagcttactttgtgcactatatggtttaattacaaataataaccattcatgaacgagcttaaaattgttcctgcaaatgtatgctattcattcatgtaaaaaaaatttttaaagagcttatatgtatgtggcaccacattagtctctgcagagtataaaaacattggtacttaaaaagtcaaaactattggttggtttgattaaatgccagataagtgatattgataaggactactggctagagtagccagtgaaggaagatgtaacaaagacgtataatttaaagtaaaacttaaaagattcaaaagtttggccaagtaaaagcaccaagtaagccacaaattccaggaaaagggatcagcaaaagtaaggacaataaggaaggcatagtcatgagatattgactaggtcagtctggtttttagacagagtacatgttaacagactctatgatggatttaaaaagaaattgaagacagttttagcaggctttgaacattacaagagggatccatgaaaagtttcagaataaaaactaagataatattagaaatggtaatctgacagtgacaggaaggagattttagaggtttgaggacgtggaagaagaagaatacccataaagaggatcttgcaataaccctgcctgaggtttctaaggaccagatgatgcttataaaaatcttggggagtagcttttaacatacctatgcagtcaactttcctttaaaacaaacttatttaactgctctgttctagacaaaattaccagacaaaaggaattcctgaaaatgaaagtatgtgtataaaagaaatattatcctgttgtatttttatttggttttcataggtccctatagaaacccatattctcacattctttaagcctacagagaaggacaggaaataatgacaaagatttcagtaagagtttgcctagagcaaaatagtcactgccacccatgatctctattaggcatccccttgatagtgattgggacccatcctgaaatagaagactgtgccacttattgctcaagtcacagctatacttgatatagtcacagagcctggagaatctgttgtcaattattttcagtcctaaccagccatgagataaccccagcagaggagagaaaacaagcacacgcattttttgaaagcaggtttatgatccccacttgtattcaaaagattaacacttggatatccacctatactagaagcacatgggaccaggagtaagtaaaggtcagcagagcagtaaagatttagcaggtgaaaccgattgtttacaagtctaatctttgtggaaaataaaagagtgtttattgtaccattcactttcttctctttcaacacatttaaactatgttcgaaatgaaatatattataaatcttcaatcggtcttgagtccttttaatttaactctcaggactcagaaactggatcttgcatattcctattggtgtttagtacgcttcagtaacccctacaatattggaaataatgtgattaatagtaatgatcctgtgttacttctcatgggagaggcttaatgatattgcacaggaagtttcatggtgtttatgttaatcttttacgggggtccactttcatctccaatttctatcaggaaatgactcttcttgccaaaacaagtttcaaacttcccttctttcacatgggcccatgagaacacttatcatgcccaagacggctgaggcacatgagggaactcagctacaaccagagagcattaagtttaggtcaaaaatattgcagtcaaaaggcccagaggtagcatcttacagaagccaactagagtgaggcaaaggtgctatagaaataaatttatagtcagtacttaaagctttgcttatgctcttgctcaaagaatagaactatgtcttagttagggccatgatgaaagaggatggcccaacaaagaccatagaaattatcatttcatgtcatatcttaggtccaaggacaggcctagatgaatctgaagtattctcatggatttcctggttaaaggtctccatcaactaactggtgatgaggaacccactgtttatcctttacaatccatcttatttcagcattcatagtacttattttaaaaatgaaaaaataagcattttctgctgactggacatcttcataaagcccaggttaaaaaaaaacaaaaagaaagaaaagaaactcttaaaagtgctattatatacagatagtactgtgggctcctgtgtgacttttagggaattcaagattctatgtctccataggcctaaccaggtaaagaaatcctcttatagaacgatgtctttaaaaagttgctttatttctttactcctcatgtgccataacttatcaatgcaatcaatgattactctccaaatataaattaaagatgatcatgaggatcccactgtctttcttttagaaagaactacacaatatggtaattaggagtgtggatccaagccatttgtcttcatttcagtttctcaattctctttaatgcaacataaccttttatttgtttccttatttttttatgtgtcagtggtttttcaaatacttctatgtgtgctacagaaaatgatattggtgtcaggagctgccactagtttatattatctaatttccttgcgctgtcagtttccttacctaaaacataagatgactggattacatcagtggtttctagtgccggacttctatgacaccagtgcaggagagtagaggcaacagtgaaaggaaagtgagggaatgtcaacggcaggggcctcaaagctgcctcctccctgcagcttaactacacagctctctttttattttaccctttcagctgttttagaaactagggctatgcctatgacttcacttggaacaacaacaacaaaaaagaggtccacttacaaaaataattaaaaaccaataaactttttttctaaaaagtctaaactttccatttctaattaattgaattattaaaaacattcaagatgttaatagcttaggcatgacttttagctacactaataaaggtaaggcgattgagacagaagcaagtagtctaatcccagatcacataacaaatgattgtatgaccagaatccaaacctcctaacttttagtgctttattcgctagcatcacacaatagcaaggctgttgctgtactacccacagctaaggcatgcactattcctattaaagtctatgtggctgctgccccctggagttgtgcaaagtgacaggcctgcagaacaattcaaaatggaaataactctaaaacaattattacatgctacatagcctctttagaattagttaacaaaacatccacatatttcaactccatattgtaaaagggacagctttcctctcttgaaaagtttgtataaatataaagcactagtttaagtatcaagtgtgaaaacaaggaagtggccttaaatcttgattacagaattggaaaatacggcaatttatttaataaatatttcagaataaccaacaactcagaaaaaataaaagagaccatagaacaattctgaaaataatattttggggaaattgccctcaaatacaaatgcctttgagttaataagctctttatttcattagacaggtactcttttgatagagacagtttgctagaaagtttacattatgtttcttaatataggtatacatgttttagattacatgtgcaatttagattacatctataaaaacaatttagtggaatgtatctcaatatcaaagactttaaagttattttcataaaactgtacagtgcagaaatagtgcattatatgcatttctctcccaggcagagaagccaagtcacaaagagatgcagtgagttgctgaaggtattaagaaactcgagaactgtctctgcaaggtagaaatcctgatttaaacaatgtgactacgtcccatgtcccatttaaccacaaaataggcaattaaagtctccctcaaattatgttgaagacatacagtttcaggaaacattgacctacaattttttcataaaaaggggttatttttcattataaactgaaaactccagtcaatagctgtattagaaatcataaaaagtaaggttttaactctgactgccaatatttataatacttcagaaaatgagtattagataaaacatgtaatttggttccatatggtgaaatgtaacataatagagcatctctaaaatgatataacctggagaaaagttgttaatatgattaaattctaccctgcacaggatactcagtagatcactgtaaaagataacagtggaatatgcttggtgattaatttctgtagaacagatgtaggcttgaacctctaaaaactaatttcagtacaaatattagcatctcaacaaagcagtatctctcaaaactggtaaaattaaacagagcaagtaccaacaagtttgtaggtatcagaaaatccgttttgatcatttatttcatttatgttttaggcacttacaaactatacatggatatccaacagtagcagaacactataatataaagccaaaacttatggctatttttaagaacatgttaacttttcctaataaccagcttgatataacacaaaaataataccgctttaaagcattgcaatgtttaagccatcctaattcaatttattgtctaaaatatgcactgtgcatagccattaatctcaaggtggctctaatcaagcttccaagagtacttagaaagagcacaattcattgcctcactagcattttttaaatagcagtggtccaccttccttccttggtcaagaggggaaaagaaagaaagaaaaagggtaagagggacttctctgtggaaaggtttggccttggagtcaaggcttttaagatgtgccagtgatcttggatcgatgcctttttattttctttcaggaataaatctgagcaatggaatggcttgtgattgtctggccaaccagccatatcagatttatcagaaagaatgaaaactggctcagaggactcctgcagtggctgagtggcaggttactgggaaagacacaaacaaaaacaatatacttagtggcggaagggaaaatatatattaacacatgtaaactcaataaatactaagatgtaaagagagaatctatagtaacagaaagggtgaatgcataagacagatgataaatagtacttctatttaaaaaccaaagggatgaaagctcatgaatactacatatttgaatccactttgaggaggaaatacgattttccatcaaataaatgcaaactctaaaaatcagccaatgcaaacttactgtgttcaggttagaataaaaaatgcataaatcttccacaaagttcatgctctgataaatattctaatgtaatttcttaattaagacacatttccagtgactaaatgaaaatatatatataaagcagtaagtgccttgattttcaacaaaatttcactttctatgcatacatgattaaaataaataaaagcagttgagtttaagagcaaaaaaaaggaatactgatataactggagtcatttcatcacaacagaacagttatagtatttccaagcgatttgcagttatactaacagatatttatttagacatattgtgaagaaaaaaataacaccttcttctaaaaagcccccttttatatatatatatatgagaatttcaaattaaaaagaaaacattgtaccgatagatgtgcttacagtaaacacttgtaagaaagagaattgatgctttcttgaaaatatatttaacacctttttcaccacttaacttttattaacatttttcttctcaaatgaaaaataaccccatgattttggagatataatgatgtatcttaaatatgtacgaaagctatatgtacttttatagaatgaaaagcaagactgagttacctgcaaaaaagaaatgggaactgaacttgttcatcgtttatctactaaggtatataagagtaccacctcaatgctactatacattttcttcaataccaaggcaatattgataattttccattatacaaggaagacgaattttagaaccattcctttggttagcaaaggctttataattgccatataaagggactttggctatatctagatatatctaaataaaatgcataattgaaaatgagacaaagtcctttagaatttctaaaaaacatcctctctaatgctgaatttttttccaagcaaaagaaaaaagaggttctcttctgttacaattaagaaatatcttaaagatctatacaacagcatcccccgccctatatttttattctgttcacatagagcagtaaataaggtgcattccttctgcttaagaaattagcatttcaaaaatatgccactttcccctgaactccaagcgtgtctaataatgcgagaagcagattgtcttccctcgtttccttaatttgtttcatctaaaagcaattcactcaacatcttgtcgccctctggcagcttagtttacttatccgcacttaatttctcatttggaccaaaacaaactcctccaaactgctactgactgctaaccgcgagaggggagacgcgcaatatgtatttagttgggaacacacagccacacacatacataggcacaaacacacacagcctcactcataccccagacagtaacttgtttttataatagcactgcattaaaaccagctgaactttccctgccaggtgcggcagggtgggggtgggggaggatgaaaaacgaagtcccccggggcatttacagtttccaatggatcaccttagtatgcgtgttgcaattataccagggatgcacccgagagcttttctttgtgcggccctttcatctggatcactttgtgttttgaacaagtgaggctcgcctttgtgcccccagaatttcaagtacagagtcacacacggaacaacaatggcacgctaatcctcgcgctctaaatgggctcacttgtgggtctgacaattcgcccagggaaacgagaagagacgaagcgagggcgcgagctagtgtcgcctgagacgaggaagaggacagctgcagaactaatttggattacattccttgcagaaattctgaaaagggcttttcggcatagctcaactcggagccgcacagttaataccaaattgctgcggactcggagcggggtcccccagtggcagaggctgaaccagacagcccccagtaggtcgcctcgtagaaattcctctcggctaagcctgcatgtcggtcgccaatgcctttgaatgggtcaatgtgcataatcaacccattgagggaaaatatgaagggactcgaagtggggagggagataaaaagagatgtatctaagaggccgcttggaatgtcaagtccgtgttggtgtgattccggaggtggctggagcgcgggacctggtatgcgtgaagaatttcggagtaattgggagggtgcaaacggccagcacaaacgcctcacatgtgccattcgaaggtcattttgaaagactcgataattgtaacttgttatttactaggcaaaggaggcggcggcggcggcggcggcggagcgggaaaactacagctagccgttttcttggtgaggtcagaaggacaccctccgggggcctaaagcgctccctatcgccactcccgggggctttatcacctcaagctacttcccacgctccagtcaccatccctggatggtttcggaaatctctctggctctccaaaaggcaccccttggccacgtcaagacaccggtcctcctcagacctctcccgtcccactttcatccccaggaaactctagtgtcagaaactttgagctccattgcactgcaggtgctgtcattagtcctgcaagccgtggcgggccagccccgccgcgctgcctctcggggtcaattagccctttgcctgcccaggtacctggggctcgagctctccagcaagcagtggccgcgcacccatcgccgctgccgctttcgcctcgggtggatccagtgacccgcaggctcggcagcctggccgggcagtaaacagacaagtttgaaggactccggccaatagcaagttgaactacaggaagaactcttcccggagccaaacacggcaaccgacgggaaggccgggcttctggctcaagtgtgccaagcctttttttttttttttaagaggtcaggcaggcgagtaagcgcccctcaagtcaatggggagagggctccgggaagccggcggaagaggcccagaactccgggccccggaccgaggcgcgcccgcctgctgcactccggctgcccgggctgggcgcgagttgcgtctgacgccacaaggctcgggcgactgggggcgcagcggtcgccagcagcacacacaggtgcaaagcccgattttctgagcgccgctctccaccgcccttcgggctcggctcgggagaggcccagccagcaccgccccaggaccgcggccccggcggtgcgggttctgccctcggggacccgacagggacagaagagtctcctctgactggggatttgggtctcccatgtcccgaacaacaggcgccaccagaagggatcccgcttaggctcccaaacaaaacgctcgggaaagaaaagcagggggttaaggagagaaaagagggactcagagtgatttttcacgataaataaagcaaacgcacacatacagggtaagtttcaaatggaaagaggggtgaccgaaagcccagggaagaggccccggtcaagcggtccctccacgcctcccgggatgggtgaagagggcaggggagccactcgaggcagccccgccggcggctgcaggttcggcgaccggagtgccagaaggaacccacctgactgagaatcgctgggctggacggtccccgccgccacgagaaggctcacccagacccaaagtcctgtcgccggcttcattttttggaagtctcagatcccgtgctgacaattacatgtccaaatggcatatccccctttcgggcacgcggaggagatcccccagccgggcgcgcgtg

SEQ ID NO: 2583 - DNA, 1162912 bp, Homo sapiens; identical to SEQ ID NO: 2582

SEQ ID NO: 2584 - DNA, 356943 bp, Homo sapiens
atccttgacttgatcacatttattcaatatggttggaaattagcaagaatcagaagaagcacatatcaatcaaatacagccacaaaaacatcctggagataaataaagctgcactatgagaaatactcactactgaaggaaccagtactctcttacatttactacctcttagcaacaaacaactcaaatgtaaatttaatttactcacaatatagaacccttgactttttaaagaaaaatatagattcaaatcaatcagaatttgcctcgctaggccttttcgttacgtatgtttttgaggcctagttcgacgactgttacgaaaatgacaaaaacaaactcgaaagaatgtttccacaaagttcaacaaaacagtgcagaaataagttacttacccatgcacagaataaggcaaaggctaatttcattcgggttaggaatagtaaatttaactagtttcttttccacaaaacgaacatttcagacttctttttaagtaacgggtatactctattatacatcatatgctacgttacgtggttttcctaactctactcagaaagccggcactcaaacgtcaaacagaaacttctccttgattagacttattctgtaacaaccacagaaattaatctgggtctcgtgatagtgtctacagtgaaaagagcacacactagtagaagcacacagtttagagagctgaaggtacattaaaacatcgtctataggtttcacaaattttgtttttaaaatattttttccaaactaaaagctgcagaaaattagttcttaaatattctactgaaaactcttgagcagctagcattttaaatttcttaagctttttattttcttaaaaatatttaaatgagtgtagtatctcatctttttgaaaaataatccaaaaaaagattacaaatctttagttttaatcagtgtgaccaagggtttgtcatcaggactgtaatcttcataggcgatggggctcacatcatacattgcaggccgggatttctttccaaacctgaaatcagagagaaaggactctggttagataaatactagatctcaagtttaattaaagcaagtgatgagaataatttatatgcatgaattaaatgaaactgtaaaaacatattctatagcaagcatagaaactttagacatcctaatattaacactgaatgtgtataaacattagtctttggtgttcgaggcaaaaaaacatatttcacaaaatgtagagctcaaagttggagcttgcaggttaaatcttggcaaagcagtcaagcatgacagctccacaatagattttaagaaaatgtgtattgatttgtctttttcttctgaggcccataaatatttggagaggtgagtttattttatatctactccagtgcctggaatatagaacaccagggcagtcttccccgggccatggacagacagcctttcctgtgggattttcaggggataagctgtgaaggtttaaggtcatctgagatcccaacacaaaagggcagaggtgggaaatgacttcagatacagaggtgtctgtccacaaactatgccagaactcaccattgaatcccacccacctatcacctcccaaccttatggacacagaagccaatgttttcctcagagcacaaagccattgtcccaacagatttgtatgtatcaaaattgcctcgacagcaggactgcctctcagaagccaagggagtcaaaatccaatttcaggacttcctgtcaaacctgtcgtaaggtggcaattattaaaataaagccaattcaacttctgggtggtctcttcccattcaagacctcaccttccctacaagccctggagtgcaacaggattcaaacgatcttccacactaacccatcctccctcctcctttgtctggacaacattttttaattgtttcaattccaccagggctctttaaaaagacattttaaaagaaccttaaattttacaaggttcctaggatggggtccctaggaattaaaggggcttatttgccatggctcctgtcccaactctcctcttttcctattttttcctttgatatgttgaaagtctgtcttctcatgtatggagatgggaagtagaatcaagcgggaaatgagaaaacagtgcgttcttcatgtgatctttcattttaaacagtcatcaatcttgtattccaatcctctcaaattttactggccttgaagagcacaaaggcatatgctatgccagacaggcaccaggcaaaacacggggttaaagagttaaagcattctaccctcagaaaaacccacagctattactgcaatatgacaaaagacttcaataaatactttctaaaatgtgaagcctcactgaaggtccaccattgtgctcacatagatgtgggtcaggctctagcctgcagtttgttcacctaaattgagtgaggcctgcataatctaaggataggaaaagtgtcaacagagtaaaagtgtcaacaggcctgttgggtcttacactttctcccaagtctgacaatttcctaggctgctttaagatgcaaacattttgacaatttatttctcataaaatacctagatacaccaccactaataataatttaaccaaaaatatccagcaacccagtgaagagctctccatatctaacatagtaggatatagagagctttgacttgagggccaacaaattatattaactaactaattattcgattggttggctgaaaggaaaaacccaattgtatatatctttaaaacatccttttttttattttttatttttgagacagagtctcgcactgttgcccaggctggagtgcagtggcgtggtctcggctcacgcggcaagctccacctcctatgttcgtgccattctcctgcctcagcttcccgagtagctgggactacaggcgcccgccaccacgcccagctaattttttgtatttttagtagagacggggtttcactgtgttagccaggatggtctcaatctcctgacctcgtgatccacccgcctcggcctcccaaagtgctgagattacaggcgtgagccacagatccactgagtatgacaaggcaagggctgatgcctctcaagagtgagccacatggccacctatgcatgttcaaggtcaactgaagagcaaggagcaccactctgtgtccacactggttaactgagctgtgtggcccggtcctaatgggattaactccaaacaagtatgggtcataaagtataatgctagttacgaaggtggttaaaataagactaatagccccagcaccagaagagagagcaggcaggcttggagctggaatccctgcatttcaacttactagctgctgagaactttgtccaaattccttaggagaattttggaggtttccacctgaaatgctgtatctaccatatggaagctaaaatgacgtcgtttatagaaacaccacagttttaaaacacacagtacaatgaaaagactttgtttgaatctcctacacctctcacagtagcaggcttacacttgttggtaaacgaatgtgcattcatgtctacatttaaaagactaacagtgtttttttttttaatatctcaggcactaaatcaatgtcagaggctgtttattttattgcaggcattttcatgcaagtgttcattttaaaaataactactactttttatcataaaggtacattttaaatgtaaaaaaaaaccaaaataaaattggaagctagagaaaattataaaatagactaggggttagcaaactatagtccacaggccaattccagcctgatgcctgtttttcaaataaagtcttagttgaacatagtcaagcctattcacacttcctctggctgcttttgcacaacaaaggctgagttgagtagtcaggacaatatggcctgcaaagtctaaaacattttacaggtccctgatgaagaccacaagaatcgcccttagtgctgctctccaaaggacgtgtcaatgttttgtgcattattcttcagtctgcccatccctcaatcccacatcccttccattcattttacaaatatgtatgaagcccctctgaaagtattatatataataattatattacatattttaacaaaattgagaaaatactctgaatactgtattgagactgacttttttcaatcgatagtctgtgtaatgttttactcagcattcttgttaagtaaaaaaaaaaaattcctacaagttaaaacattaataagaaaatgtttcttctgtgctgggtggggcgggctgggtggaacacttagtgttcatagtaacatgttcccacctgaagtagctcatggcccacgacatgaccacagaccatgacacttgggaaatgtctgctgatggtccatgaggaagccagatctttaaaagatgggaaggagttgacacactccccctcctcctgaaaaaatagctcaaataccctaatgtggtggctccatctgcggctccttcctagcccctcgaggggtgatgcatccattgtccttggtgctcactcaacatcacattccattgtcttgttttcactgattgatcatctcatctcatcatcataacaacctcgtgaagtgagtacatctcatttatcctgtattacagatgaggaaacagacacttaggaataattttcctaaggtcacacctggtgggaggtggagctttctggcttccaagcctagatgctgaacacttcgttgcaaccttcatgcatgtgacgaccccataaactgaagctctcacttaacctgtgcctgacaagaggctatgtacttctgcattgaaaggcatcaccttcaaatcagcacatcctccttctcattaacaaactctggcttacaaatctcacttacaagtcctggttttctcacaaactctgtgacccttgtgtaaattgtattatctcactaagcccaaatttcttttgcctataatgggggactaatgatacatggtcccctacattcttgtgagatgcttgccaatgagttatttgtgaatgatttagcacagtgtctggcccacgggaagctttcagtaagtgttggccatcacagaggcactaacagaaatgacagcaccagtaatatcagttagcacggacatctcaaacatcctatttggtgacaagtcttgtgtgtctatttcttcaaagaaacaaaagatactgtaaccagttataaggcaggtcaaagagccgctagttcatggtcctctgaaagtcaaccactaaaacaatgccgcagaaagaatgtcagatcttgagaaaggccaaaattggaaggttttgagctattggggaaaaaaactgaacatgtcctccattgtctttttcccgtgatcaggcacttctagctcgtagagcagtcaactgagtgggacctcagtgtcagaacttggagaaccctggctttgctcctgctggtcagttacaagctcttccctgcctgagtacaagcaaagcaagcatgttgcagatgactcctgggatgaggaagagagggaggggtctccttctcaaccctactaggagttacaaccaacagactctgacatcagaatcacccgacacagcctcagtcactcgtgtgacccactccatgtgccctgtgtggctgctgggctgcagtcattctgatccaatgtcacctccaggatagtagcagtgagacagcccataaaatggacactggctgctgaaaactatggagaggataacatcaaaaggtctaagtttttgccaatgcctttctagggtttccaggaaaagagggccaatcagcctgagacccagccatggcctctacacagccatgctgtagaaaccccaggttggagctgaataaacgttcagaagagaagttttcctaaagggaaagtattgttttaatgtcaatagttttatctgcagtcactggtgcatgcaggagcttgcccgttaggaattccgcagtaaatatttttgatataaatcagcaccaaataagagccaggtttgtaaatgctttcaagtttattctttccttccaagagtattcagttaaatatcttccccatgggccatatgagcagaaggctcagcagaatctatcttaaactattttggggctgagttaaacactccaccacttgagccctgaaggatcgtagccatggatgcctgtaggggcagagggaatcctaattgtctcccaacacatgagaatacaatgccatggattctgctccctcctggtaaaaaagcccctccaggaatgatgaggacagaaaaggttcttgggcaccaaagaaacttgtcaattctctgcttttttttttttttttttttttttttttctgagacagagtctccctctgtcgcccaggctggggtgatggagtttcaccttgttagccaggatgatctctatctcttgacctcattatccgccctcctcagcctcccaaagtgctgggattacaggtgtgagccacatgcctggcctcctctgctcctttttaagttcttcatctccaatccagtaatttcaggatactgcaaatgttcctctaggctggggccacttactgagttggtgccctgggatgagtctacctctcaagccggtcaaggcaccctattccaacccctaactgagatcatccattcatttcaaacctcaaatgttaatgaggtctactacctgccaggacccactggagacatagaaataaaagctactaccctttatttacagggtagtggcataaagagtcaaataaacaattaaggtggggcttgcaagggttggtatcagggcttcctggttgttgtattgcctcagttcgctctgaaaggaaggcgctaagatgagcagccatgcagggtccaagctggaggagggttgagttctctgtcctccctcgcagttacataagcaagactgggtgcagctcccacctcagcactggtgcagatgctcagggtctcccaagttctccctcccactggctcctccccatggaagctgagttctggcttttgcttctattagaatgacaagatcactgtaagatctgagaattgggtttggggaatttcttttggagaaagcaaactcttcgaacctcttagcttctatgccattcagatagaataatttgggttttctcatgtctctctctctctttttttttttttttttttttttttaggtagagtcttgctctgtcacccaggctggagtgcagtggtgtcatctcagctcactgcaacctccacctcgtgggttcaagtgattctcctgcctcagcctccagagtagctgggattacagtgcttatctttgtcgttgctgttatgatacatttaggtagatataagaaaacattcatgatatttcacttttacttcttatcattcccactgtaaccagaatctgaagctacactttcccaatatgtacctagtaaaagctaagtagaaattcaaaagaaacacagaacccattgatgaaggataaaaatctcagtgaagaagggcagacgtgtcccaaaggagcacagctgtgaaggtgactgcagctgactcttaggctgcctgatttggaactttggaaatgaggaggagtcacagagacagtacccaggaaggatgctcaacctctacgggcctgcccaggtcagataataaaaagtccttgatggaaacaagacggagatgaaaaggacagaaaagagaaaggatgtggatatgtgctgttgagatagaaaacccagggatttttgtttttgttttgagacagagtctctatctgtcgaccaggttggagtgcagtggtgccatctcagcttactgcaacctccgattcccaggttcaagcgattctccttcctcaccctccagagtagctaggattacaggcacccgccaccatgcctggctaatttttgtattttagtagagacagggtttcaccaagttggccaggctggtgtagaactcctgacctcaagtgatccacctgccttggcctcccaatgtgctgggattgcaggcgtgaggcagcacacccagccaggtcttctcatgtcttgaccgataccaacataggacatcccaagatagatcatatagcacccatttcccttgagccccaatcttaaggcaccaagctcagcccacttttcactacagcacacttactttctgaattgtgtgcttgagattattcaattaacaaaagaagagatggcttacttcaacaaacaatattgctatttttggaacacatactctgcaaaagtcagtaaaatgttatcttagttgattgtttaatgttatataatagatttggagaagtaaatatggggttttctgttcataccatctttaatatttgtaatggatgctgggcttaatacctaggtgatgggttgatctgtgcagcaagtcaccatggcacaagtttacttatgtaaccaacctgctcatcctgcacatgtatcccagaacttaaaacaaaagttgaaggaaaaagtatatatatttgtaatttaatatgactgtcatgactctccaaggagggagagttatccctttatacagttgagggagctatatttgtggaaagttaaaagatccgtctaaactaccgagtcaggtaacggagtcattaagactcaaagctatacctcaccagaacttacactctttctatgacaccacactaactccttgtccctctggagtccttcttccagaaaaggatactgatttataaatattcactctaaaagtagaaagatagctctttatccttcttttgctaggcccttacgtcaaatgaaatcatttatatgttgactgtttgaagagcaacagggcaaaagacattccccaaaaaaattcaacaaaaaaagttttcaatatacagcgattacgaatcagatatttatagtcacagagcaacccaaattagatgaacaaatatattcaatgtaaacaaaacaaagcaaaaggaaaagctagcagcaaattaaaaggagtttgcttatcaagtggtcgaatgatctatccccaaatacaatgtggaacctattttccattctttaaaatctcctctttgcaaatggaaagtcctgtgtataatatgaccctgttcccaagaatgcacatgtgaaggcagcattccccacgccgcccccacagccaacctggcatgccggatggatgcaatggcattgctgaactcgctgtcgatgctgcggcagttgtagaactcctcataggctggcctggaagaaccctggtattcaatgcggctgatgcggcaaatccccacgatcaggatgatcagcataaggatgaaggccacgcagagggctccaatgatgatgtagagggagtgccgtggcatgttggtgaggctctccgccatgtgcccggacttccattggaggtctgcaggcaaaaataagcaaatggctgggtatgagttgtcacctttgagaatgagaaggcctttttcatctttgcatagataacttaaaacctaagggccattcaaacttggaaggcttattttctacggattatccagacccagggttaatatccttactacataaggacttcttaagaataactaagaaaaactacaggccgggcacagtggctgacggctgtaatcccagcactttgggaggctgaggcaggtggatcacttgaggtcaggagtttgagaccagcctggccaacatggtaaaacctcatctctactaaaaatacaaacattagctgggcgtggtggtggatgtctgtaatcccagctactcgggaggctgaggcagtagaatcacttgaactcgggaggcggaggttgcagtgagccaagattgcaccactgcactccagcctgggcaacagagtgagactccatcaaacaaaaaaagaaaaaccagaaatatgccacagaaaaacaaaggatataaggaggaattcatcaaaaaaatacaaatagaaaattacttggcttcagaattacaaaaaagtacaattcctctatcagctcccaaatattactttaaaattataaccacagttggaagggtacccagaaataaggactacaagttgatacataaccgtttcatttactaattagcatatgctctgacccagatattcccattttaggatttatgctggggaagtagctcaggaaatgcataaagccttatgtgtgaagatgcttatcttcatatcacaatttttcaatgttatcacctattccatatttagaaaaaggctcagaaaatcacacagacaaccatgtactcactgctcagttaataatgttaatattttaccatttttctttagattttttttcagatagttttttaaaaagaaataaaatatggctgggcatggtggctcatgcttgtaatcccagcactttgggaggccaaggcaggcagattgttttgagcttaggagtttgagaccagcctgagcagtatggcaaaaccgtttctctacaaaaaatacaaaaattagccaggcatagtggcacatgcctgtggtcctggctactcaggaagctgaggctagagaatcacttgaacctgggagatggaggttgcagtgagccaagatcacaccaacacactccagtctgggcaacagagtgagaccctgtctcaaaagaagaaaaaacacacacacacaaatatagctagacttccctcaccccatactctctctccattccaccagcaacagcataatttattaaagtcaaaaaataaaaatctaaatatttaacactcagtgagatgaaaagatatccactaaacaacaaaagaataaaagcatgttaccaaacaggatctacttggacagtacaataatttcacaatatcttatgagtttaaaatgtctatatacacattgaaaaggtcaaaaggatagtatgataatgatggcaaacatatattgatttcttattataaactaagctctttaaaaacagctcatttaatcattataaccaccagaagatacattattctctctccccactttacaaaggaggcctagagaactgacatcacttggagtgaatgcctctgatacaagtcagaatctgaggtcttggcctttgcacagcaacatactaacaacagtgatctctaaaagacaggattaaaaatgattattttcctctgtatatgtctgagtcttttccagatttttaaaaataagaatgtattccttttccaataaagaaatatgcaatacattatttaaagaagacatttgtaggatcatcttccagcataagagtggaaatagtatcagccttgggatcacaccaaccttgctttcaatccagctcctacatttacttgatctccttgagcttcggtttctttgtttgtaaaatggaaataacaacatataccccattggcttgctgcagcatgagttaggaaacatgtttttaaaacatttaaaactttttaactttctaaaaagttaaactttctaaaaagttaaaaaaaggttttaacttcctaaaaagtttaaaaaaaaagttttaactttctaaaaagttaaaaaaaagttttaactttctaaaaagttaaaaaaaagttttaactttctaaaaagttaaaaaaaagttttaactttctaaaaagttaaaaaaaagttttaactttctaaaaagttaaaaaaaagttttaactttctaaaaagttaaacaaaaagtttcaactttctaaaaagtcaaaaaaaaagtttcaactttctaaaaagttaaaaaaaaaaagtttcaactttctaaaaaagttaaagagtccactcctggacatgtggtggtggtccctaaagaggaccagctgtggtggtggaggagggaaggataaagggtcacatgctgttccctaaggcacatgctctgagctgaggattactgagcatggccctgtgtccttcctaaaagcaccaacctgtattagcaggaaaaactggaaggacacaatgtaatctctgtgattggcgtaggtcaagaacatcaagttacttcctgtttatagatctgcacccaaatgaaactatctagatagcgtatacaagatttgaaaagaaattgtggaaattttaaagagctaggtaagaccaaacagaagctgaactcatatggaaaaaaggatgctttctctactttactcacaccaccaccaccaccattccacacttccccacccacaccaggacatcattttcatggtagaattccaagtgcctgcaaatgagattcagaggttagtggaaatggaaatgagcctgtctttccatgaaatccacaggactcttctcactgtccattatcgttgagagtatttgtggcctctggatactcacaccttcatcttagctgtatcttcagtcatcatagatctaagaatcacaattagctattccttaccttgaaaagctgcagtcagtctgaagaagagcacagatagacacccaaacagggggccaggcctgcagacccactttctagaagctaacagaaaaatgacccacgtgcccatcctggatgcttcctgagaatctgagaacagatgaataatgtgatttctgagtttgcatccagaccctcctgaatatttcaccaaaacctttgaagcctggtttgtcatttgagtctgcctgcctgagctcataaggcccacggagcttagtaaaactaaatgaccattactgcattgactgcttcatttaagccaactcacatacaggcagactgagtaacataaatcaccagaaacagtcacgatggaagggagaaggtgtttggggaaagcagaaccaaggctcaatccccaaatctgcagccatctcatttggcaatacctggtgtgcactgagagagacaactcatttttctggctgaaaaagcaagcgtgattcacttcatttccaagtattataacattctctaaaaaattcagttgcaggcaggagtccaacactcagcagagtatgttataacatccatttagcatcaacacaagggcagccagtactatgtttctcctccaactcggtagagtgctcagatctgatcactatggaagatcacatgagttcttgatgagttcttgcagtctacgcataagcttcatagcattaacctacacatcacatcaattgtgtatacacagtgagtgcacaaccacatggccactaaagtgaaaaaaacaaccatactgggctatgtgctcagtgcagtgtcccaggtctgactgcttgcatttatgaccatctgctccgtttcccaaaactctgtattccaagctgttcggacttttggaaaaactttctcaagatttctcctaaaagctctgctttcctctctccccctgcccttttctttaaagctagattccacctcactgtcatctaaaacttttttgatacaaatgactgtggctgctttacaggctaattggtttagtagctgggatggatctggctaagtccaacgctaggtctgagagacagcaaatttatctatgccaggtgcctgcaaccaccatctctcagtccagatgctatcctcataagtcattgctttgctgcatcccaggagtctcatcacatgaattgttgactatgtttgctacagcatggcactgggaagaattgtgaaccagaatatgccagatgggttcatctcatcagccccagcaggtgcatgaccaggaatgcatgtgcacgagctgctcaagaaaaatgtcacgcttgtgagtctgacagatcattttcatgtttttaaactagatttgtttgaggtgttgtattttccaaagtgcttttgcattaagcatttcagttggccctaaacaaacaccttgagctaggcagaggtgctaaacttggagcagttgctcaaggtgaggcagacagtcagtggccaagctgagaataaaatcagacccacctccactctgccaaaaagagactccagtcaatttacatattgcatctaaaatacatagcccatatctattttttaatttacctagatgaatgtagctacactagttaatttgcttacctatgttatttttaaaaagagcaagttatttttaaaaagagcaagttaaaaatacctatgttatttttaaaaagactgtttcttaagaagatgttacttagcttaagaatttttaagactacttgttgcctagaacaattgtgaggagggatgtcaaattactttgttttctatagttaaaggttagcaggacaatcaaagcagtcagtgagattgaaaaagattaacaactcttgttaatctctggaagaggaatgaatgcgaaaagggaatgaaagagatcgtctcctttatggggatccattcactgagcacattaattaaggacctactatgtgccaggcacagtgctgagtgacagggatggaaagcaagggaaaatagagagaaaagtaggctcatgtagtccccagttttctgagggatgcagggatcaggcaaatgatccccaaaacaaagtaaaagtacaactgtgctatgtctacaagggacgagctcttcagtgcagcaggaggacaggagatattttacctcactgactgccaagagagcttgcacaacaggagcccttacggagttaggttatgagtgggcactaaccagggacgggcaagagcagaggggagactgcacaggcaaagaaccagagtgagcacaggcctgtgggaggggggtgagggagaagaacaagggctggaagaacagcatgactgcttgagagagaggcagagagtggctgcagcaaggagaagggatctccttgaaggatagggcagtgtggccttgggtctttagtaacttatttattttaataggagcttggcacagtcagtgttggaaacagtgggagggagggtctgagtgttccaatttgcactttgaaaagatccttctggctgtgcatgaagaaagggtttgaggagcaaggacagaggctggttcagaggctcctgtaggacggggcagggttagtggtaacttgacctatggtgatgggcatggagacagagagaggggaatggatgtgagtgctgtgttaggggggaatcaaccagactaaatgcagcttgtacagataggccaatgaggggagagaaaccaggaggccaattcctggtttcctggcttttatcgttggatggatgaggtgctgtagccgagtgagacgaccagatttgagaggaagattctgagtttggttttatacatgttaaattggaggtaccaattctggacatgggctttgggaaagaacatataactaaatcctcaaaagcaatcgcaacaaatgcaaaaattgacaagtgagacctaattaaactaaagagcacagcaaaagaaactattgacagagtaaacagacaaccgacagaagaggagaaaatattcgcaaatgatgcatccaagaaaggtctaatacccagaatctgtaagaaacttaaacaattgaacaaacaaaaaccaaataacctcattcaaaagtgggcaggagatatgcacagacacttcttaaaagaaagcatgtaagtggccaacaaacatgaaaaaatgctcaacatcactaattatcagagaaatgcaaatcaaaaccacaataagataatcacgtcccaccagtcagaatggcgatgattaaaaagtcaagaaacaacagatattggcaaggctgagggaaaaagggaacacggtgttggtggaaatgtaaattagttcagccactgtggaaagcagtttggagatttctcaaagaatttagaaccactattcaactcagcaatctcattactgggtatgtatccaaaagaaaacaaattgttctaccaaaaaagcacaggcacttgcacgttcactgcagcactattcacaatagcaaagatacagaatcaaccaaggtgcctgcccatcaaagatggattgaataaagaaaatgtggtacatatacagcatggaataccatgcagccataaaaaaagagtgaaatcatgtcatttgcagcaatatggatgcagttgaaggccattatcctaagtgaattaacataggagcagaaaaacaaacaccacatgttctcacttataagtgggagctggccaggcacggtggctcacacctgtaatcccagcagtttgggagaccgaagtgggtggatagctttgatcttaggagttccagaccagcctggccaacatggaaaaactccatctctactaaaaatacaaaaaaagtagccaggtgtcatggtacatttctgtaatcccagctacttggaagcctgaggcacaagaatggcttgagcctgggaagcgaagggtgcagtgagctgagatcgcaccagtgaactccagcctgggtgagaccctgtcttaaaaaagaaaaaaaaataggagctgaacatcaggtacttgtggatatagaggccacaacaatagacattagggactactagggagtaaggaaaggaaggggggaaatggttaaaaaactaatggggactatagtcagtacctgggcgacaggatcattcatatcccaaacctcagcatcacacaatgtacccaggtaaaaacctgcacatgtgctccttgaatctaaaataaaagttgaataaacaaataaatgaattggaagtacctttaagacacccaagtagttatgtctaatagttaaattttgatgtttagctcatcattttggttagtaagagctgatatttattgagggttccatttgtgctggacactaagtgttaaggcgttaactcacctattcctcctacaatgctttgaggtagacactattattgccttcattttatataggaagcaactgagactctaagaggaaagctatgtgcccagggttacacacagtaagtggcagcccctgagtttaagcccaggtgccctggttctaaagccacacacttcaatcaataaggaatgttttgcaaactgtagattgtagaaatcaatgtaatggggccagactcacatttaaaaaaaaaaatttagagaactatttcagagtttgtacacttataaaaagttaagtattattttatgttgtgtgtgtttgtgtgtatattaggctgtgtgttacatgcagcgtcaagatgtaaaacatactacttactgtgggttgcactcaaaaggcatgaaaagcatttccctatgctgtacacatccatcagagctcttcagagaggcaatggaatgttcctcctcatgagattttttggaataaaaaagtcaagatcgaatcacatcaataacaactacctatctgtataatgcctgtggtcctataatattctgtacttgcagcaaattggttattaacccaaaagtatctagtttacccaggttccatcagagatgggaaatttcattttcagcagatgcccagagacttttagttgttcaaagagaaagacagctgatgataataattaaggtaatcatttattaagtatctactatgtaccagtcactgaacaatattggttacatttactatcccatttatcaaggcctaaggctcagagaccttgttttctggcccagggataaatacctgagttagaattcaaaacagctcaactcacagaattgagttatcaaccacaaaactccacaacagcattctttccactcaatcagtatgctttccccacatctagccacaatccctccctgagaaggagaggatgcattcctggtgttccaagtatgtactaaaggtaattatggattcagtgggatttgcaagttacccttggaccccaccaccattgcttccaaggggaaaagttctaaaaggcaaaaagccaacttataatgaaatgctcatgaaaagttaaaagataatcaccaaccaaaatcaaaatattaaatgcaaaaaccctttgacaattttatctttgagaatttctactattgatattcttacataagcacaaagatgctgctatgatctgaatgtatgtgactcccaagcttaaatgttgcagcctaatccatacagttaggctttgtgtccccacccaaatctcatcttgaattgtaatccccataatcctcataatccccacatgtcaagggagagacaggtggaagtaactgaatcatgggggcgggtcccccatgctgttctcatgaaagtgagttctcacaagatctgatggttttataaggggttcttccctattcactcaacatttctccttcctgccaccttgtgaagaaggtgacttgcttccccttcgccttttgccgtgcttgtaagtttcctgagaccttcccagccatgctgaaatgtgagtcaattaaacctctttcctttataaattaccctgtatcaggcagttctttataacagtatgaaaacaaactaataaactaatcaacgaagcgatggtattaagagatgtagtctttgggaagtgattaagtcatgagggctctgccttcatgaactaggttaatgtccttataaaagaggcccaagagagccaccttgcccttccactatgtgaagacactgccagaaggccctatctatgaggaatgagccctcgtcagacactggatctgccagtgccttgctctcagacttctcagcctccagaactgtgagcaattacttactgtaaggtattttgttatagtatcccaagcaaactaagacaggtgcatatatagaatattcattctagtattgctttaaatagcaaaacccctcaaatgtattatctatcaatgggggtctgattaaataaattttggagatgctaaagaatggaaataccatgtgacattttaaaaagtgtcgtagatctgcataaggtagtgtgggtgcaccttcaggatatactgttacaataaaagcaatatgttgaagagtgtgtataaaactctcatttgtacaggagaaaataggaacttatctattgactgatgcatctagaagaatatgcaataaatgtctaacagtagttacctttaaggagtgaggtggggatctggataaggagagatattaattaattttattttttaaacatcttggtttatacaaaaatgagaaccaaagagccaacctatttgtataataagaactgcccatataatataatcatttgatacatttctttaaccattattaaattccatctattgttaaaggaagaggcccaagacatccatctatacctctggccccaggatgagttactttccctttccctggttgtctagaggtggctgtgcaaagccttacggtgactcatcatatattcaaacctgccctcagattacaagctcccaaaggcagggtatgtttcattaacctttatattccagaactacactcaatgcctgacaataaagagccactgattcctgattgaatgcataaatctaaaatagcctatttgcctatttctcaactgcaaaatatcattaattcaatagtttaactgtatttaaccatagattcaactgtttaatatacaaaactggccaactgtcagtcaatgaggttaactataactctaactttataaagcttactcaaacaaagcaaaacacaccaacactgctatgtcaagattcatagaaattttgatttttagaccttgattctaggaaggcatattttccttttattataattcagaaaaaattataatcagtcccaaggtggtaaaaatgaatggcagaaaattaaaacttcactgatgttctgttaatttccagaactgtgggttttcatttgccttaaaacatgtgtaaatcactacagctatttgatcgattctattaggatggtcctggatcaatcttcttgatagttttgataaatctgtgtggtctgttagatttctgcttcttattactgactggcggccagataattaccccaaaggggcaaataactagggtgatgcgttaacagataaaattaattctacctcatccccaaatattgtaatatttaagaacaaagagagaggaatgagataccattggtgggtggtacgaaaggcagaataagggtctcctgaagatgtcctaatgcccagaacctatcaatacattatatggcaaaaatgactttcctaatgtgattaaattgagatcttgagatggagagattattctggattatctggacaagctcaatgcaaccagaagagtcctaataagtgaaagaaggaggtaggagagttgacaattgagtgatgagaatgaaagcagaggtcaaaatgacatttctgactttgaagaaggcagaaggcaccacgagccaagaaatgtgagcagccttaaggttagaaaaggcaaggggagacaagttctcccctagagcctccagaaagaagacagccctgctggtctcttgattttagcccagtgaggcccattttgcacttttgccttccagaactgtaacgtgatagatctgtgttgttttaagccactcaatttgtggtaatttgttacagtgacaagaggaaactaatacagatggtcagggaaggcacctttgaactgagacctgaatgagaagaaggcagctgtgctaaaatctgaaagaagagagctccaggcatagggaacagcatgggtgaaggtcctgaaggcagggatgaccttgacctgctcaaggaagggaaagcaggacactgtggctactgcagaggcagcaaggaagacaggcaagcaatgtggcctctgaaggcagtgatcgagttaatggaagcctcctttacttcctcaggtgactcagcagccctccagcaccatgtagctatgtgggccatggttctctgtgtacatctgagcttttctgtttagatctactgactagactttgagatatccaggcatcctcctcttggtttctggatacttcagaggatcacagatgctcagagttagaaagagacctcagaggccgtggttcccatggctcacgcaggactagaggcctcttacagcttccctgcccaccaaatgtacgaattctgtgtgcactctggatcctcagatccattccattgattcagacccaattatctagacacgagccactggtttcagctatgtgtcatccgcaaacctcatacacacggtctcctttccatatactcaggtcatggttagaaatatccagtgctgggacctggcagagcctaatctgtaattaaatttagttttgatacctttggccctatagagaaatataaatgagatcatcaaatggaagatgatagagttgagtgaacacggcgtccaggtatgcactgagatgtgtaatgtaccctatcacacccagccactcagaatagccactgtcctgggctgtaggcagcatctaaaaagacaattgctgaaggttaatccttcctgggagtagctcatagcataagaggtatagtagtacagaaaaaataaaagaaagatcaaccagtatttatttagtgtctactgaacagcagaaatctggacatttgcctcatgtaatcctcacagcaaccagcatgggaagccttcctataatcaagtgagaaagacaaggctcccagaggtaaatttgtttttccaggttacatagttagaatatgatggagcttgaatctgaagtcgactttgatccttttgttattccatattttgcctacattatcatcaccagaagaagtaaactttagattttttacaatgataggatttcacttcaaaatttcttgatgatatcctgtgtgttcctgacttttcatctatactctcctatatatttatcttcatgaatcccattttaaagttataagtagatattactctgccctaaaggcacaaagtgtgtcaatttgtcatactaaactttagaatgaaaactgatcccattttctggaaaagtaaactgaggctcagcacaagcaaatgcagtcataacgagtgccttggccaggataagaaccaaggtcctgctgacccaagtctggaatcctttccaccagcagattccaccagactggacttaacatcctataactacagtcccttagaattttaccattgaaatccttttcagtcccttgtctctctcttcaacaagaaagtagttctcacccatctttagcaaggaaagttaattcgaagcccattctgtatgagagcaattgagaatgctaagggggaggcctataacaattacacacttcacactttggctgcatgaaccaagaagaaagacagtgagtgagcaggtaagaagctaaatcatatcctcagcctcttatcaagttgatcaaattgacgttggagaatgtggtcaagttggtcaagttgatgtcagagaatgtggtccacatttggacaagagagtttcctaataccggccaccctctacattagaaaacactgagaatgagatgaccctatccagccataggcagccagaaccaccagtgagggcctggtcttgtgacatagagaggagtggagagagcagacagatcaggccaagtgacacagacagacaggcagaagcaggcaggcaggactgtgggtactgatttgcatccttccaaattcacacagaagacaagttttctttatctgtcaaaaggtgagtgagcaggtgacagagcgcggaagggagttcttatgcaactttcccaggaaaagaagcaatctggaatagggaggaaactttcacccaaccagcatggttagctctcttcggctatgaaagatcaaattgccccagctaatttaaataagaagacaatacctttcaaagttgaatctttaacagttccaaaacaattgaaaactcgattgcagtcaggcacggtgactcacacctgtaatcccagcactttgggaggccaaggcaggtggatcatgaggtcaagagatcgagaccatcctggccaacatagtgaaaccccttctctactaaaaatacaaaaattagccaggagtggtgccacacacctgtaatcccagctactcgggaagctgaggtaggagaatcacttgaaccgaggaggcagaggttgcagtgagctgagatcataccactgcactccagcctggacacagcaagactccatctcaaaaaataaaaataaaaaaataaaataaaataaaaaaagaaaactggaggggaggctggcaaaatggccgaataggaacagctctggtgtgcagctcccagcaagatcaatgcagaaggcagctgatttctgcatttccaactgaggtagctggctcatctcattgagactggttagacagtgggtacagcccatggagggcgagcagaagcaggatggggtgtcgcctcacccgggaaacacaaggggtcaagaaactccctcccctagccaagggaagccatgagggactgtgtcgtgaggaacggtgcactccagcctagatactatacttttcccatggtcttcacaatccacagaccaggagattccctcgggtacctatgtcaccagggccctgggtttcaagcacaaaactgggcagccatctgggcagacactgagctagctgcaggagtactttttttttcctaccccagtggctcctggaacaccagtgagacaaaaccgttcactcccctggaaaggtggctgcaaccagggagccaagtggtctagctcagcagatcccacccccacggagcccagcaaactaagatccactggcttgaaattctcactaccagcacagcagtctgaagtcgacctgggacactgaagcttggtggggggaggggcgtccaccattactgaggcttgagtaggcggttttcccctcacagtgtaaacaaagccgccaggaagtttggattggacggagcccaccgcagcactgcaaagccactataaccagacagcctctctagattcctcctctctgtgcagggcatttctgaaagaaaagcagcagcctcagtaaggagcttatagataaaactcccatctccctgggacagagcacctgggggaaggggcagctgtgggtgcagcttcagcagacttaaatgttcctgcctgccggctctgaagagagcagtggatctcccagcacagcacttgagctctgttaaaggacaggctgcctcctcaagtgggtgcctcctgacagagagacacctcccagcagggatcaacagacacctcatataggagaactccggctggcatctggcaggtgaccctctgggaagaagcttccagatgaaggaacaggcagacatctttgctgttccacagcctccattggtgatacccaggcaaatggtctggagtggacctccagcaaactccagcagacccacagcagaggggtctgactgttagaaggaaaactaacaaacagaaaggaatagcatcaacatcaacaaaaaggatgtccacacagaaaccccatccaaaggtcaccaacatcaaagaccaaaggtagataaatccacgaagatgaggaaaaaccagcacaaaaaggctaaaaattccaaaaaccagaatgcctcttctcctccaaaggatcacaacttctcactagcgagggaacagaactggacagagaatgagtttgacgaattgacagaagtaggttccagaaggtgggtaataacaaactcctctgagctaaagaagcatgttctaacccaatgcaaggaagctaagaaacttgaaaaaaggttagatgaattgctaactagaataaccagtttacagaagaacataaatgacctgatggagctgaaaaatacagcaagagaattttgtgaagcatacacaagtatcaatagccaaatagatcaagcagaagaaaggatataagagactgaagaccaacttaatgaaataaagcatgaagacaagattagagaaaaaagaatgaaaaggaatgaacaacgcctccaaaaaatatgggactatgtgaaaagaccaaacctgtttgattggtgtacttgaaagtgacggggagaatggaaacaagttggaaaacactttttaggatattatccgggagaacttccccaacctagcaagacaggccaacataattcagaaaatacagagaacaccacaaagatactcctcgagaagagcaaccccaagacacataatcatcagattcaccacaattgaaatgaaggaaaaatgttaagggcagccagagagaaaggtcgggttacccacaaaaggaagcccatcagactaacggcagatctctctgcagaaaccctacaagccagaagagagtggaggccaatattcaacattctgaaacaaaagaattttcaacccagaatttcatatccagccaacctaagtttcgtaagtgaaggagaaataaaatcctttacagacaagcaaatgctaagagattttgttaccaccaggcctgccttacaagagctcctgaaggaagcactaaatatggaaaggaaaaaccagtaccagccactgcaaaaacataccaaattgtaaagacaattgacactatgaaaaaactgtatcaactaacgggcaaaataaccagctagcatcataatgacaggagcaaattcaaacataacaatactaaccttaaatgtaaatgggctaaatgcctcaattaaaagacacacagtggcaaattgcatagagtcaagacccattggtgtgctgtattcaggagacccacctcacatgcaaagacacacataggctcaaaataaagggatggaggaatatttaccaagcaaatggaaagcaaaaaaaggagggatttcaattctagtctctaataaaacagactttaaaccaacaaagatcaaaagagacaaaaaagggcattacataatggtaaagggatcaatgaaacaagaagagctaactgtcttaaatatatatgcacccaataaaggagcatccagattcataaagcaagttcttagagacctaaaaagagaattagactcccacacaataatagtgggagactttaacaccctactgtcaatattagacagatccacgagacagaagattaacaagaatattcaggacttgaactcagctctggaccaagcagacctaatagacatctacagaactctccactccaaatcagcagaatacacattcttctcagcaccacttcgcacttattctaagattgaccacataattggaagtaaaacactcctcagcacatacaaaagaatggaaatcataagaaacagtctctcagaccacagtgcaatcaaattagaactcaggattaagaaactcactcaaaactgcacaactacatggaaactgaacaacctgctcctgaatgactactgggtaaataacgaaattaatgcagaaataaataagttatttgaaatcaatgagaacaaagacacaatgtaccagaatctctgggacacagctaaagcagtgtttagagggaaatttatagcactaaatccccacaggagaaagtgggaaagatctaaaatcgataccctaacatcacaattaaaagaactagagaagcaagagcaaacaaattcaaaagctagcagaagacaagaaataactaagatcagagcagaactgaaggagagagagacaagaaaaacccttcaaaaaatcaaggaatccaggagctggttttttgaaaagatttacaaaatagatagaccactagccagactaacaaagaagaaaagagagaagaatcagatagacacaataaaaattgataaaggggatatcaccgctgatctgatagaaatacaaactactatcagagaatactataaacacctctatgcaaataaactagaaaatctagaagaaacagataaattcctggacacatacaccctcccaagactaaaccagaaacaagttgaatccctgaatagaccaataagaagttctgaaattgaggaagtaattaatagcctacaaaccaaaaaaagcccaggaccagatggattcacagccaaattttatcagaggtacaaagaggagctggtaccattccttctgaaactattccaaacaatagaaaagagggactccttcccaactcatttcatgaggccagcatcatcctgataccaaaacctggaagagacgcaacaaaaaaagaaaacttcaggccaagatccctgataaacattgatgcaaaaatcctcaataaaatactggcacaccgaatccagtagcacatcaaaaagcttatccaccactgtactccagtctgggcaacagagcgagactccatctaaaaaaaaaaaaaaaaagcttatccaccacaatcaagttggcttcatccctaggatgcaagggttcaatatatacaaatcaataaatgcaatccatcacttaaacacaaccaatgataaaaaccacgtgataatctcaatagacacagaaaaggcctctgataaagtttaacacaccttcatgctaaaaactctcaataaactaggtattgacagaacgtatctcaaaataagagctatttatgacaaacccacagccagtatcatactgaatgggcaaaagctagaagcattccttttgaaaactggcacaagacaaggatgccttctctcaccactgctattcaacatagcattggaagttctggccaggtcaatcaggcaagggaaagaaataaagggtattcaaataagaagagaggaagtaaaattgtctctgtttgcagatgacatgattgtatatttagaaagccccattgtctcagctcaaaatctccttaagctgataagcaacttcagcaaagtctcaggatacaaaatcaatgtgcaaaaatcacaagctttcctataaatcaataatagacaaacagagagccaaatcatgagtgaactctcattcacaattgcgacagagaataaaatacataagaatacaacttacaagggatgttaaggacctctcaaggagaactacaaaccactgctcaaggaaataagagaagacacaaacaaatgaaaaaaacatttcatgctcatggataggaagaatcaatatcatgaaaatggccatactgcccaaagtaatttacacgttcaatgctatccccaccgagctaccactgactttcttcacagaattggaaaaatctactttaaagttcatatagaaccaaaaaagagcctgcatagccaagacaatcctaagcaaacagaacaaagctggaggcatcatgttacctgatttcaaactatactacaaagctacagtaaccaaaacagcatggtactggcaccaaaacagatgtacagagtaatggaaaagaacagaggcctcagaaatgatgccacatatctacaaccatctgatctttgataaacctgataaaaacaagcattggtgaaaggattccctatttaataaatggtgttgggaaaactggctagccatatgcagaaaacggaaactggaccccttccttacaccttatacaaaaactaactcaagatggataaaagacttacacgtaagacctaaaactgtaaaaaccctagaagaaaacctaggcaataccattcaggacataggcatgggcaaagacttcatgactaaaacaccaaaagcaatggcaacaaaagccaaaattgacaaatgagatctaattaaactaaggagcttctggacagcaaaagaaactatcatcatagtgaacagacaacctacagaatgggagaaaatttttgcaatctatccatctggaaaagggctaatatccagaatctacaaagaacttaaaaaaatttacaagaaaaaaaaaacaaacaaccacatcaaaaagtgggcaaaaggtatgaacagatacctctcaaaagaagacattcatgcagccaacaaaaatatgaaaaaaaagctcatcatcactggtcattagtgaaatgcaaatcaaaaccacaatgagataccatctcacgtcagttagaatggcgattattaaaaagtcaggaaataacagatgctgcagaggatgtggagaaataggaatgcttttatactcttggtgggaatgtaaatttgttcaaccattgtggaagacagtgtggtgattccttaaggatctggaaccagaaataccatttgacccagcaatctcattactgggtatatacccaaaggattataaatcattctactataaagacacatgcacacgtatgtttattgcagcattgttcacaacagcaaagacttggaaccaacccaaatgcccatcaatgacagactggataaagaaaatgtggcacatatacaccatggaatactatgcagccataaaaaaggatgagttcctgtcctttgcagggacatggatgaagctggaaaccatcattctcagcaaactaacacaggaacaaaaaaccaaacaccacatgttctcactcataagtgggagctcaacaatgagaacacatggacatagggagaggaacatcacacactggggcctgtcaggtggtggggagctaggggaggcatagcattaggagaaatacgtaatgtagataacaggttgatgggtgcagaaaaccaccatggcatgtgtatacctatgtaacaaacctgcacgttctgcacatgtgtcccagaacttaaagtataatagaaagaaaaagaaagaaagaaagaaagaaagagagaaagaaagaaagaaagaaagaaagaaagaaagaaagaaagaaagaaagaaagaaagaaaagaaagaaggaaggaaggaaagaaggaaaggcaagcaagctcgattccatgttagttctcatttttcacttcaatcctagtagatatattgttttaaggtataaaatcttgattaagacatttatcaaacttctattagttcaccctaagagatcactcagctttaagcagcccaaaatgtttttcagcctttcttttaagcttgtcttcactgaacttttctcgaggcaatagaaggaacttaatacatttgaagacacttgaacacataaataaaaaggtaatttgcattctgtgtgtgtgtgtgtgtgtgtgtgtgtgttttttaattttcaacacaaagactctatttttttgatacgattctaatgcttttctgttcagcacatttttggctgcatgagtagcagtgaactctggatgacatctgaaaattctcatcctggggaaaggctggcttcagactcaggagggagtgggggcagcagaatgcagggggcaaacatgctaaactgggtattgagcaccaaaatggggcaagtgtagctccggttgtccctctgggactcactgcctcatctgccagtgactcgggggctttctggtcacagtcggcatcttcttcatgaaggaaaatgcttaagtaacagctataaatgttaaataacagtggctgagctgcagaaatacttacggatctcacagtttgctcccacccaaccatgcgggcagtggcagttataaccattgggctggtccaggcagctcccaccatggtggcaggggttactgtcacattcatttatgtcaatgtcgcactcttcacctagggagataagaaaaagcagtggtgaaaccgctgcacccatggttcctgtcatttttctggccaaaaaataaagatccaaggctaggggtcataacctttagcaatagagcccaacctgctgtttgtataaagtgcagaactctcagaaaattccagacgagggatcttttacttcagtaaaactaaaaaggaaatatatatatatatatatatatatatatatatatatatatatatatatatatatagcactggtaaaaagaatctttcctttagtgtacttaactagttaactagcttcatttagctagttaagtgaggttgattcccatgtctgaataaatctttccgggttgatcagaaaaagtgaagtcgggatcttgatattattaaagaagtctattttattttggatttcatcagctgcatctcgttatttttctgaaactccagaaagctgaaaactcacagttcgtgattattctgtagccaagtatttgagtatgtgagagtggacatttgactcttctctggatagttctaggacatagctgtgcacccagcctgaggcaatttggagaggttactccacttcccaaatccctggatgtgattctgcttgaagctgggggacctgaaatgctcaggaagagcatcaggcccacctaaggagagaacttgtgaagtctggggttagtctaaacctgacctaatctcttctgagaaatggtggtccaagggaagctgtctgtcattctcccataaggaagaatgtgatcttcagctcctgaccctggctagacccaacttttcaggacacctttgcgtgcttcagagagaacctgatagaaattacaaaccagggtccagagccaatgtcacggtgattcaaacaccaccttagaacaaagccatcttcaagtgattttaaagccatcattaagagtcattacaaaacgcatacacctcttaaatttaaaggcatctcattaaagctgaagagaagaggatatttcaaattgaggcactccctctgtcaaaagtttgaaaacgagaaaaagaaattttcaaaataagccctcctttgcttagataaatgcagaaagtgatgagaacaaaactcctagcatggctatggtcatggactaaagcatatggacaaaatcagatatttttgtccattttcaaaagcaatgtttcagtgtacactcaagtgattacttctgggctcatttaattagcattaaattgcttttctatctgctattggtttaccttacgtttataaaaccactttatgtcactcaggccattttagaggaggaatctcacactaatatattccatgtctgtttcatctcacactgtttctatacctggcatcttactattttatttttaaataaaatctgttgaacaaaacatttacaacttctagatcctactaggttgattataattcagtaatatatacgtgaatttgtttcctgcaacaaatattgtcacttacatcaatagaaaaaaacatgaaattgattgcctatttcaaaggctgtctttccattaatggggcaatcactcttagtagaaatagtcatagattaaactattacaaatggcattacatggcagactggttgaagggacatatgatcaggaacatgctgagaaatgttaaaaggatgaaatcaaagaccttaacaagtatatatgtcagtactaatttccaaccatctaggaagataagtgtaattggagatatttactaaacaatagctttctttagctggcaatctgaacactgcaaattctgaaatgagatgctctgtaacctttacaagaatagctacagaaacagcccacatttccctactgctatggtctggcaaaactcaaaagcctcactctgcttcacgaagtccaatgtcaatgacatatgcttttcatttcctaaactctatgcagtcccagggctatcagttcagtccatccaggcctgctccagtccagagcttctccaaaaaggcaaatgccacattcaggagccagggcagcccccatgcacgtattaaatcacttggatcactaaggggctctaacatagtcaggggaagcccaaggtccctagaattgtctgttcttgggatccactagattggacggatttggtaagaatggagatggtggggaaaaaaataggatgacctctttctgtagacatttatcaaatacagtatctaaaatccaactagggccaaacctatctcattctggttttcatcaccataacattcttacagttacactggggattaaatgacgcaaattaatgaaataaaccctatgccagtcagggccccacttagctgacagctatttctgcaacatatgtgctctggcagaaccctggagtgatgcacagttctcagatacctttaggtttattctaatggcctcttttatagatggacactcctatgcatctagttgaatcagttattccttgggtttattgtaatggcctcttttatagacaaaccctcctacgcatctagttgaatcagttattcctcaactggctctcagtttgaggcctttgctgtgttctatgctggctggcaataggagcatgaggtgactcaaatgatggagcccctcaagggagttttcaaccagaagacacccaaggatgactgttgttctctgccttacagtgatcatgctttttgctatcagtcttacgcaaagtgtttgaagatgcactatgaattatagaaaagtttggcttcatttacgtttccccatattaacggcattatgtttgtatatgcatttcaacaccacaacattccattctcaatcaatattcgttttaacttattttattataagagttcttagtatacagtattatctttctttgctaatagttaactaataaatctttaagcttttgctgccctgagccaattgaccttttagttggctcacttactctttttaaatttgagttcaaaaaaaacaattattcttaaaccactgttcttgaataacatctattgagaaaatacaaaatgaaatttctacttgactaaggctagcaatcaaggtctgaactttaaatcttttataattcttttttcttttttctttttttttgagacaaaaatctcactctatcacccaggcttgagtgcagtggcacaatctcggctcactgcaacctccgcctcccaggttcaagcgattctcctgcctcagcctccccagtagctgggattacaggcgtgtgccaccatgcccagtgaattttttgtatttttagtagagacggggtttcaccatgttgcccaggctgatcttgaactcctgacctcaggtgatctgcccacctcaccctcccaaagtgctaggattacaggcatgagccaccatgcccagccaaattttttttcaatgtactaccttctgtgaggcaatatgtaagtacagtgggtatcacatttggtagtacttatgtagatttacaagcatactgattctgcttgctttccttgggtaaattaagaaatgcaaaaagacaaaaccatccaaagtcaccgctgttagtaaatccttgggttaacagagtccccactaaaagatattgatgacaattactataatcataatatctagtattaaatatatgcctcctacatgccaggcactgattgggtgctttgactataaatctttcatatacttcactaagagtttattcaagataaagtgagttttaaaaattatttctaacttttttttatcatgatggaataactggcacctgtcttgccttcccactgtaaacaactagacaactagatgaaatatatgaaaaaaaaaaaaaactatgaagacattggacaacaggaagtccatgactgtgattgctgcaagaagggaaataaaacagctgagcaccacaatcattctggctttcttcctggaattaatttagaacacagtggtttcactggcttgaggagacaaagatcagagtgtgtggaggccaaggtagctgtaatttgtaggaaagaccacaacacaagatagaaccactcagaaattgagcaccagaaatctgctgcatcccgtaggctgttgctgaagacgtgtgtgtgtgtaacttgaagcttggcaaacaaaatgacagatgagcagttcccaaactcacagaggactgagaaatattcagatttgcactgccagagtggaactatttaatggattacccagtacagtcagtgaagccacaaaagatcacaccttagtaatggggcacaactatccctagagtaaggctactctacattcacctccccaaaatgtacaacaaaccttgaaaggattaattaggtcagcaagttacttacctgacacaaaaaaagtccattactttttttaaaaaagacaataaaatccaatcactcaacaacttaatccacaatgaccatcattcaaacaaaaattattagacatgcaacaaagtaggctcacgtgacccataactgcatgaaaatcagtcaaaagacacaaattcagaaacaatggatgagagctagcagacaaaaaatgtgttcaaaatgtgaaataaaatataaaaaacaatgaacagaaacatggaaaataaaaaacaagcccaatggaacttttagatatgaaaaatacaatatctgaaattgtttttagaacccaatggtcttaatagtagactagtgactcacacctgtaatcccagcactctgggagtctgaggcgggctgatcacctgaggtcaggagttcgagactagcctgggcaacatggcgaaaccccgtctctactaaaaatacaaaaattagccaggtgtgatggcacatgcctataatcccaactactcaggaggctgaggcaagagaatcttgaactagggatgcagaggttgcagtgagctgagatcacgccactgtactccagcctgggtgacagagtgagactccgtctcaaaaaaaataaaaataaaaataaaaaaatagtagattagacactgcagaagaaaatattagtaaagttgaaaacagaacaatagaagcttgacaaactgaaactcagaaagaaaaaagactttttaaaaaactaagtagaagctgagcacagtggctcacacctgtaatcccagcactttgggaggctgaggtgggtggatcacgaggtcaggagatcgagaccatcctggctaacacggtgaaaccccgtctctactaaaaatacaaaaaattagccaggcgtggtggcgggcgcctgtagtcccagctacttaggaggctgaggcaggagaatggcgtgaacctgggagttggagcttgcagtgagccgggttcatgccactgcactccagcctgggcaacagagcgagactccgtctcaaaacaaaaacaaaaacaaaaacaaaaacaaaaactaagcagagactctgacccattggacaattttaagcagtctaacatagatgtactcagaatcctagagaaaggatatgaggccaaaaataatatttaataaattaatggctaaaaatttccaagtttgatgaaaactgtaaccacagattcaagatgtgcaacaaaccccaagcaggataaacacaagaaaaccacacacacacacatcatagtgcagaagcgaaagcaactgcatcttggatactgattaaccccagttccaggaatgcctctaaggattccagtttatgtactgttccttgtacaagaacagatacttaccataaatcctgcccttcggtcaaaacaaccttgatgttattgtacttcgattgtcctgcacatcccttctgaaccacctctccctctgtggatcataagccttgggtccgaagggtaatggtgtgggtgtggggatccgccatcttgtttccccactgcccaagacacagacaggcttctcttcgtaagtccctattaaacatttctttctgataaactggatatgtcagcctctttcttcagcctctcagcttcctcagactttgggggcaggtttgcagaggcctgcaggagctgagagaccaagaaatgggtaaagggaatgaagcgtctgtgtgggtaatcccaggtggcagccacttctatgtggagtggtgtggctcaccttttagacgcttgtgtgtgggtacagggacaccccaaaaatgccagcgtctttagagtgacttttaagtgggagccatctgtcgcactgcagtaaggaaggatggcgagcagccactgctctaacatggccacttctgtggccattgaggacgggagcccatctagcagcaaaagcaaagtaaaatggcttgagggggaattaaaattagacaagattttctaaagagctctattgtcaaacatacatctgtattgttttaaggtctctgttctctctccgtaaaacttctcagtcaaatgaattctgttttctccatttacatctgtctgtccctccttcctcttgccaccctcgatgccacatgagggacctacaaaaaggaacttctgacagtctgggatcccttggagacagaaaatactcctctttgtgggaggtacctctatttttctttatggaaccgtaagagttataagcagacagattcctcttgggtccaaaacatgactctcttttgtgttgcgttacctgatctgtttggtttttgggggtgccagagattactttgtaccatgagaggacttgcctttgctgtgtgtaataactggcaggtgagagatacagtcttagaggtggttgatggcacttggccgaaaatgattattactacaaggggatactcatttctttgggaatttacataagaaaactgtggtttggatacctaaaggctacagaaacatgccctactatgggataaaacaccctttgggggatgggctgatcacagagtgggctgatcagcgttgagttgcccatcagcctcaggggaatgtccttgcagtgacgtgcaccgtggaagcattgcactgtccaatcctgtagtgtttccctcttttgggggacccaggattcagtgtaaaatgggatccttggttttgagggatctaaatattctgcctttttgctgtacctgctcaagtgttcagccctacaaactgcatgctttaaagggctccatcctgggcctggtgcagtggctcatgcctgtaatcccagcactttgggaggctgaggagggcggatcacctgaggtaaggagttcgagactaccctggccaacatggtaaaaccccatctctactaaaactacaaaaaattagctgggcgtggtggcacacctgtaatcccagttacttgggaggctgaggcaggagaatcacttgaaccggagaggcggaggttgcagtgagcggagatggcgccattgcactccagcctgggtgacagagcaagactctgtctcaaaaaaaaagcttccaccctaaagccaataatctagataagaaataaactaagtgaaaaagaagacacttttcctggcaatcttgttttcagataacaatggcagcctaagttctctgcctttgagatgtaaatttcctaccttgtttcacctaagagtcatgtctttggattgacagtctaaagggggaaaagaaactgaaaactggcaaataaaaaatcttataaatctataagatctgcttctgtgtgtctgtatgtctatattttatatgtgtcatgggtgatatatccctaccaaaatatataaaagagctctaattacttagcttaaagaaaagtaagtgcttcagacaaatattttaccaggaagatagaaaccaactcaaatgccttttagtttacacgactttagtaatctttggtaactaaaactagtttcaagattttttcagtaatttaagagttaaagagttaaaatactagttaatatggaaaagtaatatcacctagtttagaggctatttaaagtttgtttcaaagtgaaggaaaaaaatgatataggtaaaactaagtggacagaaacagaaagaataaaagggtggggaatgaggaatttttgattccacagtggtcacatggtcaccacctaaggtatggagcccatctgtgctgtactcagttgctaaaggtaaaagttaccaatggaacttaggaatttaactctgggggagatggttcactggatgtgtaagaaaatgcaaactaataaggaaaaagtgaaatattaaaccccttggtaattgttatctgtcatagctaaaataaaagtacaagagagtgatggttgggccttgaggctgaaccaacctcagatgtgggtctgtctgagcataggtcactagcctcaaagcaacccacaaaggggaaaattatgccagggcaacaaaaagtacctctgagactctggttaccaagagggtagtcaatgtgagggaagggcaaaaccaagtaactactgaaatcagaaggtctagtgtgaaggaattgtgccattttgtaggtaggtattattaccttcctcagactttgggggtgggtttgcatagacctgcccaccgtggaacaaacagatacatcacaatcaatttgctaaaacctagtaataaaggaaaacttctaaaaacagccagagtgagagttctgcttttggaaagatggagcagatatattttccctatccctcccaccaagtacaagtaaaaaccctagacattgtacataaaataaacataagaaaattccaagaagttgagagaaagagacagactggctagtaatctcaggacccaaggaacaacatgattgtgagctctctgagttttcttttgacctcatatattccagattaggtgctggagaaggcagcaacccggaaatgtcaaaagatgcagaaaacaaaactcccacgaaagcctgttctctgtaaccaaagaaccaagataggggcagcctaacaagacaaaaaattatagctaataactgctccactccagccaaacactacaaaaaaaaaaaaaaaactgcaagtcccctcacccatgccaccaaaggccgagtggagagcatggacttccaccctccaaagcacctcagccaccaaacaataacagaatgcacaatcttttcaagtactcacaaaacatataccaatataaaccatattctgggctatgaaacaacctcaacaaatttaggagagttgaaatcgtagagtgttctctcaccgtaattaaatcaaactagatatctatgataaaaagtaacaggaaaacctcaaaacacttgaaaaataaacaacatgctcataagtaatctatggatcaaagaggaaatctaaagggacattaaaaataaaaattaaattgactgaaaatgaaaatacaacataaactttgtgagatacagccaaagcagtactgagggggaaatttatagcactaaaatgcatgcattagctgtgagaaaaagcctatatcaatactctaagatcttacccaaaaaacctagaaagaaataacaaaagcaaattaagcccaaagcaaaaagaagaaaatcatagacataagagaagaaatcaatgaaactgaaaacaaaaacaatagagaaaatgaatgcaacaaaaagctatttattaaaaagattaacaaaattgacaaaactctagcaagattgacaaaggaaaaaagagaaagacacaaattagccatatcataaataaagcagaaaatatcaccaaagactgcagatgtcaaaaggataacagaaatactatattacaactccacaggtaaatttaacaacttaaaaaatgcactacttcctcaaaaaaaaatcacaactcatcaaatataaaatagatgatttaaatacttttataactattgagactttaaactttaaaactccccaaaaagaaatctcaggtccaaatgctttcactggtaaattctatcaactatttaaagaagaattaatagcaaattgatacaatcggttgcagaaaacggaatacaaaagaacacttcgcaacttattccaagaagctagttttacttcaataccaaaactagacaaatacataataacttttttaaaaagagaaacaaaactattttgtgtctacgttcatattaaatacttgtttctcacaaaacacaaaattgttttctttcttttttaaaacaacaacttgagaaacaacttgtttctcatgactatagatacaaaaattctgaacaaaatattaggaaatagaatttagcaaagtattatataaaatgagttatacactatgaccaggtggtatattccaggcatgcaagactaattcaatatttgaaaatcaaccaagcatattaacaagccaaagaaaaaaatcacatgatcatatcaatccattgacaaaattcaataccaatttatggttaaagttatcagcaaactaggaatagagaggaacttcctcaatttgataaacagcatctaaaaaaaaacactacagctgacattatcattaatggtgaaagactgaatgcttttcccctaatgttgaaaacaaagcaaagatgtctgctcttactgaacctagtgttagaagttctggctagtgagacaagacaaaaaataaaatttatacctatcagaaaggaagaaataaaactgccgctcttttcagatggcatcattatttatgtagaaaatcccaagaaatctacaaaaaaaaaaaatcctaaaactagtaagttcagcaaggtcacaggatacaatttaaacatacaaaaatcaattatatttctatatactagcaagaacaattctatttacaatcactaaaaatacaccatacacacacacacacacacatgcatatatacatacctacttggatacttggatatacatgtacagggaaaaaatgttgatgaaagaaatcaaagatctaaataagtggagagtcacactgtgttcatgaattggaaaactccaaatagtaaagatattgattcttccccaaattgatatactggtttattgtaattcctcagcaaaatcttttgtaggtatagacaagattattgtaaaatttatatgaaaaggctaaggatctagaatagttataacagttttggaaaaaaaataaggtggtaggaattattctgcccaatttcaatagttattatgaaactacagttgttatgacataataaaggtagaggaatagacacataatcaatgaaaaagaagagcccaaaatagacccacataatatggccagctgatttttgacgaaagttcaaaagcaattcaatgaagaaaagatagccctttcagctaatgatgcttgaaaaattatacttacataagcaaatgtaaataaaagagcctcctctagttagaagattcaggaaagaatgcaaactgtgagaaaagattctaactatattacaactgtatggaacaacctcacaaaggggtctgggggggagctgacctaagtgactttggaaatgggtaggattgataagactaaatgcaaaataagtggtacataaacacaatactctagttcataaagttgttttccacaagggtataagttaacaattctgatactgctatacctggatactgaaattgaacaattaagtaaataaatgatggatgatgaaaggcagtatttggttgttggtgtgaagggtttacaaataagcaaggggagaaggctagaaccattcatgctgtaacaaactagagttggagacatcactgtgaattcatgtttagcttaatatagacaaagataactacatcatgcaatatttatggataagcacatgtccatgggttagtatacacatgcacttcctcactttgtcagctgagaggacctaaaagcaatgatatcccagtaaaaacaagcacagcttagcacccaaatcttgtttttaatactattctccaattaaaaaaaccagagatccttagagaaatgaatgactctagaactggagcaggaaatacacaagatgaggctgaagcatcttgcagtgccagaacgtatatatgttttaaaaaacaaaacaaaaaattagccacaaaacaaaaaattaaccacattaatggggatgtggcaaagaggtaataggagccaactgaaagaactcccaatggccaaagtattggattataacctaaagtataaaataaatatccatgaacccataaataaatgattaaataaatacacaaatggaggagaataaacaaatctttcatccagaagaattccaaataattcatgtagctactttacccttaaagagcaagagcataactcccttcttgataagtgtggactacacaacactttctttggaaggaagtcacttcctcccaaattgttaagtatggaaagggagagaaggagtaacattatagtagagaaacttgacaaacactacctcagctaagtgatcaacatcaacgtcaatgatcataaatctcattgacagtatgtagccttgatgtgatgtgataggattagaaaatggacaaaagacagaaagaaacatttcttcacaggatatgcagatatcaaataagcacaggaaaagatgctaaacatcatttatcattaggggaattcaaactgaaaccccaatgagctatcattttacccctatcagaatggcccaaataaaaaatagtgataacaccaaatgctggcaaggatgtagagaaactgaatcactcagacatcgttggtggggaatataaaatgcataagccactctggaaacattttggctctttttataaaactaagcatgcaactaccatatgacccagcaattgaatttctgggcaattgtcccggaaaaatgaaaatttatgttcacacataaacctatatatgacagtttacaccaccttttttataatagctgaaaactgaaaacaatccagattcctttcaacaggggactggttaaacaaactctgggacatccatactttggaatactgctcagcaataaaaagggagaaattattgacccaaaataacctggatgcatctccaaagaatcacgctgagtagaaaaaaaaatcaatctcaaaaggctacacactatatgattccatttatgcaatattcttgaaattacaaaaatgcaaaatacactagtggtttccaggaattaaagacagttgtggcgcaagggaaaagggtaaccagtatcctggttatgaaattgtactgtagttttacaatatgttatcattggaggaaactgggtgaagcttacattggatctctctctattactacttgcaactgcaggtaaagcttcaataatctcaaactaaaattttgaaaaactagccagagaaaaatagacccatatataatcaattgttttctaacaaatgtagcaatgaaatccaatggggaaaagactgtattttcaataagatgctggactaactggatgtttacatgggaaaaatattttccatccttaagtcacaccgtaaacaaaaattaactcaaaacagactctacacctaaacttaaaagcagacctattttaaaaacactttagaagaaaacatcggataaaatttcaccatcttgaagtagacaaagatttcttacaataccagaaaagcacaaaccataaaagaaaaaaaattgataaattagaccaattaccaaaattgaaaactttactccccaaaagataccattaaaaaaatgcatggatgagcaaaatgtatacctgacaaagaacttgtatccagaatatgtaaagaattctttgaaatcaatagtatgacaaacaaccaaaattttttaaatgggcagattatttgaaaagataattcacaagtaaagacatatgaagagcaaataaccacatgaaagatgctgagcatcaaagaaattcaatgaaaatgtcaatgaaattaaagcactgatggtattttaccataaaaattgaactagaaattgtaatattctattgtgaactgaaagacaaatatcaaaaaatagttgagttaaaagacagagagaaagatatagtaacatcattctacctttaataatgcacaaggatttcctgctctggtgagaaaggaatgggtcacttgtgtcccagctgttcaaatgacaatgtcaatgggcttggaagaatctttggcttccctgttgaagtacggttaccttatgtccagtctatggtttcaggtaaaaaaataaagcaaatcctagagaattaatgttgcatcagggtatctttccttccatccactggtcctcagccagataattccaagggggcagaattgcaaagcttcggtgacaagagtggtcccaaagtaagacagtaactgaagggtggacaggacctaggccaggacagtgggccttatggagagaactgtgtagaaggaatgaaatgcttgaagagcagggaggctctctgttcagatgactggaggaagcgtattttcagccagaagcctaggttcagcaagagaggacagagtcccccacataccacaccctatactttatctgatggcctaagaaagccagtttaatatggtaaatatgacattggattgagtatctaattatatagcaatgatttgcccgattcactccactcggtcaagcagagagtttttgaacactcagtagctggccaagtgtaacttctgctaaacctcaggtacaatgaaagagtatttgattccaaggtagctcaacctcaagagcagaagcaccatactccttgtatggaagcagttaatattttatcagcctctcctgtggaacactagttctcaggaacaatagattctctttaaggaaaaaaatggttctatgatcaaatagatttgaaagataaatttactgttaagacctctgagaaccttgagcacacagacatcctttatgaatctgcacgtgggatgtatcatgtcccacatttatttggccacagaacacttttttccatggagcatctcctgggaccagttttctgttaaacgcattaacagcacaacccctaaatgactttaggaactattctgtggtcctctgtaggctgaaaaactatcagggctgaatagaatagaccacttgttttcaaaaagcagttagagtgatgtttaaacctacttcagtgagtcccactgcgccctgagatcagggtgggtctcatgaaaaaatgcctaagggtgagattgctggtggggtatatatgggtatggtgggtgtaggggtaaagggatgagcagaggggggctgagaggcaagagatggaggaaaggcaccttactgagaagagcgtgacatggtatgttcagttatgcagcaagcagaggggcccaggacaaggctggaaaggctggatggggccagaccactcaggtcttaaagattatgttaaggactttgatctttttcctaaggacaataaaatgccaataggtgttttaggtaaagagtgataagattagatgatcatgcataaggtctctgcagtatgaaaaatggattaggagtcaggaggaataggtgtgaggagaccagataggaaggcttgtagtggtgcaggtaggttggaggtgaaggcagcatggtgctgactctgcaaagaagtgaaaagatctaagaggtttttaggagtccttggtagttggatggaggtaagagggaaaaagaggaaggtatattagtctgttctcacactgctatgaagatactacccaagactgggtaatttagaaaggaaagaggtttaactgactcacagttctacatggctggggaggcctcggaaaacttacaatcatggcagaaggcacctcttcacagggcggcaggagacagaatgagagccagcaggggaaatgccagctacttataaaaccatcagatctcatgagtactcactcactatcatgagaacagcatgaaggaaactgcccccacgatccaattacctccacctggcctctcccttgacatgtggggattatggggattccaattcaagatgagatttgggtgggaacacaaagcttagccatatcagatgatatcaaaatggttacccagtttctggccagaatgactgggagtgatggtaatgccatttgatgagctagcagatatttaaagaaggaaaggagaagaagatctgagtttggggtgtctctgagattttcaagatatatgtggagtagatagttggagttttgctaaatattctggagaaaacatgacattttctcataaaatactgaagtaaattttaaatgcattagagacttaaatgcataaaattaattcatacatgattagcataatagaggagaatatttctaaactcttgatatatagaatctttcagcatgaaacacgaaaagaaatcaagacctcaatatgtaattatggactaaaatataacatatggaaaacaaaatacttttgtccagatttaaaaggcaaatgacagtggaaaaatatgtgtaacctatggcagataaactgttatatacttaaaataaagggctatttcaaataaagaagagtaaagattagcatgaatggtctcataaaaaatcagacaaaggatatgaatagagagttcataaaggaagaaacacaaccagaaacatatttaagaagtattcaaccttactataagtctaagatctacaaatttaaacaacactaaaatgatatttttgaccactagaatgacaattctcagtatttgtgtcaagacaaggaaataaatgctcctgtgcacttttggtaggagaaaatatcggttcaatgtttgtttgttttttctcctcttagagagtaatgtcgaaatatgtatgtattctcctgtaccctgggattctatttctgcaaaattatactaaaaataataagataagtacacaaagatgtaaatacaagaagattccttgtaatgttgtttataatggggaaaagttctcaactgcccaaaagttgaattgtggatggaacttttaaaaaatcatatttcatataatggactatagggcagccagtaaaaataaaacagaagctattccttgatgtaaaaacacatttatgatatacatatatttttaagtaaaaagtaaattataaaatagtatgagtggtatgactccttttatattcaaatatgtatgcatatacactatacactatatactacacacacacagaccttcaggaaaatttctggatatcagaatgtatcaaaatcttaataacagttacctcctagcagatcaattttcagtggtgggattttttttccatagtcctatattttctaattttccttctatgctttttttactcatgggataagaatatctggggaaaaaaaacccgggatgcttcccctaatattatttttgcctccactggtgagtataaatgtctgcgtgtgtttataagcaaaacaaagccatctgcgaatcatttttggagtgagcccacttctcagtcccaagaaaagccagaaggaaaacataagctgtgacactgataaatagaaggaaaatcagaagttgcttttcctacacttcggcttttgtcaccttcaccagtagcacagatgaggctcccctgggatggcttagggaccaaggctctgtgaaattctccggggcttgggaggtggccacagtggcttagcaggggagaggtggacacagcaagatgctctccagtcaatgataacatatgtttttctttggcttcagagcccaccttcttctgtgggtacttgatatgtcatcctcttccaatttgcaatccagagtgacccttaagcttttgttggttgagcaaaactctaaaaacatagactttgtcttactctctacatttcaagatccctgggttctgttggaaaagcaggggatggaacattttgtctccggtggtttagtttctttcacctgtactttatctgcctacgtgtcccaaagcctggggaacagaaagttaaaagcctgagagataaattaatcaataacaaatgttttctaagtctccaaaagaatctgataaacatttgagaggctacgctcagcacatacacgtacaaaccacatttcacatctgtttttgagattcacaaagtccttgaagctcataagggggtgactttgaagaaggaccccaagttaggctggaacccccaatctaggagtggctcctcctgttcggtgttcagtggccaccaagatttctggagaagccagtcctgccccgccaatctcgcctcccatcccactctcccttgacacttttatatcttgcaataaaaataaatatggcagctgaaagcagcatctacagaagacacacctcttccttctttccatcttctgacttttattaacccatcacctttctcaagtgttcatgtaatggctcatttctcatgtttcatagtcctagcctgggaaaggtacagtaatgatagtctttgtaagtctagacgccaaacaaccatctcagaaaagcctcatttaatgaggctcacacaatgggttgttttaaaatagatcttcatccaagccatgcctccttacattttgtaatggtgtttatattttgcaatattttattcatgatggatttgggtttttttaacatctgcaatctcgggcactttgtggtaaatttgaaaactcagtccctggaatcacttgcctgtaaacccgggtgcacagatgcacgtgccattcaggccgtcgctgtcacaggtggctccgttcagacagctgacgttagcgcagggatccttgtacaattcacagtgtgttcctgcagagaaacaagcaaaacaggatgactcatccaggactctctggctcccatggcctctgaaagcaaagtcggaactctctggaacaatgcgagggagattcccagcgtgggtgtgtgtgggtgagtgtatacacacgtgcccactcatgattttagattgttgtaaaaacttgccttatgagaaagtaacacattcgatcactgtccataggtcccaccatagtcttttatctgtactttctctgcctacgtgtcccaaagcctggggaacagaaagttaaaagcctgaaagataaattaatcaatagcaaatgctttataagtctccaaaagaaacagaaaatatctagatggccttgagaaaatataatattagcaacctgaaagtgaagatttggaatcagatatttaagtgagtcccagttctactttgaagaactgcaggggagaggggaagccgtgtgatacttagacttcattctcaaagacatcactgcatgctttatgtctaatttattcctcacaacaacactatgagacaattatccttattcctccattttacagatgaggaaactgaggaaagagtcgaagatcacaagcctggtaagaaaggagctgggatttgaagctgcccgtaatcccatcccagagtctgtgtttgctaagtaggctgttgagagtgaccctgaattgactgtggaaatatacaaaactctatggagctcagcactcgtttaacaaagaagaggcattttttaaaaaatctgtaaagtaaaacagacagcttctcatttactttttttaaaaaaaaaagactgtgtgtgcatgtatgtacgcaaatgcctgaagtgggactggattacttccaggagacttgattactttgattttcacatctgtgtatttctacattactggcaccttttttacaagtatctatttttttataattttattaaaaactttaaaaatctaatgctatttgaaaggtgggatatctgctgatgttacactggatgccaagatggatgaatagattagtgtctctctctctctcctcctcctgcccctcctccctctctcccttcccctatccccaccctttggagagaaagataaattacattctaccttgcctaagaacgtacataatgatatgcccacacttcccaacagcctcaagaaaaatatgcataaagcaaatagtaactgaatggtatttacttaattttctctgcacttcattacttagctcatgttgtgcaagggactgccacacccaatgactcatcctttaggcactgaaatcatccttgctgggcttttcccttatttatttctcaatgccttaagaatagggctcaggaaggaggaaaggaagtaagagaaaatagaaatggaacttcctatctatattcacactaatgacttatttgagccaggtaaagctcaaattttagaataaatgacctgtaattctttttcatcctttgcccctcctagccaagccatcaacaatattctgtcaggtatttttctgaagtgtctttcagatctttgcctttctttccttcctgagaccacccctgtgatcccactgcctcgtgcctggtgggatacagcatcccgcagccatgtcttagtttcctctgtctccagggacttgaacgagcctcctcaacttccttcatccctaacccaggttgcatggtaacataaaagatcaaaataatgttaagattagcataaatctggtcattcttcttcatttgggtgtgtacagcctcttctcccaggagtctcttatttttactttcctactgatacacaagtagcctgggctcaattgaaagaataaaaagcagaagagtcttttctgctttaaaatgtttattgcaacacaaagactcacatatttacaagttcccactgggctgatcaatgggagccaagtgacaaaaaagacttttggttgtagtgggaaatacggccaccaccaaagttcagaggtgcctgaagcctagaaaacatttccattagacctgaagtcaaagaaatcaaatgattgtcactgagtttctagtaatacattaacatcactaacatattagcacccaaactaccacattttaaaaaccagactgaaaagcaaattctaggccaaatatttaagcatcttaccttttatttaaagtcttcaacaaaataagacttgatgaaaacacccaagataataagcaatttcaatcttttgggtgtttggggtttttgtttggatagatggctcttttttggagggcggggagacaatacttttttcccttgttaattttctttttcaaatggtgagacatttggtcccttgagcatctattgagagttctctggcagcaagactggacaaaagctaatcttcacagaaacctgattacggacaagcaagatggtgttaaaagtccctggagagcactttggtgactcacatttctatatcgtaaaccttgctaatccctatataaaatatatttgtcatattgctcagcttgtcattagaactgaacaactctgagctaaaaactttaaacacggagaatagacaatcatggacactactgatgtgccaagttgtatccactcaaaccctcctcctctggaggtccctaggccccctcttcctgccctcctcaccactcccattcccagaaaacatcaagtcttgggcatcctgtttcctctgaggagtcaccttctttcacacccttcccccaacctgatcttcgcatatttaactaatctctcaattcccaatccaaacaccctctctctgcaaagctgaaccttgattttctcaacacagaccacattcttccaccactgtgccttgagagcatgccgggactgtcattgtcacggagttcactgtgccaaatcataacttatctgctctcctgtctgattctcccacaaatctctgaagtcctgtagagcagaggccgtatcataatgcgtggaagaaattatggacctaacaccggaatcctatcctttcaagaggggcgacagccagtgtactttggctgacacacaggtgaggctgccagaggagagattccaaattccaaatctgcctcaaaaacaccctattttgtcagagaaaaccaggtccacacttcaaactaagtctgtggaatgacacatgcatcacccattggcagaagacacagcacgtactattacaaagctgatgtttagtctcaagcaaaaataaactgtaattcagtcaaaactaataaaaattcatacttttcgtattaagggatggagaagaaatgtttctaaaaagactttgattccaacagcattctttacagaagttaattttagaattgaaataagctagaattcaaaaagcagtacaccaattataagtctttgttgttgtaacaaatttagttacaattaatatttgaaaaatgaaaatcaatattttatctccaagaaacgaagccagtaaagaagtgttattacacttaatatttactttaagacatcgtctcatttcatccaaacttacttcctctatgaaaactttttccagtatttcaatctttatagatctcaacattttctaaaccatctcagaaattacaattgacatctcagccttagcctcattattcctgtgtgtgtcactcagtctgctcgtctggttaaataacagcccaaagaaggaagaaactctgacttatcctttttgtatttatcacagtacttgaaaggactaggtgcacaaaataaccagaaattcttgttccctggctaagtggaatctagcaaaggcaataactttatccaacaaagaaggagttctcttccttcccattaaaatttctgtagcctttaaaaataaataagtaggtacaggccaggcagagtagctcacgccggtaatcccagcactttgggaggccaacgcgggcagatcacttgaggtcaggagttcgagaccagcctggccaacatggtgaaaccccgtctctactaaaaatacaaaaattagccgggcatggtggcacacacctgtaatcccagctactcaggaggccgagacaggaggattgcttgaaccagggagacagaagttgcagtgagccaagatagcgccattgcactccagcctgggtgacagagcaagactctgtttcaaaaaaaaaagtaggtacaatgtacaatgtaattaaatctataatccagtgatctcatttctgagactctatccctagaaagaaatctggaaagtaggaaaacaatgtaaagatattaattccagaaatatttgtaatagccccacatcacatgtaacaacaaagcaatggataagtattctctcatgggaacattacaaagccatttaaaataaaactagtaagacttcctagcaatacataaatcaaacataatatcctattatgagtgagcagaacaatataaaattgtaggtatactcaattattgaacagtaaaaacatggatactaaaatcagaatggaagcaacacagattattatggctcatgttatgttgtaaaaacatgagtaattatgaattttctcttttcttctaaatatttattattgttatattattttcaaaattaaaaatcgaattttttttctaaattgtatcaccaaaaatttcaaatatatatattgttgatcatttcattggatcttctagaaataaaaatcaatcactatggggctgttccttaaccttttgacaatatgaggtatgaacacttaacaaagtcttagacgttccgtcacaaaccaggcttgaactagttttgaaggacacagcagtattttggtttgtctgaagacgggttacacagaggtcctccatgaattttgctttctaacaattccataatctacagtgaagacttacattccatgaaaatgtttaagttggtttcctttacttaattcatgtgttaaacagtagttctaactcaagtaaaggtagccattgagcatttgttctgtgcgagccaccatagtaagagctgtagagaatttaaaaagaaaaagagcctatgtagtcactgtctttccagagcttatgatttagtatagggaagaagaaagtctgaaaccaaaaagaatttaatacaaggctaaacataattgtcatggcaaatagaaagaaaatagagagttaaaggaggaagaagccacatctctttgggggtcaacatttcagacagtggatacagccataggagtggatgaaagcaaagaggagggagagagaaaggggcctggagacccacgtcattcatggcatctgggagaccaagacttagtgagggcagagaggagaaccccgtcaggaatgaagttgcagaagacacagcaaggcgacgtgcaagagggaccccagggctcagtggggcaaagggacaggaacgctggctgagtcagaagtggaaggggaggcttcatagatttcaccaaatgacttcaattacttcaccatgaattttcctgaaacctcttttagtggaatgatgtggacaagggccaagagccatggttgaaaaagcaaaagggaagaaagggactttaagcacagcagggacacaaaaagtcaaagaagaggtttttaaaattattatttatatggaatttacttagaagtctaagaactttttttttctttagcagcccagtttttctagaagggcttatttgaaaagaattcccttctcattcctagcaattcctctctaagagtcttacattattattatagacaatggtttctgggccattcttcagttttggttatctgtccattcttgctagggtaatatatgaatgtaacaataattgcagcattatagtgggtttttcaacatctggcagaagttccccctcattgcttttctttttctttttcttcttctttttttttttttttttttttgacggagtctcgctctgtcacccaggctggaatgcaatggcacgatctcagctcactgcaatctccgcctcccgggttcaagtgattctcctgcctcagccccctgagtagctgggactacaggcatgtgccacagcgcctggctaatttttgtatttttagtagagatggggtttcaccatgttagccaggctggtctcgaactcctgacctcattatctgccggcctcagcctcccaaagtgctaggattacaggtgtgagccaccgcccccggccttttttcctttttcaaaatgttcttagctatatatttggctgactccctattgcactcattctttttaggaggataaatatatatacatagagagggtgttatatatatagtgttatatatagttatattatatatatcctcctaaaaatataaaaactatatatatagtttaaaaaatatcaatattaagcagtaaaaattaccacttaaaaagtatatatataaagtaaaaagttaaagcttaactttatccctaaaatactacctatctaagttctaactccaggtaagtactagttaggaatttaaacccatccatctgacagtttcctgaatgtatacagacatacgatatgtaaatatatattggcaaaaatatttccaaaagggggaaaatgtccatccccccacggagagaaaagcacaggatcatgtggcctctcacttcccctcactcttcctctgggtggaagagcatgattagatcctcctgtctctcctttaattccttctacctaccctccccatgtccccaccactcttagtttagaagttctaccatttactgctacattactagggtttacctccctgttttcagcagccttatttaaacctaaacctaaaagtctttataaatatactaaaattaaataaacactttatctgcccattggatttgtcacccaggctggagtgcagtggtgtgatctcagctcactgcaacgtctacctcccaggttcaagcagttcccgtgcctcagcctcctgagtagctgagattacaggcacccgccaccacacctggctaattttcgtatttttagtagagacgggatttcactgtctggtcttgaactcctgacttcaggtgatctgcccactgcagcttcccaaagtgttgggattacaggtgcgagccaccacaccaagccaggagtgaaatgtttaacacacttgtatgcctttcagtctttcctatcctcacccccttcaacacatggctttgttttaaataatatgaaaccactttacttgttgaaatttttccttaagagcaagagtggtggacacagcctagagtgacccctagggagtcacacccttgtgtaattccctccctttgagtgtgagcttccaaccaagagcaaatggcagttaagacattttgaagatgcaattaaggtccctaatcagttgactttgagttcctcccaggtgggcctggcctaaccaggtgagacctttaagagggtccaggctgggtgcagtggctcatgtctgcaatcccagcacttcgggaggccaagacaggtggatcacctgaggtcgggagttcaagaccagcctgaccaacatggagaaactttgtctctactaaaaatccaaaatcagctgggcatggtggtgaatgcctgtaatcccagctactcaggaggctgaggcaggagaatcgcttgaacccaggaggtggaggttggtgtgagccgagatcacaccattgcactccagcctgggcaatgagagtgaaactccatcacaaaaaaaaaaagtccaggccttcccggaagttcaagactggaagcagtggggtctctgtcatagttgctagctttcaaagagcaagctgtcacaaatcctacagccacgaggatataagttctgccaataacctaaggggacttggaagctgatttctcactattcaagcctcagatgagagctcagtcagtcaatacctggctttcacccttgtgagcccctgagctgggaattgactaagccacacctggacctaggaaactgttaggtaataaaagcatgttgtttaagccagtaccgggtactgatttgttatgcagcaatagatagctgatacagaaggcggatctacttttttcaagagactttccttcaccattatattaccattcacaatcacataaatatcaaatatttagatttatgcctgcatttaaaggcatacatctcttccttccattctccatcttcccctatctggatatctttgttttgatttagttcctatttggtggcgatgcttattaaggtacttatcttagggtatagggtgctatattttctgtatccttgaatgtatggcaatgtctttcttttgccctcaaatataaacaacaaactcctagtccttttcatttaaaagtctgaaacgctgctctgctattctttacctcatgatagagaggggcagtacaatgccgatttgattctctttcttctgtatgtaacctgtgatcccttcgaagaatcttgtaaaaaattctctttatccttgcagttacaaattttaccaggaaatctcaaattgtgtatcatctccttcattaatcccattactgccctgtgagcccattctatttgaaaataagactttcttcacctcacagacacctccttctaggagttagttaattctgcttctatttccacatgctccttcttctggagcacccatcgctcaggcagaagcagatctctcaaatcttttctccatgtttcctgtcttttcactcgtggtttccacttcctcatattttgattctctcatgcactagttcctcctttttattcagatccaaattcaattttgagtagtgtacattactttcttcacttcctttcttgagtgtttagagctgttgttgcaatttttgtttttatttcccaaaacttttctccctctctgagttgctggcgtgggctagtgtactggccaggctagtgggtggaaatcttggcagagacagacaacataacacattccccttcagggatggatgggcagccaatggggccctgtgtactaaggcatgaggcagagagaggcctcccagtttggtgttctcaaggccacaaaaaatgggggggccagctcagcctactgtgcaatttccttagacagcagcccgtagccatgagatcagtacacccctctgcctcctagggtcagacgcagcacaattacagcatgcacttcctctctataagctgaaggatttttttggactaatctgttcattgagtcatcagttctctctggagccctcatcccctgttcttgtggttaagcaaaggctcccagcacacataccctttcttgagaccccaaatcttcagatgaccccattcagggtcatctaccttattgagccatccctagcagagagtcaggagggatcagagatattgaatgtcaatgtgagctgccatcttcctagaatcttcatttgttcagagtaagaaatccatgaaaatatttatacacatggaaaggagcaaggggaaagaaggaggttgaagatatgtagagagaaaggtaatagatagatagactcagaactgagaagcctgagaatgaagccagcacatctgctgttgtgtcctggtagatgttagtggagtttggttctaaccgaacgtcatactccaacagaagcatcagatctgtggaacacaaagtcaagacctggcccagcttcagccctcttatccaggagcttaatcaagttttcagtgtagcctacaaggccatgagacttgccaaaaaggttactaaataaaggtaggttcatccaaagagaagcaacggtgagggcaatgcaaggtctccagccaggtggatggcatcaagcaagcagcaataggagcaagcggttgaatgaaatggctataaatagagcccacaaacgcattccaaaatctaaacccggccccgtagttatggcttagagaaatgtgtgcaacagctgataaataggttctcctggaacagggccgtctgaggatatctgggctccaggaagccttgccatccacaaaacgtggccagaggccagtgaagatgctgggaaagggctttaggaaccacgctgaccaggcttataggggaagagcattactgtccacctcatagggttctcggggggatttagtgagctatgcacattaggggttagaacggggtccacacattggaaacactctgtcaatgtcgcctgtttttaataagcattaacttacttgctgatacatgggactccgcctgcctcctccccaagaaagcacagcattctatctctgcataagaagctttataggacggcatccttcctcttccacagttttcacagccatggtctctaacctatgtctgacagtccatcttaatattactttttgttttcagctttttacacattcaataaaaaagaaagcgaggatccacaaagaacaggacaggaaagggggttgtttctcaatctatcaggaagaaaccagagacttgcaaattggtctccttggaccgattaatcatgccagcttcagcatttgattgttattctgaacaattcatggtccaattagaggtttatgcatttacactgagaaatacatgacgtcatttagagccattctggcacaggaaggccaggcggcctctcacctttgtattctgccaggcacacacactcatagccattaacgaggtccctgcaggtggctgcattcaggcatggagcggagaggcactcattatattcctcctcacagtagaggccatggtaacctgagggacagagagaaaggcccactgtcaaatgcatcccatttacaacccacgcgggaccagcctgcaaggaaggcagttgggggtattcattagaaagtatggtataaacagatgggatttcaggagctagatctcttggggtaaagttgaaaggtggatttgggggaaggctatgaagaaagcgcctgttcttatcacactttttcatgatcccaagtataaaagaagtgattccatttatccactgacattttcatcatagtgcatccaacagtgctggtgttagggtgatccagtcactgagtgtgtctgctgtggccatcagagatagtgaatgagcaggatttacggcaggggaggagcaaacagctcccttcaagagtgagaacctggctcggtgtggtggctcatgccaccacaaagtgctggtaatcccagcactttgggataccgaggcaggttgatcacttgagctcaggagttcgagaccagcctggccaacatggtgaaactctgtctctactaaaaatacaaaaaattagccaggcgtggtggcgggcgcctgtaatcccagctactcagtaggctgaggcaggagaatcacttgaacctgggaggcagaggttgcagtgagccaagattgtaccactgcactccagcctgggcgacaagagcaaaactccatctcaaaaaaaaaacaaaagaaaacaaaaagtgtgagagccacattagaaaagtatatctgtatttccttttcaagtcagaaaagaaaattagctcaaaatgcttaactgaaattattgatgaaatgtgagggtatttttgttgttattgcttgtttaaagatatgattatataaattataatattttaaattgtacctaaatgtttaaattactaaagaaataatcatgtgagtgaagagaaaataaacccacaatttcttgataaagtggattttaccctcctatttgcaaaacaggtgtttattctaaaggacaagaagacaacattctttgagattcattcatgagggttatgctgttttcaacttttgaaaacatgtgttactgccaatttgcagtgaaaccaggccatttttgtccagccctgtccaaacaatgaaaaacatgtgagtgttttcaaaagtcacactgactgtgttcgttctgaattcagataagcagaaaaaataagcccttatccaagtaggaattagaactactagcttttccctagcctttccagctcacaaccaactctcaaactcagaaagtcccattagaacatgctaatatgttgaactgctttgtttcttgtgcctatcataaaagtaggttaagctcatatttgcattattaacagagcacttttcaaatatgttgccatttcagttgtttttgaacagctttccaaatttaggttgtgataatggcccctttgaggagcccttgacctacctaagacaaatatactatagttttcaattcttctgaaaagtagtatgttaccctactttttgtaactttagggaaatatttctattacccttcattagattattttcatcatgtagataagaggtactcaactagcagcaattttgtcccccaaaggacatttgaaaatgtttggagacatttttcgttgtcacaactggaggcagggggaggggttgctgctggcatctagtaggcagagtcaagagtgctgctaagcatcctacagttctacaggaggctgcgcaggacagcctctcacaacaagactatccagaaaaaaataacaatacagccaggttgagaaactctgttctagaccaggggtcagcaaactatggcccacagatgaaatctatcccagcctgtttttgcaaataaagttttattgggacacagccacagtcatgcatttacatattgtctatggccgttttaacactacaacagaggactgagtggttgcaacagagaccatatggcctgcaaagcctaaatatttactgtctggccctttgcgcagaacaagtttgctgattcttgatttagattcaatgaaagatctttcttttaacaagagttttggatattaaccccttatcaaatgtattgtttgcaaatattttctgccattccataggtcaccttttcatgctgttgattgttcctttgttatgcagaaccttttaagtttgaagcaccacttgtatatttgtgcttttgttgcctgtacctcggatatcatatccaagaagtcattcctaaggccaatgttatgaagtttttcccctacgttttcttctagaagttttatacttccaggccttacatctaagcttttagtccattttgagttggcagttatgtaaggtacaaaataatacaaatggccaacaggcatatgaaaataacatcactaatcaacatcactaaaaatcagggaaatgcaaattaaaatcataacaaaatatcacttcacacccattaggatggccattataaaaaacaaaacaaaacaaacaaaaacagaaaataacaagtgttggggcagatttgaagaaattggaacctttgtgcactgttggtaggaaggtaaaatggtacagctgctatgaaaaactacagaggttcctcaaaaaataaaaaatagaaccaccacatgatccagcaattccattgctgggtactcaaccaaaagaatcgaaaacaggatctggagaaggtaatagcactctcatgttcattgcagcattattcacaataaccaagaagtacaaacaacttgatgtccattgacagaagaacggacaggtcaagcaaaagtggtacataatacaatggaatattattcagccttaaaaaggaagaaaatcttgtcatgtgctacaatatggatgaaccttcaggacattacattacatgaaataagccagtcacagaaggacaaatactgtatggttccacctatatgatgtatttttaaaatagtcaaactcacagaagcagaaagtagaatgatgatgattgccagggtctgcggaaggggaaaaatggagagctgctatttaactatgcaagatgttatgcaagatgaataagttccagatatctgctggaaaacagtgtgtgtatggtaaataatactgtaatgtatacttaaacatttgttaagaaggtacatttaatgctgtgtttttttaccactatatatataaatatatatgtattattaaatatacatattttaaccactattatatacagatatatattttaccactatctgtatatctatatctatatctctatatctatattttacctactatatatatagtgggtaaaaaatacacaacataaaaaatatatatagtggtaaaaaacatacaacatgaaatatatatatatatatagagagagagagagagagaaagtgggagagagagtaaaaatatatacatatatatccatgtatatgtaaagagttaagtgtcttttgcttctcctaatatgagaagctttttgaggtcattgtggagtacaatcaccagcagcaccttttcaattgcatttgccctcctaggagatcttttaacaatcaacatggaagggtaatatataaccataaccctgcatgcatctttgacctctgaattgaggtggcatttaaatagacaaaaatcaaacaagcaagttttgcaagatcatctttaattgtttccatttttgaaaacagtatcattatctttttatactagcaatatgaaaagcaaatgaggaagttattttacagagataattaagctggtgatgtttttcttccttgggggggaaaaaagataaagttttcatattctaaaaccgtttcttcagagacggtaacatttaaatgtcttcatggaaatgtcaaggcaccctttatactcagtgccaagcagcctcaatcggacgatttgaataaaaaggcactccttccaaaagagagggcttctgtgaaaatgaggctatcaccccctgctgataattaattcaggcaaacaaattagctcagggcagtatgcccagtgtctgaaaaaaaattaggctaatccaaagattttttaaaaataaaataaacaatcaaagggtgggatcagagtggccctttccaaggcactgatctttatcagcactgctcccatctttgcatgatttgctcccgaataatcagttccccttatttctttcggattgacggggcacagcaaccaaccagatggggggagtgagaaagagcggtggagatggctgccatgtctagctgagtgagcggatgaagtcattatcaccaagaggtaccaccaaaggaaaaacagacttagaggaggaaaaacaggcttagaagaagaccagtttaactttggacgtgtttagattgggcacacttgggcaggtccaagtggcagttggaagtatgcgtgtaaatggcttagaaagagcactttgggaattagttgcctggaagtggttttgaaattttcattaaagaagaaaatggaagggaaagaagaaaatggaagggaaaaaagaaggggtcaaggtcagaccacatgggcaggtggagaacaaagagccagatcaagacactggacaaggattgggcaaaaaggaggagaaaagcccaaggcatgcagtgccatggaagccagaggatgaaaggatatcaaggaaggtgggttagcagtgtcagaggctctaatgagcaagaatgaccactggactagaaaatgaggaggtcactgaacaccctcaaaaccatggttcttaatggtggctgtgctagcccttagatggtgtttagagaaaattaggggtgggagtgatccttatgcaatgattggagggttctactggaatttaggagggtgggagagggcaaagttattaaatattgcaatgccctggatattcctgcacaacaaagaatgcctcctcattcttcacaacaatggactgttccactggaccctcatgtaggcaaaaaccctgttgataactttcccaaactaaaacctaacttctttatatgtacagcaccattttaagatatactgagttttaagccgggcacagtggctcacccctgtaatcccagcactttgggaggctgaggcaggtggatcacttgaggtcaggagttcaagaccagcctgatcaacatggtgaaaccccatctctactaaaaatacaaaaagtagccaggcgtggtggtgggcgcctgtaatcccagctacttgggaggctgtgacacatgaatcacttgaacctgtgaggcagaggttgcagtgcaccaagattgtgccactgcactccagcctgggagatagagcgagactacatctcaaaaaaaaaaaaaaaaagatatactgagttttcctagaatgtactacttgataaaccaagagaagattgtaccaagaattatttatcattttaaaaaaacacttcacaagaacaacagctctagtggaatttaaatctccaataaagaatatctatatccataaaacaaaaacatcaacaaaaatcacttcctcagatagttttctgacaatgctatttacagtagctcttcccaccagcaactcatcacgacactcagctgatttccatcgtagcatttgtaactgtctgaaatcctatttttatcatagttctttacttgattatcacgtctcttcctccactacaggataagcttgagggtagagtctgcaaacgcagtattcacagctgtacctgtggtatctgtgtcggaaaaggctacacaaataaaactgttacataagcacccaaaatgttatcaattgattcgatgcacttttaaaatgtttccatggtgctccaggaccttccaggtgccctgggtactgcctacaaagctaaagaacagggtctccacctacacggagcatccagtgtggtagcaagttagcagcatctgccttatgtcaggccctttagatgtgttaacttgtttaattctcataaaaacccaaggcgatgggcatgaatcatcccaatttatagatgaggaattaagagttagagaggtaaagaaatttgcccaaagccatgtagtcaatcctgtgtgttcttccttctttcccatgttgcctccaaacgcattgtctagtatgttagtttattagggctcccatgaaaatactatagcactggttgaattaaacaaaaacttattttcccagagttttggaggctagaagtccatgtcaaggtgtcaacaggtatggtttcccctgaggcctctccccttggcttgcagacggccgccttctctatgagtcctcacatgtccttttctctgtgtgtgagtgcttctcataaggacaccggtgctattgtattacagccctacccttataatctcattgaaccttaattacctctttaaaggccctatctccaaagacattggaggttacaacttcaacatatgaatttggggtggagggcctaatttagtccttaacacctagaatctgagtttctcagtcacaagactgttggtattttggaccagatcataatcgcggggagcttccctgtgcactgtagaatgttgagtcgcatccctgacctctacacaatagattccaataataccatccttcccaggtgtaatgattaaaaatgtccccattgtcatatgtcccctggaagacaaaaatcccttttggagaaccactgttctagatcctttttataagatgaaaacaacttgaagagatttgagaacatgagggtttcaaattgttgtgaagggtgagagttcattcatcagagcaaaaggatttctggacaatacctaggagggcttctgcccttgtgggtttgacataacacagtccatggggtgactctctcctgtactgctatcccacagaaggaaacaggccctgggtatatctgggactggctcataccaagcaaatgagatagagcggagtaagaagggagaacctgcctggtgatttttgagctaacgagaaccctgttgaatgctgtgtccttggattgggactcctctctgtgccccctatgaagcctccagccacatggtgaagctggtttctagctagtgctcttcctacttttcacatgaaaagaccacagccctacagccttgaccagttcagcaaaggcacggtggagcccagattccagcccacagaccctgacctgctccagaacaggacactttgctgcataaaggtcttaagagtcactcaattcctactctccccagtaaaaggcaaagccttccatggcctttcaccatcttccctctcaacactgtcgcaaggcaggatttaaacatcaatccaggacccaccggctctggttccacagtgtgtttgctcacaggagtactttccctctccccgcccgtccctcatcacactcaaaaatatccaaaactgtaagattctagctgtagccagatggctttcacacttcgtgcaacaaattcccagcgactcatctgtcagtatcacctctggagcgtgatttgtgcttcctgctgcctcaggcaaacaggaccttcgaagaccatggtgctgtgatcaggacaaccagggggaggtcatgccactcactcccctcgtacagactgaattcaaggcaagagtgaatttacggtgtttggggcttttatttgtttttactttatagtcaggctgaagtgagtgcagggctgtgaagagtggttcctttaatgatgcaacacaactcaaaggatgttttcccttcttttcagcatgagtggataaaatgtgaaaacccatgactttctgattcaagtctaggccagttcctgggagatcaaatattccacctcacccatagtagttaaagatatgggggccgggcgcggtggttcacacctataatcccagcactttgggaggccgaggcggatggatcacaaggtcaggagatcgagaccatcctggctaatactgtgaaaccctgtctctactaaaaatacaaaaaattagctgggcgtggtggcgggtgcctgtagtcccagctactccagaggctgaggcaggagaatggcgtgaacccaggaggcagagcttgcaatgagccaagattgcgccactgcactccagcctgggtgacagagcgagactccatctcaaaaaaaaaaaaaaaaaaaaaaaagatatgggtcacagagaaaataatcctattatattaacatgattgtgagctttcaaattctggctaaactcactggtggtcatagagccctttggcgctctggaatgtgggacaagatgcattcattttgctgtgtagagctttatttcaagggaatctgtgtgggtgcgtgtgtgtgtgagtgagtgtgtgcatctatctcccttagcctctcttgttgctggcaggttcataatagaaatcgattaaagaacagaaataagaacagaggcaagcatctgggctcacattaatcctattaagtgttcagatgctctcgtttaaacgaacctgctggttttgataactgcacaggttttcactgagtaatcgtgcttctgtcacacacacacacacaacacacacaataaagccagaaaatacttgtgaacatggaggaagttgtgtaagtcaatgcagagcattcgttggtgtgtggcagacaatagctgctgatgtttcttatttctttagtctctaatttcttatccttttattgctcatggcaactaagccagaaaagaaaataaatgtcagaagacccaaatcagtcaatattttcacttgctgtgatttttataaacattaaattgaaaggactaaagacagaggctaaattaaagtttttgactgtaaaacctccctattatttatgttactgagccatctacaaatttccatctccctccctgggcttccaaaaggatggatgatgaaaagccagctctaaatcatatcctcactgttcacaccatgagtttatattctccctcagtgcagaggctctctggctttaatagccacatggggaaggttggtaattctctgtttctcatatttgcctccttgatcgattcattctttaagtcaacaaatagttattcaatgcctgctatgtgtcaggcactgtgctagtcactggggctatctggtgagtaaaaacagataaagtgcctttactggggcgcttatgaggggaaaaacatcaatcaatcattcaagtcaatggaaaatcataactgggaagtataagcaatgaggggcctggtgttccaggagggaggagagggaggagatgcaggagagctgaccttgccccagggaggctgccaggaagaggggaaagtgagctaagagggaggggtgtgcagaagaatgatgagaaaattcaaggcaggaaaagctgtgggtgcaaaagacccacggtagagggaccacggcttgtgatttgttccagacatggattgcaacccactgtagagcaaagggcagagaagaaataagaacactgggctgggcatggtggctcacgcctgtaatcccagcactttgggaggctgaggcgggcagatcacgaggtcaggagttcgagaccagcctgaccaacatggtgaaatctcgtctctactaaaaatgcaaaaattagccaggcgtggtggcacacacctatagtcccagctacttgggaggctgaggcgggagaattgcttgaacccgggaggcagaggttgcagtgagctgggatcgcaccactgcattctagcctgggtgacagagcgagattccatctcaaaaaaaaaaaaaaaaaagagaaaaaaagaaaagaaaagagaaacaggcaggtgtcaggcctggtggtatctttcatgtgggtggtggggggatacaaaatcagatttgcatttcagagagattgctccagctaccctttggagaatggggataagacctgcaagaatcaatgtggagaaatcagtgaagaggctgctgcaatcgtctcgggaaatcacggctgggatgagagtggtgacagggccatgtggaatataaatgtcaagagccatttaaacagtaaatagaaatacctggtaatgaatagaatgtgaagggtgagaaggaaggagaggtggaaggggaggcccagattcctggctgttttgtccagagatactgcaatttctttcaaaggagtgcaggaattgacatttattgagtccccttctatgggccaatttctcttctaggcactttaaaatacaacagaagctcattagaaggaaggggctggggaggggaatggagtggaagggaaccatattctagaagaagcagatcttaattgaacaaaaagaattgacaggttctcccagaaaaacggaagtgatttgaaaaaaaaaaaaatcagttcattttaatgagtatttgctgaaatctgactatatagccaagcattgaactagttgctgaggggttcaattgtgctgtagttaagaaagaaaggccttatgtaagaagacacaagaagtcagaggtggagggagggcagaaaaagagagagcaggatcaggggagcatgggatgggtagagaggaagagcaaaagagagacccagagttatcaagatggagacagaaaagaaacagagaaagagacatagaaagagaaaaagccaaaaagataaaatagagagaaagaaaaactggtccagaacatgatggaattacactgggcagacagcaaggtcgctgccagaaatgttgtgggcccctgcagagtgatgtctccaactggcgtaatgaccttgagcactgcccttggagggtcaccaagatggtggagcatatgggggctgggggtacaatgtgagagtttgagagacaatgggacacagcaggattcttgcttcccaagtgaaatacatattcttgcttcccttattaaaataaaatgtatttgatgctattttctttttattaagtactttttgtaactcagtattgagagtgtttctagatggggagcactggaccatcaggcatacagttgcagctcagtgccagtgtgtcacatcttccattaaggccattcatgggcacttgtggcaacagaggatacttataaaaggaggagtttctgcctctcccttaggaggacacgggcctggcattgtccgtgaggtggtaacacaagggaagcattaagcacaatgcctggcgtaagcacatcatgatgtgatgtgtggtcacctggcctgtgaggcaaacgtgattttaaaagacaacctgggtgccgtacttctgaaataggtgcccaccttgcagacacagcaaaggccctaagcaccatagccctgaaggacgccattaccctgagccatagtttcacatggtcagcaaagaccgcttactagagaagcacaatagcaccagctcagcactgacatggtgcctggctgattagcccagatttcaccacccaggaacttgaagatctaaatttttccaatacgaaacagcctgtttatgtttggctttttaaaacctaccctttttccttttcatagccccatcccctgagattaacctcggggctggatctggtttcctgcttggcagtaaaacttcgattcactgctcaatatttgattccaaactctgcattttctctttaacaacaggctgttctcctctcatttccttagcacacaggttgaggaatatagaagatgcttgatcaaactgggtaaattgaatttgctagaaaaatagaatcagagggccaaataacctttgcatacataaatacagaagagttcttttctttaccagtgcctgttttgcacaaacatgcattaaaaggcttggaaaaacatcttccaaaattgacaattgttttgttaagggattcttttattaatttaaatatgtatattcatgttttctaattttccattaacagagatatgttattgtgtgatataagcgggtaatatcatccatgctgtgatggttaatactgattaactgatggttaatactgagtgtcaacttgattggattgaaggatacaaagtattgattctagctgtgtctgtgagtctgttgccaaaggagattaacatttgagtcagtgggctgggaaaggcagatccacccttaatctgagtgggcaccagctaatcagctgctagcatgactagaatataagcaggcagaaaaatgtgaaaagagagactgtgacctagcctcccagcctacatctttctcccgtgctggatgcttcctgccctcgaacatcagactacaagttcttcagttttggaactcggactggctctctttgctcctcagcctgcagatggcctattatgtgaccttgtgatcgtgtgacttaatacttagtaaatatatatatatatatatattccattaattctgtccctgtagagaaccctgactaatacacatgttttatgggtattttatttgtagtaacacaactctaaattatgtcaccgattacaagggaaatgatgaccattctttatgtctaacccttgattggcagtaaggaaaacagataatattagaaaaaccctaactttttaaaatatttttttagtggagagataagaacatttcctatagtctataaagggaaaagactagacttattagaggagattttctgagatgcagggaacagacattataataaacgcactgctagtaaagaaattgttttttaaaagaagaattatactttttaatatgcagaaaagaaaatctttgaagatgttaaaaattctgtaacttctgtagatgtactgagtgtaaatcataattaatttatatttggaaaggaaacagttcttaaatatacagtaaaaaccaaacgaccactatctggagttatctccttaaaaatgagcattctccctcaaaaacatttaagaaaatctgggactatatggaagacgacagctcacttgtgactgtgcttatgaaggacactggaagccaggagaaattggcagtgaacctgctttaacggaaacagtgtctaaaggcctttgactttaaacttgtccatcatctggggaatctttctagccatgttgatctaaacatttctgaaagctttctcttggaattggcttcaggactaggttacaaactagtcacactgagaaaaatcaatctcttcacaatgttttagctatgtcttatgacttttttttttaatgttgcttttggccactagagggtggattctacttattatctaggcaagtgaaaaaggaaaaaaaaaaagttactcaggagtttaacaaaagaggaggactaaaaagataagtgtggggaggggggagggatagcattaggagatatacctaatgctaaatgacgagttaatgggtgcagcacatcagcatggcacatgtatacatatgtaactaacctgcacattgtgcacatgtaccctaaaacttaaagtataataataattaaaaaaaaagaaaaaaaagatgtcttttacaaaaggaaatagatggcacagagggatgcaaatgaatctgccaggttatatttaaagaagaaatcccattccctttaataataaaacataacattcaaatatttctctacagcttgcaaattcaccaatatgtcctctataaacatatggtgtctacagtttaaattatccattgtaaagtggcctatttttcttactttttatttaaaatatttttaatgcaaatgtttgtaataccatgattaaagcaccaagattaaatactaagtataatgacaaaataatattttataatttgagttaaagattattgtgctatgtgtgtttacatataaacagtaagaaaagcattttaataaaataatcccataccctcaattgattatctagcatgtttataaacacataaaaatggctggtttataattgaggtgaggaagatgataagaaagtttagaaaagcaaaggtagacatacaccctcacattccagaagtttttcattatgggatgcacaaagatgggtgctggggccagcaaaggcaacaaatgggtgggaggggggaaaatcaaagactaagactctattatggcactttgaagagaaaataaaacctagataattacttttacacaagtatgcatactaacaaagagaaattttaaacggtataaaagtatagaagagttttaaaatgtttatttccttttaatttatttcacaatcaattggttaaatttggtttagttgacctcttagttactaatagacattcatttgaggtatccgcactcatcacacttgggtctcagtgcagtccccagaccagcagcatcaacaccacctgggaactagttagaaatgcgtgttctcaggtcacactcaagacccgctgattcagggactctaagggtagggcccagaactccatgacttaaaccctctaacatggttctgatgagcactcaagtttgagagccactaagctatagaatagaaaagtatacaacgtctcccacaatctctgactctcacaaatgcggggaaatggtaggggttgtccaaggaaaatgctacatatagtgtggttatgggattttttgtgttttgttgttgttgttgttgttgttgttttgagatggagtttcactctgtcgcccaggctggagtgcaaaggcgcaatctagggtcactgcaacttccgtctcctgagttcaaacaattctcctgccttagcctcctgagtagctgggattacaggtgcctgccaccgtacctgactaatttttgtaattttaggagagacagggtttcaccatgttggtcaggctggtctcgaactcctgactatgtgatccgtccgccttggcctcccaaagtgctgggattacaggcgtgagccaccgtgcccagccggttttgtattttaacagccatggcatctcctaagcgcgtttaactaatccaaccgcaaaacatatggtcagaacatgtaccagctatgggcatataaataaaccaacagtgaaacatatagtcaaatgatctaccagccatcggcacatggactaaaggaagctaccctcctctcgaggtttacataagggaaaaaagtaacacaaaggaatcccaaagtgacaacaaatgacgtattggaaaagaaaggccagaatgagggaaagtaataaggatatagctgtggcacaatgtgttctagttcctcactgtatgactaggagtcacacatgcctaagcggaatgaggataaacaagttcatattcaaattcgtgagggcaatttttcccacatctctgatctagcttccttaacccacaggaataatatttttgcagaaaggaatgtcagaaaatggaagatattagaagtatttaatacagcaccaagattaagattttgagtaacatacagaccagtaggtaatattaaaaataatattatagttttgtaaagattaagtgtgtttcaaattgactatcatatactagacatttgtgaattagctttttgcattcctaattatcttgccgaaaatttgctctgaaggtaatttatgttgcttatcttttaaaatatattttgaataaaacataaaagctctactttaaaaaggaaagaaagaaaaaagcataaacaatctaaggtaacaatttttgcaaaccaaaaattgggaaccatgatctgacaaagttgcgctgtttccaattatatatcagaggtggcctcatagatacatagtttggtagcaaagtatttgtgtgatggaaaacaaaatactgtgactgggattattccagaaaattttggtacacggagtccacaatgcagaccacgattatctttctggctgtatttactttcattcccctatcactggggacattcacaggcacaatgcaatcgtgtcatcctctaagctttctattagtcattgccattctcgagtaaatatgctaaatcctaaatattgttaaacaccagggaaatttctcatgatcctttaagaacagttttagaagcacacaccttccacttggccactatccctaagggctacaaatgcccaagggctgaagctgacagtcaggacttcagctaaagaatttcatggggaaattcagccttgatgcaactggattacaaagaaaatttcaaaatgtaaataaatcagaaatgacaactcaattatatgagtaaattctgaattctcttccaactttctttattaaattaaggatgcctaaacacacagcatttgttcatttaagagttgataaagcagtgaaaaatcagaagtgtgtttttatttggtgacttaagattctaggagaatatatatgttaataacctgaagggaaaaatgaaacttctttgaaataaagccaggaacaaggctcaatctatatggaattatgaggtaagtaaagaagttttctcctagacattccttatcacttgagtaggcaagttcaggggacctcaccatttcttttcaagcaaccaaagattaaacactgtttttcaactttctttctcctcaaatctgcttacatatatagagacaatttatatatatatatatatacacacacacacacacacacacacgtgcacacacacacacagacacatcacatcacattcttcacatatttaggtttaaggttatggtagattgaaaaaaaaatagctacaagttctgtgcagctcctcctatcaagaaacagagtctataagcttggccctgtgacttgctcatgccactgggacattggcaaacaacagaagaagcagctttaaagagagcatgcatatgggaccttgtgttctgttgctgctttcggaaccctacaatcgtgggaagaagccccgactggtctgctggatgaagagagacatgtggcttagttgcccccatcactccagctaactgccagcaatataagaggggtcatccaggacccggcagtccccagctggcttgccagctgaccacaaaagcatgagtgggcacatggaatagagaagagacatcccagctaaaccctgcccaaattatcaacccacagaatcacaaacaataagtggttttcttaagccatcaagtcttggaatgttttgttacacagcaatgactaactaatacaaaggttgattgccaggtacaatgtctaacttaaataaataaaaccacaaagataaacttttaggcatcagagacctggtaaaaaaggtatttttacggagtagtaaagaggagtcttctcaaaatagtaccaccaggtactacatattccttagtttagacctactttaattgggcttatccaatctaaaagcaacacctactaatgaattgaacctaggacattcactctgatctgaggcatcagaaaccatctggtagagtaaaattgaaacatgatcttggtaatcatcaacatatcattaagacttcagtccaaccaactaaggacctctttaggcaattcctataaaaccaagtgggattgtaattttttaatgattttggcaatatgtttattcacaatataaactgtttggtaaaagataaacatgtgcctaacaagttaacaacatttgattgtgattttttttaacttttattttaggttcagggatacacaggcaggtttttcatataagtaaattacatgtctcaggggtttggtgtacagattattttctcacccaggtaataagtatagtacacagtaagtagtttttcgaccctcatcctcctccccactcaagcaggatccagcgtctattgttcccttctttgtgtccatatgtactcgaagtttagctcccacttataagcgagaacatgaaatatttggttttctgtttctgtattagtttgcttaggataatagcctgtggatccatacatgttactgcaaaagacatgatcccctgctttttcatgactgcacagtattacattgtgtatatgtaccactttttaaaaatccagtctaccactgatgggcatttaggttgattccgtgtctttgctattgtgaatagcgctgtgatgaacatatgtatgtatgtgtctttcaaattcaggaaatgcagagaacacctatgaaatactacaaaagaaggccatgcccaagatagtcatcagattctccgatgtcaaaaatgaaagaaaaaatgttaaaggcagctagagagaaggagcaggtcacctacaaagtgaactccatcagactaacagcagacctgtcagcagaaaccctacaagccagaagagattggggacctgtattcaacattcaaaagaaaaaaaaattataacaagaattccatgtccagccaatctaagcttcataagcaaaggagaaataagatgctttttgaacaagcaaatgttaggggaatttgtcaccaccagacctgctttacaagaggtcctgaaggaagtgctaaatatggaaaggaaagaccattaccggccactacaaaaacacacttaagtacataaagcagtgacactataaagcggtcacacaagcaagtctgcacaataaccaactaaaaacatggtgacaggatcacatccacacatatcaatactaaccttgaatgtaaatgggctacatgccccaattaaaaggcacagagtggccggttggataaagaagcaaaacccaatggtatgctatctttgagagacccatctcacacacaatgatacccataggccaaaataaacagatggagaaaaatctaccaaacaaacagaaaacataaaaaggcaggggctgctatacaaataggattttaaagagagcattgaggcactgcataaagaagcacgtgagtgagatggaagaggaaatgctgttttgaaaaatcaatacccgctatgagttgacaatgttctgggatttaaagaaaaggttatgtatcaatctgcttcaggcaaacctaagagctctgaatcttcattaaaactgaagctgttctgtaaaagcattcagtgaatgcagcaactttcacagtgtgctttcaaactgcaaattaatgggcatgatagaaaacaatggaagaaatacagggcattgtccccaggttgttgtataaatccaaaccaatgaagaatttaaatgcatagtgaaggctacaagtccagaaaaaagtaggacatgcagcaaatctccttattggtggtctaattgggactcaggaagtagactaccataagtcacaatatatctcaaacatcacctataatggcacattgttacagagtttccaatcctccatgattgacattgacggcaaatcatttccactaagccagtcttgtgggaaggcgtgctactgaaggaacatgtcatcaaagctatctcaaagtagagaactaaaaacaacaaaagtcaaatatgaaaaggaaagaacatttcagggactataatgtcaccagagccaggtgaaaagaaacaacatcaaaggaatccatgacatataatcatcaatgcaggaggttttcagggaatcaggtggtaagaaaaattgctagtaggcattggggaccccagaaatgagaagagctaatcaagagaaactacctaggctgaagggtgcatagctgtcatgtggttatgtctgcatttctcatttgagtcacaggaaaggaagtttctttaattaggtgcatccggcaggcatcaaatcaaataaaatcataagcttcagtcacaggtagttctcagcatcaatttcaaagaagtggattgctggatctacagaatgaagcaaagacagaagaagggggctccctacctagatgcggttcaatacccttggaagtcagagttgcgcttctctgtgctgggaagtaggaaacgtctattggtcaagtatcatccattgaactataatgaaggccacctttcatgccaagctttgaggcatccacttaaagatccatctcaggagctatgctgagacagaggagtctggaatcttgttcttgtgattggttcaaacataagtgagagcccaggtttgcacctaacttggggtgtcacatgtaggcttctgaggattagggttaaaatatcacctccgcctcctgttgtttaaactctcaatgcctccattaccttatccttaaataaaagaataggaatactccaacggggggcaagtaagagaaaataagtgtcaggtgtttggcacacagtctattataaatgcagtaagctttcatagatagtcgctactctagtcaaagccagatgggatgaagtcactctctgggtcaacagagctgaatcaatgtggctgacaaatcccaatttaatatattaatttgaagtggctattaacacagctaccacttgaaaaatctggttagaatacctaatgggtacgatgtacattatttgagtaatggctaccctaaaagccctgatttcaccactatgcaatctatgcgtataacaaaattatacttacacttcataagcttatacaaatttttaaaaacagaaaaatttttcagtcagttatttacccttggtgagtcaaggccacttttgaccccatttgctatttactctgagctaacagaggctccagcaggtcccaattgcctggattcaagtcccagcttcatccttaactggctgtattgtcatgggcagagaaatgacaacaacaatgggtcccacttcataaggactatggggattcaagaagccaattcaatcaaagagctttgcccagcatctggcacttaaatagttatcaccggagtcacagaaagccaccatcaaggcaagcagtcgcttaaccctgcaagaagttgaatgtgcacccattattcaagaatgcccactatggccatttcatctcacctccagtccaactctaaccttgaacctcatataaaaagaataaaaacacaaatgtaaaaatgtcctcagtggtctttcccaagtaacggaatatccaatgtctgcgctaatgctccaccattttatagatttcaaggtggaggaccatctgtatcatttcatttgagcttcacaagccagttatgtttgtctgcattttaaaggtgagaaaagtaatgctgatagaggccaatggcacagctgttcggaggcaaagctggtacttaaattcagctcttctcaacgctaagctcaggcccctttccatccagccaaggaagaaaggcaaggcatgcaggatttcagttctaaaatccagattcacagacattctcaacagtgaaagaaaacagtgattggatcataataattttcaaccacatagtaagagtcaatggctttgttacaaaatagtggtagggaggtccccatctgaccctccagggccataagcttgatgagaatgttctgatactgtgctggcagggctgcaaaacgagctgtcctcagaaatgcataggttagtgacgttaagttgttaccagctgccatttgcaactttcattccaggcaagatgacgtaaaatgatttctgctgtcctcacagactctgctaactcctatttttagtaggcaaatctcacaccttttcaacactactgcagcaaagaatgagttctgaatgatttgaattttgagggaaagtcagggagtggtgggagcagaaatcccttacaattaaagaccagttcattaacgttttcatacatatggattaaccaatttaagtgaggtgaaaaagcagccttgtgaatagatttgtaatatcaggaatctcataaaaatttcatgctccaccagcaagtgcccttggcttaacagcagtgtccttcctccccttgtattaatttctcaggtcagaagcctaaagaaggcaaatatcacgaattctacctgaatgcccccacaacttacaatcaaacaagatgaagatggagaatggctgtggccacagtttggaagcatgcttaggaaaggtaccttagcgtctggacgtctagtggagcctgactcagctcctcacgccctgggcagtgccctctcatcctcctccctcccctgactcccaggataccgccctcaccctgcaacctcccgacctcccaactcactgctggctcctctgccctctcctgtggccactactacctccaacctcaaagcaagaactctgcaactctcttccaattttttcccctttctttttacactctcaccctctcctatcttgatggcttccatgactttctctagcatccatacaatgggaactctctctatattttttcccctggtttcagtcttgttcccacattccagccccaagtaagaaccatttaccgacacatccatgttgctcagcctgctgtacccaagccctaaagagggtgcgtatgcacatttcccatttcctctgaatcacccagaggggtcctttgactccattcacacccttgttccccgcatccaactgacaactgaaccctgatgatcccgatcctcacataaacgtttaacccatcctttcattcccacacacaagttcatgcctttatttctattggtacttgctagaagatctctatcttttcatctctttttgaccataatatatgccaaatactatgagaataatctgtctaaaatacatatcagctcatatatacccaataatgccaaatgtctgcaagtcttcttaatccaaactccttagcatctacattctccccacatgtgtccccatgagcattttcagccttactacctattgctgcatctaatgcatcttatcctgcagcaaactggatccactcttctttgaactcctcccccatgacccaggacttcccccacgtataaatccaaacaatatttcagtgtccaactcattggaaattctgaactattgttcagaattttatatgaactattgttcatataaaaattcaatcaattgccatcctcaatacttcaagcattttaattaattaagttctgtcaatgcccttcaaccaaagactactaaggacacacctgtagttgaacaagttgagtttattacccattgcagttagagagactgcacgccatgggaatcgtggagtgtctcaattagaaggtgttagatgggatttattataggatttgaactctggttaggttatttggggagatttcactctagagtgaatgctggatgctgtcagaaagcaggagcaattcttatctaaagaatgggaaggctagagcaagaccaatgctgtatttggtaaagaggaagctgtcactctacatatgtgacactaagaactgagagaaagtggatacttggtattttgcgggttgcagggtgaccttgtttttgtattggacaaaattataaagtggtcttgttttgcctgactctatcatagcctctgaatggtcatatccaatatccgtgttatgtggaattgttgatgttcttaagtccagcagaagacatcatggcccagctgtaagcatcagaccagctcctaacgacctcaaggtctacctgtaagtgccaagcaagctcctgacatcagcggctgctcttctttttctcagttctcagcatcatcatgatgtcaatatacagatttaaacattctctaaagcagagcacagattatgaagagtaaagcaaactctcccttgctacagatgcagctgggtgatcaggattccatttggggtcccaatggtgaggtgggcatcatattttggaatacagaaaaggaaggacatgagggcaggattaggatctggaggaaaaaggtaatatattctatacaatctacaactctcaagaatagtgtgatatgcagatcagaaaccccctacagcatgttaaatataagaatgccttcatcggccgggagcagtgctcacgcctgtaatcccagcactttgggaggccaaggcaggcagatcaagaggtcaggagatggagaccatcctggctaacacagtgaaaccccatctttactaaaaatacaaaaaattagctggttgtggtggtgggtgcctgtagtcccagctactagggaggctgaggcaggagaatggtgtgaacctgggaggcggaggttgcagtgagctgagactgtgccactgcactccagcctgggcgacagagcaacgctctgtcttaaaaaaaaaaaaaaatgctggtaaactagataaagtttttctggttaataacagatgaaagttgtccactatacttactatacttatccaaaaatgtaaaggcacatgggccttagtgagctaaatgtcttcaaacctttgcaggtatatttatttctttattgctgttcaattgctattaaaatcctgaccattaagtcttatccttgatcctgtttccagcaaatattatcggactactgatattttcaggtctgagtttaacagaaggagcagtgtcaactgtgtctttcgggacatacagaccagaaatgcagctcacatgtaaggcatatgtagaaaatacaaaaaaaaaattacatctaaaatccttacaaatataattttctttcaaaaaatttcacttggaaaaagtctacatttcctttggtttacagcctattatatatctggatgatctaattgagttaccagccctttggtgaagaagaatgggcagaggaacttggttggcaactgtgccatgtctagtctgggatttcaactgcagttgaaatgatgagcatcttagatcttgcttgttaaaaaaaattataaacatatttccacgtaaaaatctccaatgccctgtcccttaaattcccttaaatagtaatatgtgaggcacattctataatggcagggttaattcaattccacaagtttagagtaataactcaagtgcaaactatcttccttcctgccagggactccttccaataccggtcatgtacagctattatctgcagaggccaccattgtattgagaacacaagcaatactgtggctcccacctgcaggggaaatggcacccccaccccagcgagttccacctcatcctgtttgtagcagctccaagttctcactttcttcagcagatttcaatttgcaatttttaagagaacgggtagcctatcacttaacactgtcactggaagataacatttcagtaattactcagtgctgacattttattatttaatcttaaaatcccatcagaaatccctagcccgaaaagctacaaacgaagtttgaaaataaaacacccggcaaatctgatttgcagtaatcaaaatggcattttgtcagatgggaactaattatcaacctgacatgacttcaatctgctgccattttatgaaatgagatccgtttgctctctgtaaagaagatcagccttgctgctccatagctagatgcccaatttcacctattctcgtgagattcttccattatgcaaactggtgttgaagcaattacatgctccaaaagatgaagacgagaaatttcacattcacagacttgtcatgttcacctcttaaaatgtaagttcttgcctggtgttaagatgccttttttattttacacagtcacctaacaatctgaagaaacatcccctctgaaggcagtttcagctcccaggttcaacaagagggccctgtcacgattacaaggctctgctttgagactgctgaacaaatgaagggatcatgttcattccacgaacagaatgcacacgtcttcaggcttttcaaggctattaaggggctactgctggaccacagacaattatcaagtcaaacgctccaagtgggcatgaatgttttagcagagaatagacggaaggaaagtggaaattaaacaggagtgatttcacccccacatagctcgagaatcctgctggaatctccacggacagaaagaaagaagagctttcactagtccatgccaggaaatgggctgcctgcctctcatttcatgctctgacatataactctcctctcttttctgatagaggggaaaactgagtcccagagatgcctgtaaatttcctatggttttagtcaataagcgaggatgttagagaggtcctttctaccactctcggctgcctctcccaatgtggaaagagaaacatcaggcagtatattttctatttggttgcctcacacgtgttgaaaaactctatttggtattattaaaaaacactatttatctctaactcccttcaattttaagttttagaaatcaactaactataagaaaaagtttgggtcaggcatggtggctcaggcctgtaatcccagcactgtgggaggccgaggcaggcagataacctgaggtcaggagttcaagaccggcctggacaacatggtgcaaccctgtctctagtaaacatacaaaaattagcagggtgtggtggtgggagcctgtaatcccaactacttgggagactgaggcaggagaatcgcttgaacccgggaggcagaggttgaagcctgggcaacaagagcaaaactccatctcaaaaaaattttaaaaaagaaaaagtttgatataattaagaaaagaagtcagaggagaaagggaggagaaaataaagttgttttctggtcttacaatatttaattcttctttgtggggcttcacagagagaacggaactctcaggagacaggtaataaagtattaaggaagtttttgttcagaatgctgctgaggggtattttcacatgtgttacgacatccagagcagagctgggaacagcgtgctcgtgagtcagtacgtgagtaagcctctgttcttccagcacaattgcagcttgtttagtttgcaaacacaagttgtctcagtgatccacattcccaataggtaagggccagcgccacactgcctcctcccacaggacacgcagctcacagcatgtgagcccgaatccacatggaagaaaactggaccctctgaggggcagctattcctgtctccaccctggctctgaaggagagcatggaggtcaaccaagaaaaatatcctcatgtcaaacacagtggagaaactgtttcacttcaaggtttatgagatccaaaaatgttactgcgatagttcatttcgggtgtcaacttggctaggccatggttcttagatactcgctcaaacactaatctagatgttggtatgaaggtgtgttttagatgagattaacgtttaaatcagcagactttgaatgaagcagatgactctccagaatgtgcgtgggctgcatccaaacagctgaggaccttaaggacaaagactgaggtttcccaaagaagaaataattcagctcaagacacaacacagaaacctcgcctgagtttccagcctgccagcttccctacggattttggacttgtgagtccacacaattgcatgagccagttacttaaaataaatctctctctctctcctcgctctctgtctcctgtttctccggagaatcctaactactaacattgttacaaagcagattaaacagccctattccctctgaatgtcagagcagagaggaaagaggcacttggcaaaatatcagttgcttagaaaatcggggaattaagagtctatgtgaaaaaaggcttttcaacaccattcaagtgccaaattgcatttctcagtaacttgttgagttattcgttgagtatgagacatgccctttggaagttccaggccaggcactggagcagcaaaaccagggacaccggcattcgaatctgggctcagcccccattctgggtgtgtagccacaggcacatgactgaacctctagaggcatttcaaaccttggtgtaaatgtgacactaaaaagaccagagatgtgaagcacccggctcagaatctagaaagatcagtgctcactaaatagtggcttagggtgattgctgctgatacaaaagctattaataaaacacagttcctcccagccctaaggaggagagagacacatacaaggataattaatgttctgtttccaagaccacaaaagtgatattgtaggtgactgtcggaacccagaggaagggaaactgagtcagccccagaagtagaagtttgtacagtgaggtggggtaacggggagcacgcattccagctagaggccattgcaccagcaaagccagggtcaagccaaaccagatactggccagccatactgactggccagggagatgtgtggggattcattgtgctgggaagctttctaaagagccagctcgtgtaaggatggagacatacacagaatagaaacgagaggaaagggctgccccgtgcattcctttctgactacactagtgggttgtgcacacacaaaattttgactagtaatcactcacttctaggtatcaaaacctccataattaaaaatctgtaatgcaaatgcagaaggcatttggaaattaaatggtaaaagttttaaattcttacatagggagccagtgatataacataatgtgcatagagtaacaattttaatagatgacacaattctgaatgtattgcaccgtgcttttcatgcacgttaagatgaaagaagatattctgttaacttaagcacacaatagtaaaagatacacaacacagtgaaagttctgcagtgacttacagtaaattgataaaaatgcttagcctgtgatgagattaagcctgttttcaattttctttattttgcttgttttttctacaatgaatgtgagttgatcatgaaatgatgaaagagtatttttttaaccctgccaagagtaaatctaaaaaagaaagtgtgtcataaatgagtggaattcacttttattcacaagtatatcagtaagtatacttacttacaagcataccagtaagtataccacttttatttacaagtataccaagatgcaaaagaaaaagtaatggtcttttgagattggtttgagattgagaaaaggaagatgtactgtgtaggggcggtacccacctggatcacagaggcatttgtagctggtgcccacgctgcggcacgtgccatgagcacaggggctgagggcacagaagtcaataagctgggcacaggtcggccctgtgaagcccgggctgcagttgcaggtaaagtgtaccccgtccacatagcaggtgccgttgttctggcacggagacgaggcgcaggggtccaccttttcttcacaagcagatccgaagtatcctgtgaaaaaacacatgagagcttaaaaaaactaaaacacatttgcacataataactaatcaactgagtctgctccactgtatatgcataacaattaattcattcacagcttccagatatgtcacaacccaacaagataggtaggttgtttttcccacctttagtaatgtagggttaaaaatattaagccccacaattccatttttattgaaatataaggtatatgactgtttaggagtacatacatacgtgtacatgaatatatttatgtgcacacatgtgtatatgaacatgtgtgtatactctagaaatatatcaaaaataaattaatggtaatttcctaaaggaatatgggatttggatcagcagagggctctcccctcttattttgtatatattaatggggaacacatttcttattttgctttaatagatatgacataatcctgaattcaaaaaattaaaaccatatcaaatagtaaacaatgaaaaagtctctttttcatccttgtccctttgtctctaattcccttctctacaagcagccactgttaacagtttcttgaatatatgctttttaaaaagttgattgttgtaagagaaacaaaagtgatctacccacacaatgaaataccactcagcaataaaaaaaaaaataagtactgacacatcgtatgacatgaatgaatgtcaaaagcattatgctaagtaaaagaagctaggcacgaaatactacatattatataatcccatttgtaagaaatgtgcaggaaaagcaaatctgtagatacagaaagtagataaatggttgcctatggctgggccggaaagaggagttcactgcaaatggacatgaggagtccactggggtggatggaaatgttttaaacttggattgtggtgatagctgcacaactctgtaaatttactaatatgctttgaactgtactttcaaatgaatgaattttataatgtataaattgtacacttaaataaaattttatgttatataaaattatgtaaggctgttaactttttcttttaaatatggttactgtgtaggtgatttttatcttgtttcctgtgtatctgattcagtatttcttgttaaaaaattatacatgtgcatatgtgtgggtctctacatctgtgcatacatgtaggtatatatgtttaacaatgctttccataaaactatacttctttcaatactttaagagcagtttgaaaattaaatattattcaaattttagaaataaaagttaaataatttcactcacatatagtttgtattctaatagtctattacacgtctcttgtttacatttaagtttctatttactcatcttcttatagaactcctagcaatactgacaatttttgttgttgttaaggacacatttaatatgtaaacaaaccaaaataactcccagatttaattatgtgaagcaccactcataaattggcataatcaacttggtatttctctgtgcagtatagaaatataaaattatcctccaaaaaaatccaatgctattcagcattttataaaattcctggtagcttttaaatcttagaaatcctactaaaaatgtaccatacaatcagttttaataacacttgaattctccaaaaagtttcttggcagcctcaagtggaatataattctacccatcatgagatatgttccattttactctgattgaaaagaagatacttaaacatttttcaacatatgacagtactatatgttaccgtcactatttaacatgatttcaaaaataggatttaatatctcaaatcttttaattttagacaataaaataatttttatctgtctagaaaatgcagcatagctgcttaaaatattaaaaggcccatttgatttcctcgagcatgacactaaaagtcattcaatatttttttcttaatatgaaggaataattttgagaaatgaattgaccaagccaccctacagcttgcatttagttagatagtgacccaagattgcatcttatgacttgagaggaaaaaaaaatggtgggggtgggcggtggccagtggggagcagtgcaggttctaggttaaccttgtggatgcactgatttctttacaagaaattcaggctcatgataaattccatacccaaggctgggtaccagtttgcccaaatcagcagctcaaggtgaatcagaaaatcataaatgttaatgctcagaaatagaaatcaatttattttattttattttgttttgttttttgagacagagtctcactctgttgcccaggctggagtgcaatggcacaatcttggctcactgcaacctctgccttcgggtcaagcgattctcctgcctcagcctcctgagtagctgtgattacaggaggacaccaccacgcctggctaatttttgtatttttagttgagacggggctttaccatgttggtcaggctggtctcgaactcctgacctcgtgatcaacctgcctcggcctcccaaagtgctgggattataggcgtgagccaccgtgcctgggcacagaaatcaaatttaagaggacattttgattatttttgttcctccagaagaactgaactaatgatgacagaaggtgacagttgagaactgtcaactctgtcaactcttttagttgagaacacagagaagagaagtgatcataggaactgtatccttgaaaactctatgagattaggtgggtgagaacttgatggaaagaatatctagggagggtcaaagataagaaaaatcaggaacaagaagcttatacctacgttaggagcataaaaatgaaaattacttagaactactagaacccagtagaagagttaatattaaatatagttctcagtggaggttgatagttaagcattggattagcaatgtcatgggttaaattgcgtccctccaaaattcatattttttaaaattagctttctctggttgagtaaaattcatattttgaagccctaactctcaatacctcagaatgtggcttttcagggatagtgcctttaaagaggtgagtcagttaaactgaagttgttaggttgagccctaatgcaatctgactggtgtctttataagcagagatcaggacacagaaaaagacaccagagatgcctgtgcacaaaggaaaagaccttgtgaggaggaagcaagagggtggccctctgcaggccaaggagagaggcctcagaaaaaatcaaccctgccagcactttgatcctgagcttccagcctccagaactagaagtagatgaactgcttatcagcctccaaagctagaaaaagatgtctgttgtttaaacctgtagtccttggtcacagcagcctgagaagactcatacaaatagggagcataaggagacagggaagcgataattaggatcttgtgtttgattctgtgttcaccaccccagcagtctgagtgaccatggcaaggccccctttctcccatcgtccactgcctctacctggaaaacagggctgaaactgttttctttacaaagtcactgtgggttctgaaaaaaatacatatcaaacttcctagtacggttcccagtccaaggctggaagaatgaatgaattaaaaatgctaataataacagcaacaggccaggcgtgatggctcatgcctataatcctagcactttgggagactgaggcaggcggatcacgaggtcaggagtccaagaccagcctggccaacgtggtgaaatcccgtctctactaaaaatacaaaaattagccgggtgtggtggtgcctgcctgtaatcccagctactggggaggctgaggcaggagaatcgcttgaacccaggaggcggaggatgcagtgagccgagatagtgccactgcactacaggctgggtgacagagcaagactctgtctcgaaaaataaataaacaaataaataaataacagcaacagctaacatccactggaggctgatttgcatcacctggttctaaccctttaggtgaactatttcatttaatcctactattatagtaggatgtaagaactataatagccctatcttacaaatgtgaaaacagtgacatgagaatgtgaagtaaccttttcaagtctaaatagctagtatatggcagagctgggacaccaaggccaagtgcttacacgtctcctacactgcacagaagagaagtgaatgaccaaccaattaagatgttatgatgtgtaagcaaaaccaggacttatgtttctatcctgtttgtgtcttggtgaaagaatagaggatttactgatcaggtcaaaataaaggaaaaagtgaattttagaaaggcaatcactctagctttatgtcaatatactcagttataaatagtaatataagccacacagaatagtccaagtagaaataaaaatgggtaacaaggagacataaagggtcatggctttggagagagccaatatttcaataagaagagaagtgcagaaaatgaataataatgagagcactggtcaggccaggtcacgactggtcttatatgttacacttgggagcttacatttcattctgaggctactggatatcatctattttcattatttatatctctaattataggcaatgtggagagggaatcagaagaggttgagaccggaagcatgaaaccagttgtttactcgaataattgaggttgtgaaggccaatttgtagcaataaacataaagaatgtgaaatatattagagcatgattttataagtaaaattatcaattcagggaccacttggactgtagaagaatggaagagacgacagagcccagagacacaatgtaacataagtcaaaaatgcaaatgccagcaggactccggtagataatgttgatacagagggtggatcaggtgtaatacaatagggactggcagggtctgtggcaaacgggagaaagcatgccccttccaaaaaagacggccgccataacctgcagccaatttgaaacatggggccaggtaccatatcttctgagtgttcaagaaaagtccgaaatccaaattcctgtttgagccttgtctattttattattattttatttatttatttatttattttttgagatggagtcttgctccgtagcccaggctgaagtgcagtggcatgatctcggctcactgcaacctccgcctcctggattcaagcattctcttgcctcagcctcccaagtaactgggactacaggcacttgccaccacgcccagctaatttttgtatttttagtagagacggggtttcaccatgttggccaggctggtcttgaactcctgacctcaagtgatccactcgcctcagcctcccaaagtgctgggattacaggcgtgagccaccacacccagccaaggcttgtcattttaaactgttgataaataatttctccagcaaataaagcatatgtatgggccctgtatatgtgtcttctctgtgtgagttaatgttaaagagctttgaaccaaggggaattggatttaaacaccatctcagcccactaaactgtgggactttgggctagtacttaatcactctgactttctgcttttgtatccatgaaagaaagatattaatgcttacaattttcatttcttatgaagcttaactgcaaaaatctatgcaaagcacttggcacagtgactctccaattgttaagtgttaataagaagcagcaataattataatgtaatttccaggttttcagatggggggacaatgtggatagtgttgttatcaaatgcagtggaaaatacaggaggaggctgctaggggagggttatgagttcagctttgtgcaaagtgagttgagatgcttttgcagttgttcaatagtcattaaatatgcagaacttgtgctcaggagagaggtatgaactagactgttgactgggagccatatgcacatggatgggaattggattcatcataggtatacatgacaccacttggggcaaatgaacagagagacaagaaagctcaaggctggaactctgaacaactgtagctcttgtgagcacaagaaagaagaggaaaccaagagcatgtctcattgagagacctctcctcttgttctgcagctctctgtagatctcactctctcctagcacctaccccaccctttctgcctcctccataagtggtctctgattttcttgagatcagggaatgtaacttacatgtctttgtatccctgttgctcagcatgaagcttggaagatggtaggcatttgaccagggacagataaatggacagacaggcagacagacggatggatgaatagacagctagctaagtttcaagaaagaaagaagttgcagggtttggtcaggaataaaatatattaaaaaaaaaaaaaaaaaaaaaagaaagaagagaaaccaggagagaaaggtgtcactgaaaacaatggaagagagaatgtgaaaaaatggcactgaaccttgcttgtaaatcacatgcacaagcccacgccagcctgctgcaagatgagagacggcatggagcaaaggaagctagcacagccaaggccattctagaccacttgacctccatcagtgtggccagtgaccagctaagcttgcccaaattgctattgcaatgtacaaggactatgagctaaatgagtggctgccattttaaccactacattttgggggtggtttgtcatgcagccaaagttaactgataaaattaataggagctacaggattgtatctatgtgggaatacaggccagagggagatttttgttttgctttgctttatggaacagacttgaaagagtaattgatcatacactacaggaaaatttcactaaagagatgatcaataaatgtttgttgaattgaatatcaaaaagtcccactgctgttgaatcaaggatcctgtgtttttttattattattaaaattttgctttttcttatcaattcaggaaaatataatgcaggatgagaatggaactaatacttaatattttcagagtctgctagcatacctcagtatacatactgaggagagaatacacttttggcatattatccagtctaaaaaagaaagtggaaaatttcactaaagagatatcaataaatgcttgtagaattgaatatcaaaaaggcccactgctattaaatcaaggatctgtgttttattattcttaaaattttgctttttcttaccaattcaagaaaatataatgcaggatgagaatggaactaatacttaatattttcagagtctgctagcatatctcagtatatactgaggagagaatacacttttggtatattatacagtctaaaaaaagaaagtgggatataaaatgctcttctgttacaaagaatgacaaagcaaaaagaaaatgaatgcaaggtatatctgaatacactttgaagagatgaatgtgaggtacagcaattatgagataattttcctggctcacatgattattaatgaccactagaaaaggaatgccagacttaaaggctgagtcacttttgagatgctattgctttaacgagtaaattctccatttccttctatcagctaagctattatcttcttgttcatatgacatccttttacaaatgactcacatctccttcagccaccctctaagtgaccttcctaagagaagcaagaacaggttttataattcaaagaatgcagagccagaaaaccaaagtttgaatcttcttactaccgtgtgacctcaggcttaatcattttttctctaattttcttacctacaaaatggtgttggctcctaccatgaagtcaagtaaggtgacacatgtggtcaataaatgtcggattcttttccctttaaacggtggttctggggtaatctcaagttgcccgtataatcagagtttgtggttagagaaaggaagctggcctgtcagtcagtctgtggaataccatccattttcacatttgtatgaatcccacagggtcatgaccctggatgtctataaacggagatttctggaattgggaggtgctcacatactgctctctaaacacacgaacagttactgggccatgcagtgatgctggtgaacagaggtggggtcccagggcagacagccgtggcaagaggtgggaggtaggagtgtccctgagaacatctctgtacaggctcgaaaggacaatctgctgaagttgtgtttgttaatagcaaacacttgtatgtaccaggcactgttccaagggttttaaatatactaagtcatttaactctcacatcaatcctatgagataagaactatcatttccccattttcagatgagaaaatagggatagaaagatcaagtaacttgcccaaagttacacagctagtaaacggcaggtttgagatttgaacccaggcagtcagattcaggtccaagctcctaaccagcactctgtgctgtggcacccaacacctggggtatagcagtatattagtccatttttgcattactacaaagggatacctgagactgggtaatttataaagaaaagaggtttaattggctgacggttctgcaggctgtacaggaatcatggtgccagcatatgcttctagtgagggccgcatggagtttacaatcatggcagaaggtgaaagggaaagctggcgtatcacagggtgagagcaagagcaagagagaaatgcaggaggtgccacacacttgtaaacaaccagctgtcacgtgaactcagagtgagaaccaaggggatggcactgagtcactcatgatggatccccgtgatccaaacacctcccaccaggccccacctccaacactgggaattacgtttccacatcagatttgaaggggacaaacatctaaaccacaccaagcagaaaggccaagaatgagagggcaggtgctccagggtctgtcaggcctctgtcccttcctgaccatgtgtatcagaaactactttttgtcctaacatccatctctccacttcccatggtcttacacttctggtcacatggcaacatagaacaatgtctacagggaccagcctcttctgcagctacatgtacatctgtgatgaccttctgaataacagacacaagtgaaaatgtcctgaagtcacctctatagaaaattccttgaaagaagttggcaagcaccctttgctctttcactattttcccccttcatccatcctaccatctagaccacacagatgatgaccgagtttttcctaagtttggtgaaaaacatctacccatacacaatatgctcagtgaaccccagggagaataaatcaaatatacaggaatgtcacagacaagctgctgaaaaccaaaaattgagagaaaacattaaaagaagccaaaaagaaaaaaaaagacatgatacacacatcaagcaatagtaagattgacagatgacttgtcaccaagatctacagaagcataagataacaaaatgacatctttaaggcactggaaaaataaactcgtcaaacagaattctagtttcagggaaaataacttctagtaatcaaggttaattaagatattttctgataaagaacagctgagaaagtttgttgccagcagatctagccacactacaaaaatactaaagaaagttatttaagctgaatagaaacaataataggtggaaactcaagtctacaggaagaaattaagggccctagaaatggcagtctgggggagtaaatattcatttttttcttaatttcttttaaaaatggttaaaagcaaaaagaacattgaattatgatgttgtaacgtacatagaaggaatatacataacaagagaacaaataataagggaagttaatagaattttactaccgttaggttcttacattttgcatgaagtgattaaatattgattctaagtagactctcataaattaagggtgtacactgtaattcccagagcagccactaaaactaaaacagacgcaacaaaaaccccaaaccaaaaaacccagcagtatagctaagaagccagttaagaaaatagtatctttttaaatattctatttacccacccacccccaccaccaaagagggcaggaatagaataaaacaaagaacatatgagaaaaatagaaaataaatagcaatgaggtagacttagatccaatcatatcaaggttatattgaatataagtagactaacaccccaattaaaaggcgtagattgtcagactttatttggaaaaaaaaaaaaagatctaactatgtgctctctaaaagaaacccactccagcataaagacacataaaaatggaaagtaaggacaggtgcggtggcttacacctgtaatcccagcacttcaggaggccaaggtgggcagatcacgaggtgaggagttcgagaccagcctggccaatgtggtgaaaccctgtctctactaaaaatacaaaaattagtcaggtgtggtggtgtgcacctgtaatcccagctactggggcggctaaggcaggagaatcgcttaaacccaggaggcagaggttgcagtgagctgagatcacaccactgcactccagcctgggtcacagagcaagactctatctcaaaaaaaaaaaaaaaaaaaaaaaaaaggaaagtaaaagaatagggaaagatacattgtgaaaaagaaagcataagaaaactagtattctctgttaaaatcagaaaaggtagacttcaagactaagaacattatctgacataaaaagggacacttaatatgaaaaagtgagtaatccaacaggaagctttaacaatcccaaatatgtaggcgcctaataagagagcttcaaaatacatgaaagaaaaactgctagcaagagaaacagaaattatcagagaagaagccctttcttagtaactgacagaatcaattgacaaaatgagctagtttatacaatagttaaataacatattcttttcatgtgcacatgaaataagtcattttaatagatacagaaaaattatttggcaaaattcaatatgcattcatcatttttaagaagaaagaaaaactctcagcaaactaaaatagaaggtaacacttgctgtatcttttagggtatatacaaaaaaaaaactatggctaatatcatactcaatgatgaaataataaatattttctccctaagatagagagcaaagcaaggatgtctaccctcagcatttacattcaatattttactggaggttctatatatgcaaaaaaaaagtaaaagaaataaaaaacataaagtgtagaaaggaaaataagacttattattcaacaatctacgattttatacaaagaaaatccaaagaaatctaaaataaaaatttggggaactaataggtaaatttagcaaactgtcagcatacaaagtcaatatacaaaaatcaatagtgtttctatacactagtaataagcaactggaaattaaaaaatgttttactggcatttataatattatcaaaaagcataaaataggattaaatttaacaaaagatatgcaagatgtctacactgaaaactataaaacattacttgaagaaattaaaaatacccaaataaatgaagacatataccacgttgatgggttggaagtctcactattgttaatatttaagttctattcaaattgatttactgcagtactaattatttggggatgcctattgtttataactaaatcaaattctaattgataaattatgtcagcgcaatcaagtaagtagctcttatatgttttatacatctcttatatgtctgttatcttatttgttaaaaatggaaataatagaatagctgtatgcatccagtagttatagttgtactagtagaaatagaagaagaaagaagagaaattgttgtgttaaaagtaatagaaaaattttattgagttcttactacatacgggacattatgccgagcaattggtatctattctttcttacttatcacaaccactggctcaggtaggttctaccaccatctactttttacagacgaaggttcagagacttcgctttagggaactaacctagaaacactcatctagtaactgggaaaaataacattcaatcaggtttgtctgactccaaatctgtgctcttaagccccaatctatttgctgcttctcacaagagagttcgtgtgaaagcatttgacaagtcgaaaacgccgtgctagcatatgaaattatgttcagatcagctgggcatggtggtgtgtgcctgtaatcccggctactcaggaggctgaggcaggagttcaagaccagcctgggcaacatagtaaaactccatctcaaaacaaaaaaaagaggccgggcacggtggctcacgcctgtaatcccagcactttgggaggccgaagcgggtggatcacaaggtcaaaagatcgagaccatcctgtctaacatggtgaaaccccgtctctactaaacatacaaaaaattagctgggcgtggtggggggtgcctgtagtcccaactactcgggagactgaggcaggagaatggcgtgaacctgggaggcggagcttgcagtgagcagagatcgcgccactacactccagcctgggtgacagagtgagactccgtctcaaaaaaaaaaaaaaaaaaaaaaaaaattatgaaatttgagtcctaaggaataaacatgtgctaccaactccttataaaatcagaactcttaaaataattcagatatcaaattaagagccaagatgtttatgtaagaaactttaagagaaaatcataaatgttttggtgttacaagctaatgtgtaatgttgagagctttttaaaaactattacaagccaatgtgtaatgttgagagctttttaaaaactaccagcatacaaagtcaatatacaaaaattatatatgaaatatataaattattatttctttttagagctgattggttttaaatacaaacctaaagccatattttcaggagaactttttttcataaggatgcacaaggcaaccagttcttacactggtaatttataaaatctaacacaataagaaacatctgatgacattataaattttcagaacaaaaattatagccatcaaatttgaatattagtttttaatattcaagatgcaggcatagcctactaatctgctgatggagaccagacgttggttgattggtggctcttagctacaatgcatgttacaggtttgttgatggatatattttgaaattttgagtcaaaactagcttgtcaacctgatagtgatcacaagaaggtcaaatgttacaaacatagtttcaaaatttaacggagaccacatgtgaaacaatgtatattcagaagaagcacctgtgtaagtgatcccaaactcagatacagtactatgtgagtccgattcccccttgtagaaatatagaagtctgcaagtcaaagctaaagcaaagatgagtaaacgcatccctgtgttggagttacagagtgtagggcagtaggatgagtgctagtaaaaagacattttacaacacaaggtggaaaaggctttgggtcatctgtggctgagacggtcagaacagatttcatcttccccaaaaaattctaaaaataaaccaatattctcattcactctattttctcctttccctccttctctctcaatataaatatacagacatacattatatataaagagttttcaattcaatctccagacctagggacctctctgcattgtcctgttcctacataatgttataactctaaaagaaattatttgagctagcctttggtaaagtttctctttttattagcacggctctttaagagctctgaccggtcaacctagtaataatgatctctcaaggtaagtgttttttttaaaattccccttatagaatatgcaaattaaattagttatggtggcaaagggtagagaattggaaaaggaaatttaacattcctgggttcaagcacattcatggacacatttaacctccaaaatatgaaaaacgatagataggagaacaaatacaatactgctacgtagaatgatgtcatataaataataaaaataatagtagtatttatgaaatgactaaaggattaataagctataacagaggaataatatacagtcctaactggaagctaataagcaaatatatttggatttacaatcttccttgaagagtagaaaatgaaaaactatttggtgatggtagccaaaaagtgcaagcagaaagatgaacatagtgatatctctggtgtgcaatagtgtaattcaaatgatacagacctaagatgatggacataaggaaatcttggaaagaaaacacaacagctccagagaaaaggtctatttcaaacacatggaaacaatggcagcagccaagagatttcaaacaactgattttaaaacaagggaaaagtttagaaaaggatgaaagattaaagaattacaatggaaaataaacaaaatagaattacaaaagaaacctactgaagaggaatgcaaataaagtaatttagctagttgactttccttcaaattttgtgtttgaaccaatattaaagtgaacattactgctgaattatttattatgtaagtagaaagaaatcaatacccttgagatacacccattatggaatcagatatttaagaccaaaagaaaacatttctggaagattttaaattgcaagacaatgaagtcactctatgtattgtcagaaagcaatagaggtgtcagaaatttttgcaatactaaaggaaaatacagaataaagtgacactggcattttttgctgacagggtaaagacaattcacatcaaagaaatgatgtgtataggcattttaaactcaactcagcattccattgccttggcaaatggctccagtcagaaacctaggagtcatacctgattgtttttcttctctgaacccccatatccatccaattagtggatcttatagacactatctccaaaatacatcatgaacccaaacactttcttgcaacttggctgctaccatcctagccaaagatacaactattaatatttcgctcccattataacagttttctcttatgagattccctgtccatcttacccctacaaccaattctccaaacagcaataatcattttcttaaaatgttaatattatcatgacttccagtaattcctagaataaaatttgacctcctttccataggctacaagtcctgtgggctctaagcgcagctcaccagtcttacgccacatgcttcagaagctggccccactggcctccattcagtttccagaaataacaagccattcctcaccttgatccttgccacatgccatttccactgtccagaagctgctgctcctacctgcttacagagttgactcctccttatgtcttaatttttgacataagtgttagacaagcaggtctctcctgatcgcctcatcctaggtacatatccctttcttattctgtatcacagtaccctgctcacccctttcatagcacttttatttgcaatgaaataggtgtgtattggtttccctgtttatcacctgtttcccacccagaataagaccacaggcttcctggaggaggaaccaggttctttcctctcaccattgtgccttggcatccagcacagtgtctgagctatgggaagtgtgcagtaaatgtttgtggaataaatgagtggattaaatgaatggtgtaatagagaacatattccaacagatttgcaacacaatatagttaggaaaagcaaattgacaaatatggatggggttttagaaattacaatgagggaatatgaaaggagaaatattagtcattagatgtttttattacagatatataaatgaataatcactagatcaaaatgaaagtagaaaatatatttatttattttgtgatggggtctcgctttgtctcccaggctggagtatagtggcataatcatggctctcagcagccttgaactcctgggttcaagtgatcttactgcctcagcctcccgagtagctgagattacaagcacttccaccacatccaattaaatttcaatttttttatggaaatgtgatctccctatgttgcccaggcttgtcttgaactcctgccctcaagggatcctcgtgctttagcctcccagagtgctgagatcacaggcattgagccgctgtgcccagctgaaggtaaaatggtttatgaagtattctgctgcgtagcacgggaaagcaaggagaaggaagaatcctgactctcagagagctcattcttgtacagaggagaccagaaggacatatttgagataatgagagaacacgttgaggccatttttccttcctgcaaacattgatggaatgattccagcctggcaggaagggttgaaagaccagcccagcctgtcaaaatggaatcagtgtgcgtggcaccagctctaactgtggcagaaattcagaaggaagaaccctatgatgtgtgcaggtcagaaaaatctcatgggacagttggcttttccaactgggcctgaaagaaagcacaggagttgacttggcagaagaggacaaggagtgatgttcaaatcagagaaggggttttggccagtgtgtatggaaaacttaattgggaccacatttgttctggttctaagaaagcagacagttatgcaagataaagagaaaggggaatatctgggaaaatcaattacaaaatcatcagctgtaaaagacccaataggattgcattttaaatgtgactttgaatttttaagaaaatccatttgagagagtaaaaaatatcttaaggactttttcttgagcagaacagaaagtcaaagttagatttaagacaggaaaatgaaaaacagctaggaaatcatcagaagaatgttaaatcaactctcccttaatttggaatacatagaagggcataagagataaaacttatttaaaggatatagttatgtgaacaaaaataattggctattgacaatggagatttaaaggtttggtcagaaggtctgcatttccctctgggtcttcatttatctaacctagactaattgggagcagccatgcatcaggcactgcttcaagactttccattctagtgaggaaaacatactataaaaaaacaagtaaataggtatcctcagtcagggctacaggttattgaagcagggtgcggtgggtagagaatggtgggggctgtgtaagatagtggagtcaggaagacctaagtgacacaagggggagagagagccatgtgagggcccctatgaagaagggtacagggtcaggtgcaaacgctccctgtagcattggatgtaaggtgaatgaatggcttccgcctggaggacaatttctaagcctttggcatgtttgaacaacaacaagaagtcagaatctggagaaaaggaaaggaagagaggaataagaaatgaggttggaaattgtggaagacagtgtggtgattcctcaaagacctagaaccagaagtacgatttgacccagcaatcctattactgggtgtatacccaagggaatagaaatcattctattataaagatgcatgcatgtgtatgttcattgcagcactattcacaatagcaaagacatggaatccactcaaatgcccgtcaatgatagactagacaaagaaaatgtggtacatatacaccatggaatactatgcagccataaaaaggaacaagatcatgtcttttgcagggacatgaatggagcttgaagccattgtcttcagcaaactaatgcaggaacagaagaccaagcaccacatattctcacttataagtgggagctgagcaatgagaacacgtgatcacagggaaggaaacagcacacaatgggaccagggggctgagggagggaaagcatcaggataaacagctaatgcatacagggcttaatacctaggtgatgggttgataggtgcagcaaatcaccatggcacacatttacctatgtaacaaacccacacatcctacacatgtatcctggaacttaaaataacatttaaaaaaaaataaaaaacaaacagaatctcagcccccatcccatacctgctgaatcagaatatgcatttaaacaagatcacttagtgatttgtatgtatcttaaaattcaaaaagcaaaaaataaaagaagaaattaggttggagaggtagccagggatatgttggccccagacaacaccttggatgagaaatcagcagagattcgaaaggcagggaaggaaaacatgtcatctgcattttagagggatcacttttctcatcctccccctcaaaaatgctcagctcccaatagcacccccgtatatcaagtcgtgtaaaacttgtcgaaaactggtgtgtcctctccctggccttctccttgtcctcttatagccaaatctgtccacttctctctatctccattgtcacctctgcaatgcattcagcattaaagctcatctaaagcagtgtaacaggctcctaacaggtttctctaattcttgtcctccctggatccattcttcccccctaaacacagtaatttcttccaagtgctaaaattcttctcctctcctgctaaacccattcatggtgcccttgtccacactcttgggccatgtgcaatccacttagcccactgcttaaaggtctacctgagccgactcctacttctctctctagccttctgtcttccctccatcacattctgcagtacggctctgctgaactgcattttgttcctcagatttctgtgtctccctctccctccctaacctcgccctgcttttctctcttcctgaaagagtctttcctctgcctgcagccctactcattctttaggttactacttagtcttcaagtatgtttgaacatcacttcccttggaacacttcctgactctccctccagccctcagtgtaggtgagtggtccctcttcagactctaccacctgattaccccagaggagccctgtcacacccctgatcatactgtccatgctgtctctcggggccactattccataagacccatgaggccgaagccacatatgtctcgctcactgctgaatcccttgtgatcaacacaataaccactgcaaggtaggtaatcaagaaatagtatgtgaattaagtgttttattaaataaataatgccatattcatatgatagaagcaatcattaataattctttagaataatacttaaaaatatagaacatgtagagcacactgttcagttaaagacactcattacaaaagcgaatacacagtcagatccgattttggttttctaaaaagggcattaataaagtgacctcaaagatgttcacctaaaatgtaaaatgatttttctcctggggttggaattcgaggcattgtttttcctttgagcacatttgagcataaatttctttggtcatcagggaaaaaaaatcacgaaaatgatttaaagtgcggtgtcaagtcttggactgtcacggaaaagaggaccctggtcaaatgcaatgatggtggccagtagtgaacagaaagtcccttgtgagtgtcctgggtcgcagcggccaagggcattgctaagggtaggctatttgggagtagaaagtgaggaagggactctaaacatgacaacttcttcatagaaattataattaaatgtaattaggccaattttaaagaagagcagtgggaaaatgtctttaaaaatgggctaaatgaactgaggagaggcgtcagtatctatcttcagctgccttttatcattatggtatcaggtcacaggagatgaaattagattagaaaaacagagtcaaagaagggtttatttaaccaaaaataatatatgatgaagcaattaacaaaacattcttctactttcccagtcttctgtctgttcaacgttgtcttgggcctgggtctctctgtatgtcccctgccttaaggtggtcagagtcagagcctcgacctgaatagttcagaagaagggccaggactgtatcacatgatattttggtccaagtgaaaaacaaaaatttcactttagcttcccccattgttgtggtctaaagaggggtatgtgtgaggagataattctgctacaagaaaaaatgaaaattatatttactactagggtatttatatttctatcgtaaaggatctttgttgcattcaagaaccatgatataatatgaatgttttgcgtttagcatggagaagttagcttttaataaacagatcctcccacaaaacagctgttaaatctgacaagaaaaaaaataaaaataaaaagcgaaaaacttcttcaaggctctgaaaagtgaaccaaagcaggcaggttttggaagggagtcaaaatacagaggcagcagccagcatgagatcagtttcgcatttggggggttcacatggccggctgccacagccgtgacagtggcacagggggataagacgacagcactgaaccttccgtttcagtccagaggtacccaggaagggaaaccgcctttgcagaatgataactgaggaaattatgacagtgaaagaaatcagacctaaccaactccaccttgcttctaacctttaagctgtccttcttcattcctgggcatgggccaagctataggaaggaattcagttcatggtttgactctgaaataaaattgctaatagccctttcccaaaaggacccctttcttgcctagggaaccagtctgcctttgcaggattaacaaattagctacaagattagacattacagtttggggggtcatgcagcctctggctccaagagtctgaacctccccaagttgttcttggggataacatcactattgtaaaacctaacatcagtgcttgagatattctgcagcccctacactcgatggatcagctgacaccatccagacaggtaatctggctcaaccagttctgccatcccacccaggaacagaagacagcaagaaaaactcactttgaccccctatgattccatctccaacctggtcagtcagcactccccacttcccaagcccctacccgccaaattatctttaaaaactctgatccccgaaatatcagagatactgaattgagtaataataaaactcctgtctcctgcacagccagctctgcgtgaattactctttctcgattgcaattcccctgtcttgataaatcagctctgtctaggcagtgggcagggtgaacccattaggtagttacagaaggagcctggagaaggcataccacgaggagtgagggagggttctgggcaggaagacagccaaagaaggggcctccaattctgaatatgaactctcccggagtctctggatgacccctacaccacccctaaactgggcactggaagtaaccagatgagatgagagctcctgcaccccgcaggcatcatgagtttgcagtgagtctagccagtgagatttgcacatttacttcagtgaacattggttaatgcatctttgtgatatggggagtttcctcatacataaaatgttattgtcaggacagttttgagatatttactcgttcattcattcaacaaatgtctcgtatgtttctacatgccagatgctttaagggatacagaaatgtttagcatccctgtcctcaacgagcccagagccccatgagggacagcgggtgtacatccaaatagctaccacttgaagtaaaactggatcagggaggaattggtgcagcagaaagaacatgaacttcaggatcaaacaaacctgtttagagcctcaggaattatctgacaaatggcataataatacctgtcttgtacagctgttgtgcagattaagtggtgaaatttattaattacttattctctgcgaggtactggtctaagcactgcatattcacagctccgttaattcttataacgacccctttaggtagccactaatactaccctcgctcgatagatggggaaaatgaggcatcgagaatttaagtaaattgttcaaggtcgccagggagtaagtaatcaaacaggttcaaactcagcaaagtctacttgagcctcagctgttaactgctaagttatgctgaataataatgtcaaagtgctggccgggcatggtggctcacgcctgtaatcccaacactttggcaggccaaggcaggcggatcacctgaggtcaggagttcgagaccagcttggccaacatggcgaaatcccgtctcaactaaaaatacaaaaaatagctgggcatggtggtgggtgcctgtaatcccacctactcaggaagctgaggcaggagagtcgcttgaaccccgggaggcagaggttgcagtgagccaagatcgcgccattgcactccagtctgggtggacagactgagactccaactcaagtaataataataataatgtcaaagtgccaagcacagtgcttaacacataggaggcactcaacaaatggcagacagcatcagtactgttataggtactgccgatgctgttgttattactttgaagcataagaaagaaaaccatcgttgaagttcaagacctatgcctgaagttttaaaactaaaatgttgtaagaatgctaaataattgtcacgtgcagatcttgacacacacctttagaaatcaaaatttatgtttatcccttaggtatatcccatctcttttttagaagaaaaccatcaaggtatcatttaagtattcattcattcattcatcaaactgtaacttctgactgccctctgtcagcactaaagtgggcatcggaaccattttcaaaggggaaagaaagctaatgtgggaagagggtcctggtcattcactgaaagttagtgcagccattttccccagtgctaatgaaaaaaagcaggcaactaaaattccttgctgcatttttatttaaacaacctcagagaaactgctatgcaaaaaataataataataataataattcagttgtaaagcaaaattaatgaattgtgtgccaaacataaaaataaaattttggaagggcgcagtggctcacgcctgtaatccccgtactttgggaggctgaggtgggcggatcacctgaggtcaggagtttgagaccagcctggccaacatggtgaaaccccgtctctactaaaaatacaaaaattagccgggtgtggtgatggtcgcctgtaatgccagctattcgggaggctgaagcaggagaatcacttgaatctgggaagcggaggttacagtgagccaagatcgtgccattggactccagcctgggcaacaagagcaaaatgctgtttcaaacacaaaataaaataagataaaattttactcacacttaataaatcttaataccctgctttgattctaaaaggtgaaactatatactactccaaggatctcagctgctgtgattcctaaatgaagtggtgatttagggataatgccaaattttgaaagaacaagaacagcattttattcaggactgttaattttatgagggtatgtggcatgtttcttatgtaaatacatggagtttcatatggttctaatagagtgctttcaccaagatcatacatgttagggtgctggaaaaaaaaaacaactaaatcccaaaactatatcacccttaaatcctgactgggtaacatacccagtttttaaacaatacacattatctgagagataacttttatgacatgtgttgctattgcctgcaaatccctttaagatgaaaagcattaccactgaaatttgagttcgacaaaaggatttatatagctaggttacccaaggctataaaatgaaaaaaaaaaatagttttgtaaatgcttggagcttgttgcagtggaatttaacctacaggacctttgggccaacataaagatttaaaccccaggcattccctagagttacttagaggttatgaaggttttctctataaacatgacttgaaacatgatggatttattgactcagcaagtagcttttaaactgatatatttgaattaaagacttttaagcatagggtcccttaaaggtagtagtcaaccttcatcctttttaccgaagaaaactaagggtggaagagataaaattatgtgacttaaccgaggttagatgactaattaataacaatcatcataatagctaacattaactcagcacctactatttgcaaagcacagtgctaagggctttctccaaccttcacactaactttaaacatgtaaacgagtgttactctactttataaattaaaaaatgagcctcaaagaagccaagaccttgtcaaaagaggtaggtccggatttcaaacctaagcagtgtgaccccaaaccacatgcataaaccactccactctacagcctcgtcacggggcctagactcaaatctactgacctccaggccagagaacgacaccaaatctccatccttggctatgagagtttccagattgtaagatctttgatgtctgacagcaaaatccaacattgcattctaatagttataggactggaagatgtgagtcctctccctggttgtaatacttgacttcataattacagtgcaagagtggttcatacaaaatctatgtattccataatcttatcccataggaatagtgtgagaaaatacctttaatgcttttaaaatgcattggataaaatgatatgttttcaaaatagtgcataaagccccatattctctctttggtctctgattgccatatgtcttccgtaataggtaattgccaggaaggtggttccgtttgaccagctgtgctctccagaaggggatggtcatgctgcagagccaatggatgtcctttattgctggaggctttcatcactactgatttctttttattctttattaatttatgggtattctacttcaaattcccagtggaagggagatggaattaagatactgataatggctagagagtagtattcagactgtatttatacatgtatctaaatacattcatatatttaaatatacatatttaaataccaatatgcagtaatcctaagcatatatagacatcttcagaattaaaatgcatttagtttaaaacttaaggatttcaaagttctaaaccaaatacgaagacaataaattattaagcaataatgccaggttctaagtgcttatctttgtctttgctgttatcattcaattaggtggatattagaaaacattcatgatatttcacttttatttcttatcatccccaccgtaaccagaatctgaagctacactttcccaatatgaacctagtaaaagctaagtcgaaattcaggagaaatacagaacctgttgatgaaggataaaaatctcagtgtagaagggcagacgtgtcctgaaggagcgcagctatgaaggtgactgcagctggctctcgggctgcccgatttggaactttgtgaaggagcaggagtcacagagacagtacccagaacagatgttcaatctctacgggcctacccaggtcagatggaaaaaggtccttgaaggaaacaaaatggagatgaaaaggggggaaaagagaaaggatgcggatgtgtgctgtcgagaactctatctagagggaaaaccccattttaacagctttccagcctgggaggaattggtataaaaggatttgacttgcttaccaaaaataataacttctcactttttccagatttaagaaagtaaacagcagagacatttagaagttttctttgcatgcattttacttatgattatggttacaaagataatctttaaaaatataatgtgatttcttttaaagaatatattcagagatggtataggacagtagttgggagcactagagcccatttctgggtttagtctccatttctggctatgtgacctcaggcaagttattgatcctcttgtgcctcagttttctaatctgttaaatggaaatattaacagtgtgtgcttcctagcatacaatactaatttgattctcattgttgtgagagtcaaattagttagtagacatagtgagtgatagctaagtgttgacttctattattaaattatttaccaaatattaatccctcctgctaacataaaacgcaacccgtaggaaaggtgttggaattaggtgtgggaaacaagatgaataaaatacattccctttcctcaaagaataacacagagaagcagggcagacagaatcaacaaaaacctacaatggagaaatggaaaaggaggcaggcaagggtcagggctggctctgaaccccaggacattctgtgaatttgaggctctgctcagacttgctctcagcatgtctgatgtgagaaacatcctggagacacaggctctttttattttttattttctttttgagacaggatcttgctctgttacccaggctggagtacagtggcacaatctcggttcactgcaacttccgcctcctgggttgaagcaattcttgtgccttagcctcccaagtagctgggattacaggtgtgtgccaccacacccggctaaattttatatttttagtagagacagggttttgccatgttggtcaggctggtcttgtactcctggcctgcagtgatccgcccaccttggcctcccagagtgctgggattacaggcataagccaccacacctggtgacacaggctctttttaaagtgcaaagtgttctataaatatgagttactgccgacacacaaaagcaagcactgtaaggataggccagtgggagaggcagcttaaaaaatgccagtcaccaggtatgagctcctgctaagaggctgccacacattccagcaaattcttctaaactctaatgaaagcctgcttttccctgctcaggcttcattgaagataaaccttcgaataaaagtctttgtagtggaaaattcatcttcatcttgtcaattccagagcctcgcattttctctaggctttatctaggcagcatggaggggctggtgtgccaccggataaaggagaagggttcctagatcagcatccaggatttaaattactacctaaaggccaatgtctctgtgtttagatgagaccaggcttcttccagactcatagagccacagcctagctgacatctccacttgactatcacaagggtctctcacaagggttccaacatagaacacttcatttttctgtttctccatgaacagcacaacccactgcaaagccccagactcgctgcctcaccctccctcacctcccaccaccttgctccttctcaggcctcctccattttctttccaaagttcttccaaatccgtctgcctctctctttttcaaattccacccttccattcctagcagccaacatctatttcttggacttctacaacagtccccaaacttttctccttattcccactcttgtctctctctatgttcaacattgttccagaatgaaaagttcaaagttccctgcttatcaatggtttaatagtaatcattatcatgaaaacaatagtgatgaaatagctactatgaattcagcacttagccaggcactgtgctaggcactttatctgtctcaactcatttaatccttacactgatcccaggacatagacacaatcatcaccccattttacagattaaaaacaccaagatgcagggaggtataaaatcacatgcccatgggacaaagctggtgatagtggaactggccttcaaacctccccctccgactccctcccctctaggatgaagatgaaaggccttgcggggctcacccagccctgcaagccttgccctgcctgcttccacctgctgtcaccatgattcttctcatcctcttagctcagtcatgcccgcaactgcgccatctcctccctctcctctcctagggtctttgtacatgggagtctctcccagctctccaagcccaggcagatcccttctgtgcatcttcaaagcacctattcctgcatgtaattacatacttatctgtgtgtgcactactggaggggccatctcagccttccttagcattatatcctagctcctggcacagtgcctggtatacgtaaagtgctcagcaaatcattaacaactaggaaattgtagtacgagtgcaagcaaaattctgtttttagttcgagggccattgtttattaccagtgtgattttgtgcaaattacccccatctgaacttccagaggcctgattgtaactttcaggtaacaatcccagcaataataggaaagcatgttggagttcttaaagcactttcacaaaaattccatttggtcccaggacgaccctgcaggctgcccttgactaaacactaaacgacaaggccttcaatcagagttaggtggcgactgactaaccaagggcgtgacagagctttaagaactgcaaagtgctctatgtgagtgaagactggtgctgcttgctcagtcatcagccttcagcaacgtttccaagttttcgcatttgtttaagggagctgagcctaaattgcaaaagaaggagagggtgaagagcagggcttgccaaacacatttaactcatcaccagcacacagagagagagagggatggctgggtgggccacagccatctcactccggcccccaccctggcccctgctctgcccaagtgagcaggaagacaagaacctgcccttctttagttgatgttcacttctccgaaatattcgattatgaggtactgccgatcacatgggcagctcctggagaacccaagcacttccgttatctgggaagccagtggcctcttaccaacaccctcctggaccaccgccctccccctgcctctcagccttaggtaatctaaggtaattgtgaatacacagatacttccttaggttctcaggctctacatttaatctctgcagaggatgtgactctatgtagttgtcaatgttacttctgtggatcagaagcttacatgctggttctaaaaaacaatctaatgtcatgttattcttacaaaattaacaattgaaaataatcccttccataacatccctgcaagcagaaatgggaacaaaacttcctcaaatcacaaaataattttgtgaacaccagcttgatagctgtgattatctgcctgcttcttcaggtaaaactatgccagcagtaaaactgctttttaaaataaaagtagccctaaagatgtggtttttcaggtgacttgaattttctaagacattatgaagttgatttaaaaacagaagcaggtgaactttgtgttgaatttttaaatgtaaactcatatcaaaaaccaaacaaaatagaaatcttaagtaaattgtcaccattagagattctattttattatagctattcattttcaatgtataaataaaatcacagaaagtcctagattatgtctaatattcaaataattttcaagctatgctagcatagagctaaaaagggggactatcttctatttttgttttataaatcaaacaaaacaggaagttctcttgtgtagagttttgcagaaacaaagtataaggctgatcaaattagtttatgatttaaaatgaaaaaagttctttctggagtaataaatactaattaccttctggacactggcaggtgaatccactgagactggaaatgcatgttgctccatttctgcatgggtctaggatgcagtaatcaatcttggactggcaaagctctccagtataacctgaataaaacaaaatgtacattttataaaataagctcttccagacccaccatgagccactctaggaattgatggattcaactggtacctgcccagtgaaggcagtggcagccttcagctaagctgctcctagatctcatttatttttacaaactatggtagtttagaaataatcatagtggtttagagtcatagttcaaaaatcgtttactctgcaaaaatctttattgcaagaagaccacatttcttcggcattaggtctgtgtttcatcttgaaatatcagtcggaactttcagaagctgagactgaggatcacgttggtagcttccttctgacacaggaatttacagtgttcagcttgatctaactgagataatggccacattccctaggccatcacaacacctacataaaaagcattaggaaaatgtctaggtatgagcagttttaatttataatattttagagctagaataacccacctgtgttaattctgtgacctctcctcccactttaaagataaagagattgaggcaaacagaatgctaagcacattaatatatttttatttatacctacttaattcacaaatccaactaaattatctgtgaagcaaggctctcatggtaattttgttggattgtaacataactacgcacatgtggtgaggaaataaggatgtaaatcgattggaacacctgtgcagtcaaaaagctttaaatacttccagaattttgtttattaattttgaaaacaaagcccctggagagaaaagtttaaaaaataaaatgctaataaatttctcattataaagtggaaaacggtaaagaaagtttggaaaatttaagacattacacagaaaaagaaaaaaatgtgcccttggttatgttatttgagtgacaggaccatcaatactgtagagataattcctatcaaaaattgtgagtcatagatattttccacacaattatgatcatagtgtaacactttatttctaggacagttttaactacataaaatcttgtctttctgaattattagttttgaaagactgccattagcacttgaatctgagatttacaaaccaaaaagatccagtgatactagaaaagagatgattcacctgagcttcaattacctgccaaatagattgtaaattacagattgggaatgtggaggcattcatttgcaatcctactcacaggcattcaagccgtgtaggagattctagctaattcacggtatgagaagaggagtaagacaagcgcatgaactaaaaatccaaacaccaggagaaaaggctatttcaaaattctagaacagattaaataaaagctgtaaattcaaaataagggagagtgaattgtttttaagaggaatgctgcaaataactttttggctaaaaataatagccaaaacttacaaaaatcacttatttttattcatacattaattaatattaataatttatccacacattaatacctaattcatccatactcacgtaaccttatgaggttagtgttattagaatcaccctatttttttttaacttcaacttttattttaagttccggggtacctgtgcaggatgcgcaggtttgttacataggtaaacgtgtgccatggtggtttgctgcacagatcaacccatcacctaggtattaagcccagcattccttagctgttcttcctgatgctctccttccccaaacccccactcccaacaggccccagtgtgtgttgttctcctccatgtttccatgtattctcatcattcagctcccacttcaaagtgagaacatgtggtgtttggttttctgttcctgtgttagtttgctgaggataatggcttccagctccatccatgtccctgcaaaggacatgatcgcattcctttttatggctgcgtagtattccatggagaaccaccccatttaacaaatgaggaaaccgaggattatgaaggttaagtaatttgcacacagtcatacagggagtcagagccctgtgtccaagccctttcacacagtccgcctaaggttacacttaaggcactatgcatcaccatcgtcaacaaacaggtatttagtatgaagggaaaataacagaaaataatgggtaagaaaacacatagaaagagacacagagcttgatataaaaaccatcaatattcagctaggtgcggtagctcatgcctgtaatcccagcactttgggaggttgaagcaggcagattacttgaggccaggagttcaagaccagcctgaccagcatggcaaaaccctgtctctactaaaaatacaaaaattagccaagtgtggtggcatacgcctgaaatcccagctacaggggaggctgaggcacgagagtcatttgaaccgaggaggtagaggttacagcgagccgagattgcgccactgcactccagcctggacaatggagtgagactttgtctcaaaaaaaaaaaaaaaaaaacaaaaaaccataaatataaatattcatccataacttacagcctatgtgtggttggttatgcttaggctggaggtgccaagaattattttttcaaatccctgactttaaagattctacaatatggctagaaaagtatagtacatttatgaaaaagataaccgattacaagtggtagcttcttagaggcagtgtggcctaaaggatgtggatggcatcatgaattctgtccccggaaagatgtcagaattgcgaccacagaatgacacaaaaccatgacccacagccagcagccaatttggtctcagaagtgagagatgtacatccccaccagacagaaaaaatagaagaatgcaggactctgtgaacttcaaagttctttcaataaaattttaacaatcacttcctttttactttttatccaaggatttaaaacatacttaaacatagagagatgaggttataaacctcatgtgtccatcacccagctccaaccattattagcattttgtccgtttaatttcatctagtctcttcgtattttcctaggttccccatgagggtattttgaatcaaatttcatttcacctgtaaatatttcagtatgcatttctagcaaaaggggagttttttaaagatcacttttaatggcctctttaattaatatttcattccatttacaaatttaattaaacactttaaaacatatttatttatatttaataatatccacaattttcttaagaaccacaactgtctgataatgcacaaatattcccatgcacttaattcttacagatctaataaattataagtgagggtgaatcttcaatgctgttaagtgccccaataccgtatgcaagttcggtaagatttcaatcagagaggctaatttacatttttaattgtcataacagcttcgggacctcactggcattttgtgggtaaagatactgaggtcttgcaggacttgagatggcctaatatattaataacagagttgtcacactgaaaatgccaatagttccctccaatgagaaacagtggtccatattcaacactttgtcattgctttatttccctgagctttaaagtctttatagtaaagattttgaaaacacaggaaacatggaactatggagaaaaagattatgtgtaatgctctagacccgtaaagtatgagcatattgacatgtctgtgggttcagtattactggagatgaagaacactaatggaggagcatggactggggtgtaggaggaagcagggaggcaggggtgagatcacgggattataggaccactgagcattctcagctgcaagtggccagtgctactggcaataaccagctatggatctgcaaagccgatgagggtagcctgatgctctacccaccccagtctccctggaaagggaggggccctttggcaggacagttgcttggtgcgagcgtttcccaaattagacgtatggaccatgatggcaggagctcaagacctgacaatcattcacaccagactcaccaagaggaccaggtattattcttggcctccagggagttactagttggcagtcccaagagtaccatcatcaactgtattactcccattacagttgcattactagccaagtgaagacagttctggaagaggagaggcagaggacaaggagccaggagcatcctgtggctggcttcagaaactctcaaataccagcgagtgactccttagaccctcagagagcagaggcttcactgaaggtgttgggcaaatcactggtattgatatacatgtaatactctgaactggatacctaagatctacacaaatctcacccttcctgtgtcttttggttttttatttgatctcataatcaaggagtcaaaactaaatgagtgactggtagaaatttaaatgaaaaataccattaaagtcttggcctgggttttctttcttccatcctgctaaaagtcaaactcttctctggggactaaagtaaccataccaactatgactaatatttccttttgccactaaagcaatgacagacacccagaggacctcgtagaagatatacaagcaagactgatggtatcgatgccacagacacaaaaggtaatacacggtggccattctgtgtgtgttatggaagaatttgctctagcatgcatacacaacaggcatttcagccctggaaacctatgccatagctcccaagtggaaggtgggcaagacatggagaaaaacccatgtaaaggcacacaagagtgcagaaaatgtgtgaatgtcattgacacttgactaaaaatgcaagacaatgataaactcccttattttgatttccaaatgacgaaagtctatacctaaccatggaggcaagtatcagcaattgtctttctttcctctagctagtggtactccctctaagcccccatgggcagaccacaagcattcgtgaaccacctgccaagttattgtcacaaccacataatacctttcacattgtctagtcccaaacctcactgcctctcaccaggactccagcaatggtcgcccagcccctgtcttcactgccacacttgctttctttcaatccattctccacatacgaatagccaaagagatccttttaagatataattcatatcctattactccttacttaaaaccctccaatggcttcccaaaaggtttggaataaaacccaaacactttacccaggggctaaaagataccgcacggtgtggcccctgcaccctcatcttggcccagtcctgccaccgaccaccgtgctgcagccacccaggcctcactctattccgaatctcgccaagcttctgctcataggcatcagtattgttttcatgctgtggcctcaggaccagaaagaatcatgagagggatgcaggattcaacagaagcagttacagtcctgccctacaaagagaagtggggcacagatttaaaattgtcctgagatggagaaattactgaagaaagttagcaataaacttttgggagtggaaaggagaggaccagtggagttatagtggaatttcatttgtaaaatcaggaaataaagacaggagggtttagaaataaattgcacaacagagtagaagacctaagagaagggtatcaaagctttaaagttatctctagaaccaggtagggagacatgaaaatgtcttaagagggctacaaagaaaagtgcaaaatccaactaaggagggaaggaaaatagctacaaccttagtgggagttaccaataaaatcagaacaattaaacaataatgtctctgggactcaggggctgtgggttttgaaatcaagcccattgatgagtatgagcttggagtttcctgttggatggcaataatagggagaggtggcctatgtgtgctcatcccactgatatgagaagaatcaccctggatgcccaggactcctgagacagccaaaaacctccctcccagaaacaaccttagtcctctgagcgccaactgcaattcatttgggtcaagaaccacagttagcttaggataatgaagctcttccattagcggtatgagtcttccaatcacaagaagagatagagccaagtatagagatgatgatatgaggacgtagatcaagcccatggttctgccacttcgtgtctggtttaagctaatctgtgcctattggtatgcaaagaatgtgtgatgattgagaaaaaatgtgatgtgtgagagaatctatcacacttatgattccaattaaaatgtttagctgagtaattggtttttgattgatgaatttaagttgaaagataagattaagtcagaacccattgggatgttgaacagagcttgagaatcattatagtgtttaagtttacttctcacaagggaacgcatacaaaagataatttcaaatagtcttctctgtgcccaaaggacattctgggatgccaaaaaactcacccctggaccctgtggtcacactgcagggctgtttcctctgactctgcagccttctgtgcccaccctctttcattagttagctctaagctcagaagtcacttgctcagacctcaggctttttgcccttgtttattctaaaacttcgctcttatttctacttgaaacacacacacatacttgttacctccccacccagaaggtgacccatgggagtagggctgcatccctggaggcccctgttgtatccccagggcacctgtgtgctcatcactgtatacttctcattacctacaatgattttctttattggtttccttccgagaacataaactccctgagaatcaggactttctctgccttgtttggagagaaacctctggaccctccaaacttaaacatttcctggcacaattatttgttgaaggagcgaatccacttgcttaaagtttttgtcccaaaatcaaccatatctttcaacttaggtttagcctctccctaagcaataatatcgagaacggcctgggtaaaatgtgctagctgcttgttttcctaatgcacattaaaataaatgcagagctactgaagtaaaaacattgttatctcaaatatctgccatcaaaaatcaccttgctgccatcatggtctgtacatctaacttgggaaacactgcaatgagcaactgtcctgctaaagggccccttcctttctaggcagactgagatcagtagagcatcatgctacccctcttctgaacttcgatcttgtttctccagctagcattcagcacctccaacaggtctctgcaatacggcaaatcaacaaggctgaagcagaactcttcattttgttgttgttgttcaggagcccatatccagacttaattccttaggtcggtggttcttgactggggtgattcttcccccaggtgtcattggtgatgtcaggagactttatgtattgttatacctctgaaggtgtgactggcatctagtaggtagagccagggctgctgctgaacactctccaatacacaagacagtctcctacaacaaagaattatccaaggcaaaatgtcctgaacaccaaggttgagaagccctggtttaggtcaatggaaccttagtccttcagactataaacctttgttttggtttcagagcctcttatcttcccttaaacagaaactgctcctttacaaagcagagaaacagcaccttcagaacattttttaaaaatcagcattctcaggaatatttataatccctagcaaattcaaagccgttgtaaaatacattgacccaaaaccctaagaacctgaggaatttataattgggatattctatgaataagtaaaataattcattcaaaaacagatgactattgaaaatactgacctctcctttcagggaattgcagagattttattgtttctttgaagaacactgcagtacaacaaagatagaagaaaagttgtgactcagggtacatggtaaggatgccctttgaggacatatggcacagccgggaaagccctcaactcaggcttcgtgcttttaaagggtctgaccgtgagcaatgatgttaggtgaaatacagtccctgacataggaagcaaagcctggcagtgagtaaattcttaaaaaggcaaaaggcagaaagtgaccagacacttgaaggaaatgcatccatttcatcagtgggtgttcacagattacatttggtctaatataggcttggagtgtttgattttatactattttgtatttaagtataaaatataatttaaaatgtattcatatctagagagagaagagtggctaagtttgcctgtgaatctcagaacagcataccatctgagtgatatcttttgatttccaacataacaaaaaatccccccaccaacccatatatcattatcgacaccaccatttcccttcaaatgaagaaaaccttccagaggtcaatggtaaattacatgaggtgtaagcgaagttagctaaatgagtcagattatgaagaagaagggcgatcaatcagttgtgggcatttttaaaaaaacattctccttccctgcacagttgtttttgtgtatgatgtttacttcatgatttctctactgaaataataaaaaaaaaaattctcctgtgttgctttggctctctaaggcagagtctaaatgtttctttggagagctgttctgaaggctcccatggtggcaattgcgacgagagctatttttaacgctcctggtcttttaatagtctggcctgtgcagtgaggtgaggctgctgaatttgggctgaatgctgatgctaccaagagaacccaccagtctcagctctcaccctggggggatctgagcagctggtatcagggcctcagccgtgtctgctaagatgcagtgcctaatattagcactctgaggcaagaagtaaaccgggggaataaatagtgcaccatcaagacgttcagtctcagaggcatcctattttaaagtcggaaggcagacattattgcacagaaaaaaactagtaagattcgctggcaggagaaacacaaacacatctggacaaacacaaacaggatttaaaaaccaaaggcaaagaaaggaagatacatgaagcccatctatgaaagacaataagtaaaatataattaaattggaatatgcaaaaaaaaaagcttgacagaaagctgacattcagcagaattagaaaaattaatctcaacattggggaaaaaagtaaccacatctaacaagtaaatagacaagaggcacagtgggaaggacagtggcttggggagtggaaggtctgggatggtgatacaacaatcagctgagagagctcattaagaggttgacttttaccttcatttccctcatggaggaattaaagattatgattataatgacttcaagcagcaggtaccatttctatggagtgtaccctttaatccacaagagcttgcaccatgcttggcatgtcctaggtggctcaatattttttgagtgaaatttatggattttaaaactgcaaagcaatatgccaatatttttggatctctcagtttttatacaggcaatttagagcagtggttctcaaaatgtgtttcccagatcagcagcatcagccctgcctgggaactcgttacaaatgcaaattgaccatcattgtcacagacttactgaaggagaaactctgggggtggggcctggcaactgaggtttaagaagtcctacaggtgatactaatacaaggtacatgctagagtttgaaaaccaccatctggaaaattagaagcaagcaatcttttaacatcaaatattaatattattcatttccgaattacacatataacgcaaattacagaggacaaaaatcagaggccaatgggtgaaagtcaaatattatatgacatcaaaaagcctttagtgattgcactgttgacatggttttcttctttttctgagtgggaggtcttgggctcaattattgcaactgtcattgcattcttcacacatctacttccctattctttaagggcaggtattgattacttttatgccagcctctagcacagagccagggacactataaatactcattatatagtaaactaataactgcataagcaccatgcatcactctctctaatataattccttttattcaatttctctagctctcaaataataaagtgcaatattgatacagtccatctatatcttttaatctgatgattccgaagaggaagataattcaatacttagaattcaatacctcaaaggggaagatatttcattaagtatgtcctgatgactactcctgagaagttgaaatcaaaagaaagaaaacattagattaattaaggtgttacaccatgagacagacaagttaggggattgacttaaactacataaaaatttatataactatatttattagttgagttttaagtttttgtagtaaatcaaactctaaagaaggtattcattcactcttcagaaagaattttttgtgagtgaaaattcacatttggggaatctaaaagaagttcaggaacagttcttaccttcagggagcttaggctccagatgaggaggtaagacacattcccatgaaacagcatactgagtaaatgagcaggagaatggtcccaaggcaggcacatgtgcatggcagtgcccaggctagcctcactgatgtgccggggaaacaaggctaggctagggcccccaatccacaaaccaaagagttggggtcactgacatggcatcttcaaaggtttctgcacagagtagaggcatggtaacgatgtgttgtatattgatctcttcctgtaaccactcaccgccatttcaggggagcacttaaggtctctcctcccttctccctgggagcaagtgttctggtctggacgaaatgagagaactccaagagggatgtcgaaactgggtgtgggatggggagtgggcaatgcccttgcagaagaaatcagaagaatgaaagctccaatctttctcatctttcatcctcttactagtgtttagaggctacaaagaagtgcccttgatggcttaccgattctgtgccagtgtgtgtggatgtggatgtggggatagatgtttgtgtatgcatgtctgcgtgcatgtgtgcactctgtgtatattacatttgtatatgtgtgtacatgttttgtgtttgtgtatgtgttatgtgcatgtgtgtatacatgtgtgtgcatgtgttgcatatgcatgtatatgagtgcacatgtgtgttgtgtgtgcatttgtgtgttcttgcgtgtgtgttttcttttacaaggtcaagatcatcattccattttatagataagagaacttgggctcagaggagctaagtaaagttggtgagtggaattcaacccaggactgcagactctaaccctacgtccctctctttcctcatatgtgttccttctttccttttgatgaagttcatttgaaaagactgtgagggccaaccaaggccagccctgaggccagacacagtgggcaggaagtggcccattcaggcctggctttcctgtgatctttgctccaacctggctcccctgagcaggagatgcagaaagagctgaagccaaatctctggccaagaaagtggtgattggactctgtgcagggcttgacaatcacaacaatatcaacagctgacatttgttgagggcttactatgcaccaggtcactttccaagcacactacctatatcatcttatttaatcttcacagtcattggattgtggcacattgaataccgtcacccatgcccaatttacagatagacagctgagacccaggaagattaagtaacttccccaagctcacacaataaatgagtagtggaagcaggcgctgcacttgggcaatctggcctcccggcccagctgggctttgcggtcagccaggccctggcttcgtaagtatcacatcggcagctgtgagtaaggcagcatggcctgcggggagggtgcaatcacccaggcggcagatgccaacagcttgaatcagggcattggtaatggaagaggaagagccagggcagatggagagtcatcataaataaaggaaacttggtggcactccaaagataactgagatgagggcggcgagcataatggccgagcttccagcccaagtgaggagggagatgatggcaccactgatagaaactagggatgcatgagaaagccagactgcaatcaagtgtgggatcaaaaggaggcagagagaggccggcaacatgactgggtgggtgtggggggcgcggacagagggaaggaaggtggtgaggaggagggggaggaagaggaaggggaggaggggaggaggagtcggcagacacattgctgcctggtgcaggcaaagtgctgaggtgaaaggctgggctagaaggggtctggaagccatccaccttgaggtgatggctcagaaggagccattgctacccaaggcagaggagagcagctgaagagggaggggaggaagaagagggtgggagaggtctcaggagagcaggcacagtgcagtgctctggaagccaggtgagaaggcttctgaaaaatgatcaacttcagcaggataaggatgaggaaggagccctcgaaatcagtgagaagggcaccactgatgaccttggagaagcactcttatgatacagagagaaaagcagcatgagggagtgggtagaaaattatgagttgaagatggaccaatatgttgcagtaacgaggaagagagagtggaagagaaagaaggggagatcaaagtggaggacaagagggaagaggaggagaggaggaagagacaaaggaggaggagaaagcggaggaagtggacatatggaaggagcagcaaggaatttccaaattactgcttgtttgcaggactggttttaagatagagaaggccagagaatccttgtgaacaagaagccaggaaagaagcagggagggacagggaatatagcagaaagagggagacaaggttagaagcacatgatcctggaggaaaattgaagagggagtacatcaggctaagtgtcttagtgtcttggcagcattattcacaatagccaaaagatggaaatactccaagtgtctgtcagcgcataaagggataaacaaaatgtggtacatccatacaatggaatattattcaggcataaaaaggaatgcagttatacctggtataacctgaatgaaccttgaaaacctgctaaattaaagacaccagccacaaaactacacatcatatacttggacttatctctaaaatgtccagaataaataaatctatggagacagaatgtagatgagtggttgcctagagctggggggtggggaggatggtagggccacagagtgatagctaaagggtagagggcctctttcaggggtgataaaatgccctaaagctgattatggtgatgactgcacaactctatgaatatactaaaaagcactgaattgtaaacttgctggtatgtggattgtatctcaataaagctgttatttaaaaaaacaaacaaactttggagtcattcacaactctccacttccactcacacctcagcacaccaggaagtgttatcagctgtaccttcaaagacatcccaaatccaaaacgtctcactacttccagcaccacagtggtcaagctgtccttatctctagcctgataaatgcacatattttaaaaatagcctcctaactggttttccaatttgtcctccctatgtttattctgccccagactccacagtgatccttttaagtggaaagtccaatggctcagcccagttcatgccctcagtggcttcctgtcactctcagaatgagctccctgtccttccttcctggccaggtccaggttccttctcagcttgctcaggtctcatcataggttctctcgggcactgtgctccggctcttcaaacacgctgggcatattcctgcatcatgacctttgcacattatcttggtccattcaggctgctagagcaaaatacctgacactaggaaatttacgaggtgcatgcagattcagtgtttggtgagggcccattcctcatagacggcaccttcgagatgccctcacatggcagaaaaagaaggcagctctctgggccctctttcatgagggtactaatcccattcatcaggtgaagctctcatgacccaatcacctcccaaaggctccaccttctaataccaacaccttggtgattaggtttcaacacaggaattttagggaaacgcaaacacagatcatagcacttgtgcatagcatataactatttcctctgcctgcaatcctattcccctgatagtcacactgtttacaagctcattttattcagtctcttcacaaacatttccccttctaggaggctttacctagtcaacctatctgcaatcctattcccatttttcttcatccctttaccctgttttattttttcttcacagcacctatcactccttgatgtctgacagccttccttcactccacatctactttctccttcccctgtagttcaaactgatactgtctttgatggtaaaatcccatctcaattcctggcttctgctgagatggctgattaaatccatgaatcacatccatgatctcttaccaaatggttgctcagccataaccttaagtattctcttcagaacaacttccccatttttcccatttttgccatgattacacacacacacacacacacacacacagacacacagacacacaaacacactacatatatgcaaacatacacacgcatacactgtatacacaaatgcatatgcatattgtctagtcatcttcctcactgaaatatgacttccacgagcacagggactttgcttcattctcaattgtattctcagcacccagaaaaatccctggcacatagtacacattcagtaaataattattgaatgaataagccttactacaactccttatgttaaagatgaggaaaccagaaggagttaagaaaggttaggaggatcacacaaggtcacacaaccagtaggtagaagtggttagcttgaagccctgacgtaccatgtctcactagctttgttttgttattctgagccccaaggggtgcaatgtctggtcctgagaagggatgaatgacacaggggcaatacattcatagaccattagaaatgcccataccttccactctattcataactaacagaaaattcacagaccattaatatgtagcagtgaaacacactctttgactcaaagatgggccccgagtgaagaggcctgcattccggtttcccccatgagctttgtgaccttgatcaagtcccacagccttatggagtcaatattgcttccatgcttcacacagaggtgagttctgaggtttctgccagtctaaaactcacaactcattttttacttatttatttatttttgagatgggggtctcagtctgtcacccaggttggagtgcagtagcacaatcatagttcactgcagcctcaaacacctgggttcaagctaacctcctgcggcagcctctgaaatacctatgactgcaggcacataccaccatgcgcagctaagctttttttatttttcatagagacaggatttcgctatgttgcccagactggtctcaaactcatggcctcaagttatcgtccagcctcaacttcccaaagcgctgggattagagacctgagccaccacacccagcctaacctactttttaaaacctgctttcatgatctgctaattcactcacttcttgaggtgaaaaaggctgggtttggggacacacagaaaattctaatcgggatttgtctccagcaggaggtgacccatttcaaaccaacaacgcaaaggcactgacacttagtcagtgtgcaaaagagtaaatgtgggaagggaacacgcgcaacaacattcccgttgcctcggaaataacgagtttttaaaaataggctgaaatcaccaattagtaggaacaatgtagtgctttgaagttgaaaaatgctttgcataatgctaataatattttggcagtggtggttctgaacttgtatcaccgctattcttttcagaaaaagaaatagctcctttgaggaagaattatattcttgaaattagaaggcttttataaaatgttaataaatcctgattaaagaagttaaatttcaacttaatcagccattgtgtgtttactatgtacaaggcacagggcttggcactgacatgatggaaaactcaagaggaatagaattgttgctgccctcgagccagctacaaattacacatgtgctgtagggagaagctgagggacagagggaagaggaagaagaaataagagaactgagcccctaccatacacctgtatggctcatatagaattgtatctcattctattcacccattcattcattcaggaagtccttattgagcacctgctttgtgtcaggctccaggctaggtactgggtgtatggattgacaactgatcaggtacttgcattccttcaatacccataaccagccatgatgagacttgttctaatctctttgcagagatgaagaagcaggcccagagagttgcataatcttcccaaggagcccagctagaaaagggtaagagtggcagcaggatttaaactgctggctcagaagctgtggccaagtggaacagataagggtctagattccagggcagacagtatcaggtttgtacctgactctggcgcttcgggttcatataacttcgggcaataagctacatgaacctctctaggaaccttgttctgaattgaatagtatgatattagggcttgataggaaataaagaatatagcccaattttaaaggggcacaattcagttcacagcattccacctctgattctccaaaattcaggttcttctcatacacacaaaatacattcattccttcccaacagccccaaatgtctcaactcattctagcataatacctaatatctaaagtcctaagtctcatccacataccatctaaatcagatatgaatgaaacccaaagtgtgatttatcctgaggcaaaattcctctccacacatggacctgtgagatcagacaagttatatgcttccaaatacaatggtgggacaggtgtaggatagatattcccattccaaaaggaagaactaggaaggaaagaagaggtggcaagtcccaagcaagtctaaaactctagcaaggcaaaatccatcagaacgtaacagctcaagagcaatcctctttggtatgatgctgtgccctccaggcccctggtgtggcagtgtcaccccacagctttgcagggcagccctgccccagagacactgggcagttattcaggcccattgaaatctgggaggctgtcatacccttagaaacaaaggaggaagccttgtccccagacctggagtagaggtgggattataccatctctgtagtgggagttacagccccgctgatctctgagtctcctttggggccctctttccctttccttgaagaacagctcatattcacagctgaatagctctatattccactcctatagattccaagaagtccgacagccttccttcattccacctctattttctctgtcccctttagttcaaactgagagtgtctttgattgtaaaatcccatctcaattcctggcttctgctgagattgctgattaaacccatgaatcatatccatgatctctttatcaaatggttcctcagccacaaccttaagtattctcttcagaacaactttctcatttttttgcaatatagatagattgagaattttccaaatcttcaagttctgatccgttttagcttaacaatttccttttcaatgcatctctctccttttgcattttacttgagtagtcaacaggatccagcctttcaacactttgcttggaaatctattcagctaaatatataatttcatcactaacaaattctacctttcacaaaatactagaatgtagctcagccaaggtttttgccactttataacagaaccaataggagatatacataaagagatgtgttataaggcattggttcatatgattatggaggctgagaagtccccatatctatggtcagcaagctggagactaaggaaagccaatgatgcaattccagtctgagtctaaagacctaagaaccaggagagatggtgtaagttcccgtctgaaagctagcaggctcgagacccaagaagggccaatatttcaactgaagttggaaggcaagaaaagaccaatgtcccagctcaaggcagtcaggcaggaggaattccctcttactcagcctttttgttctactcaggtcctcaacctaggcccacccacgttaggaagggtaatattctttacatagtctaccaattcaaatgttaaacttatctagagacatcctcatagacacacccagaataatgtttgaccaaatgtctcggcacccgctggcccagtcaagttgacacataaaataaaccatcacagagacctttctttgattctgttcctcatattaatttttccactaaacgtatttctagagcagtctgtatttgctgctcactcattctcatatcatgtctacctcctgttcagctcatcactgccaaccagtatcacctggtgggaggttgaggtgggtggtcagtctaataacttattggccacatgtaaaccatgagggtatgacagctctagacacagtattgccctacagagtgtttggcacctcctaactacccttcttgctcctgttcttacagtcttttaaagagacctcaaagcttctgatatagcctatgtcaggtcaatgtaatggaaaaccaccacaggcttgaaaaaccttgttactaagtttaataaactcctcttagattttcttgcagtaattgatgcggatgacaatccctttctttttgaaagtattgtgagaaagtttcaagaaaaatatcaattacacttcattaaaattttctgctcaaaacagaaactttactgatcaaaatctatagtccatttaatattgtgaaaacatgtatatgacttcattaatatttataagttaaaagatcacctcctgcttccaagcaattatattaagaatcaaaatgaaaactaaaagagaaactataaacaaaaagagagtagtaagtcctcacctatcaataattattttgaatgtacatggattaattttccaggcagaagacatagagtggatgcatgaatttttttaagtcctaattatatgatgcctaccagagattcacttcacttttaaggacacacatagatccaaagtaaaggaatggaaaaagacactccatgcaagtggaaaccaaaagagagcagggatagctccacttaaataaaataaaatagaatttgagtcaaaaactgtaaaaagaggcaaagatggtcattatataatgacaaaggggtcaattcaataagaggatataacaattataaatatatatgtgcccaacttcagagcccctacatacataaggcaaatattaatatatctgaaggaagagttagactgcaatacaatagcaggggacttcaataccccactttcaaaaatagagagactatacagacagaaaatcaataagaaaacaccagagctggactgtacttcaggccaaatggacctaacagttatatacagagcattccacccaacagcagcagcatatacattcttctcaagccacgtggagcattctccagaacaaatcatatgttaggccagaagacaagtctaccaaatttaagaagattgaaatcacatcaataatattttcatattacaatgatatgaaagtagaaactgataacaggaagcattttagaaaatttagaaatatatgaaaattaagcaacatgctcttgcacaaccaataagtcaaagaataaatcaaaagaaaaatgtaaaaatatcttgaaacaaacaaaaatggaaacacaacataccaaaactaataggatgcagttaaagcagttctaagaggaaaggatgtaacaataaataactacatcaaaaaagaaagatctcaaataaacaacccaatgttacatctaaagaagctagacaaagaacaaagcccaaagttaatataaggaaggaaataatgaagatcagatcaaaaataaataaactagaaactagaaaaacaataggaaaaatatcaacaaaactaatcagttgttttttttaaagataaataaagtcaacaaaactttagctagactaacaaagtaaaaaagaagacttaactaaataaaaacagaaatgaaagaggggatattacaactgataccacagagatacaaaggatttgttatactataacacaaagaattactctaatactataaccagtaatacaccaacaaattggataaccaagaacaaatgcataaatttctagaaacatacaatctatcaagactgaatcatgaagaaatagaaaatgtgaacagaccaagaatgagtaaaagagtgagccagtaataaaaaagtctcccatcaaagaaaaattcaggaactgatggcttcactgctgaattgtattaaacatttaaagagctaataccaatttttctcaaactcttccaaaatatggaagagaaggccagcgttaccctgataccaaagccagacaaggacactatgacaaaagaaaactacaggtccctgatgaacatagaagaaaaaattctcaaaaaaacactagcaaactgaatttaataccatattaacagaatcattcaccacaatcaagtgggatttatccatgggatgcaaggaaggatcaacatatgcaaatcaataaatatgatatattactttaaaagaatgaagggcaaaaaccacatcatcatctcaatagatgcagaaaaagcatttgaccaaatttagcatcctttcatgataaaaactcttaacaaactaggtatagaaggaatgtagctcaacacgataaaggccatatatgacaagcccaaagctaacatcatactcagtagtaaacagttgaaagattttcctctaagatcaggaatgagtggcccactctcaccacttctattgaacatataacttaatatactagccagagcaattaggcaagaaaaagaaataaaacgcttccaaatcagaatggaagaagttagactgtttgctgatgacatgaccttatatatagaaattatttaaaaccccacaaaaggactgctacaattaataaatgaattcagtaaatatggaggatacaaaatgaacatacaaaatgcagtagcatttctgtacactaacaatgacctacctaaaaaataaatgaagtaaacagttttctttatagtaactacaaaataaaatacttagaaatacattaaaccaagtaggggaaatatctgtaaatttaaaactataaaattctgacaaaaaaattgaagaagacaaaaataaatggaaagatttcctgtgttcatggatgggaagagttaatattgttaaaatgtccattttatctaaagcaatctacagattcaatgaaattcctacaaaaattccaatgacattttccacagaaattttaaaaaaattctaaaatttgtatggaaccacaaaagactccaaatagctaaaatcaatcttgagtaaaaagagcaaagcaggagggatcacactacctgatttcaaaatatactacaaaactatagcaatcaaaacagcatggtgctggcatgaaaacagatgcatactaatggaacacaacagagagcttaaaaacaaatctatgcttttgcagtcacttgattttcaacaatgatgccaagaacataaaatggggaacagggccaggtgcagtggctcacacctgtaatcccagcactttgggaggccgaggcgggcagatcacctgaggtcaggagtttgagaccagcctggccaatatggtgaaatcctgtctctaataaaattgaaaaattagctgggcatggtggtgggtgcctgtagtcccagctactcaggagtttgaggcaggagaatcgcttgaacccaggaagcagaggtcacagtgagccaagatcatgccactgcactccagcctgagcaacacagcaagactccaactcaaaaaaaaaaaaaaaaaggaaatttaaaaattgggaatagacagtctctaaaataaatggtggtgggaaaactggacatccacatgcagaagaatgaaattggactctgatctcacatcatatgcaaaacatcaatttaaagacttaaatatcagacctgaaactgttaaacagaaaaaaaaaaatagaagagctctgtggcaattgtctgtgcaatgattttttttgcatataaccccaaaagcccaggcaacaaaagcaaaaatagacaaacgggattacatcaaactaaaaagcttctgcatggcaaaagaagcgatcaatggagtgaaaatacaacctgcagaataagagaaaatacttgcaaaccacacgtctgataaagaattgctatttcaaatatataaggtattcaaacaactcaatagcaagaaaacaaatgagccaattttaaaaatgggcaaaaaatctgaatagactttctttctttttttttttttttctcttcaagacagagtctcactctgtcacccaggctggagtgcagtggcacaatctcggtcactgcaacctccacctcccaggttcaagcgattctcctgcctcagcctcctgagtagctgggactacaggcacttgccaccacgcccaactaattttttgtatttttagtagagaccaggtttcaccgtgttagccaggatggtctcaatctcctgacttcatgatctgccctcctcggcctctcacagtgccaggattacaggcgtgagccaccgtgcccggccctgaataagctttctaaagaaagacatacaaatggccaacaagtatatgaaagaagactcaaaatcactgatcatcagggaagtgtcaattaaaaccacgatgagatatcaagtcacacctgtcagaatagctattatcaaaaagacaaaagataatatgtgttggtgaggatgtggaggaaaagggactcttgaacactgggaatgcaaagtagtgtaactattatgaaaaacagtatttaagttcctcaaaaaactaaaatagaactactgcatgatgcagtaatctccctactggatatatatccaaaggaattgaaatcagtatttcgaggtgatatttccactatcatgttcattgtagcattatttacgaatagtcaagatatggattcagtctaagtatccatcaacaggtgagtgaataaagaaaatgtggtgtatatatacacaatagaatactatttggccttttttcaaaatttccataggtttcgggggaacagattgtgtatggttacaagagtaggttatggcgatatgtaagatttcgatgcacctaccacccaagcagtatacactgtacccaacttgcagtcttttatctctcacccccctcccgccctttccaccgagtccccaaagtccattgtatcattcttatgcctttgcattctcatagattagctcccacttatgagtgagaacatacgatgtttggttttcaaaagaagaaaattgtgtcatctacaacaacatgaatcaacctggaggacattgtgctaagggaaataagccagacacagaaggagaaatgctgtgtgataccacctatatgatgactctcaaataggcaaactcatagaagtagagagaatggtgattaccaggagggtaggaggaggggaggacaagattggagagatttaaaagagtacctaggttggtcaaaggatacaaaatctcaggaggaatgcttccagagatctattgtacaacaccgtgactatagttagtcacaatgtattatatccttaaaaaatgctaagaaagtggattttaagtgttctcaccacaaagaaatgataagtatgttaggttaaaaaaaaaaagaaaaagaaaactaaagaaaaatgtttatcacttaaccaactcaaaacccaatctgccatattcatgcattctagattacccataactaaaaaaaaaattttgtactgatacttgacatagaaattaaagcaaaaatgtcaaaaaatttaacaaatttggagctgcagattctttgctgaaaatattttcccttaccaagaaacattctcctctcaagagaaataagccttgtgtcaagacaacaatccttctgtgaagagactttgttgagagtttttgttctctggtgacaacaacacagtttgaattaattcattcatcaaacaaaataattttgcatgatcaaacttgtaataattagagcatagtgggatacattttcaaaaagaaggcacactcccctctgtttgaaggtttttgtgtatttatctggtgtttcggaggttaattaattgatattaattaattataaatagttaacccacaaagaaaatgcaattttcctatggaaaaataattggttcaaggatatccagcagctcatagttgaccaacaaggagcggcctggcttacagacagcagttgcaaagtgaatggacaatatactgtttggaaagctgctgctttggtcaaagaaggtaaaatctgatctgctcagtgggctgaattgcatgctgtttttctaagagtaacggaagaactaacagtggtggaagcccctgtgtttgggttttcactgactcactgggcagtgaccaatggcctggccatatactcaggcaagagggcagtggaaacctgtcctatcgaaaggaaacccatatggagcatggccctatgaagatttgaggggtgcattaaagtagaacccatcagtgcccatcagaagaactctcatccaggctcagaaggtgactggaatcaacaaacagatatctacgggtgctcccttgaggaggccacctgagtccatgaaatgggtggatatgggatatgggggcaccgcagcagtgcagagatgggctgaacctagatacgttcctcttgcaccctccttgggcacataatgccaaaactgtactgcttgtcaataagagagacagagactgccgatggctatggggcagattctctgtggggaaagaaggccctgaacacagctgatgagtgggactgatgctggcagcccggggagctacaaataggtcttgacgggaatagacactgactctggactgggctttgtttaccctgcggaagatgaaaatgctcggagtgccataacaaaaacaaaaaacaagaaacagaagatattacatggatttggatggttatcatttcttcagaccaatgaacacactatacagcccataatgtccaacaatgggtagagatatcctcctcagagtgatagtttgatagagaaataggacaggtaactgaaacaatggttgcctgaaataaggagacggcaggcagggctggtttacctggtttcgcagctgtgtgctcacactgcatatgaatgggattaaaggggtgtcccccttagatatttttttcctctggctgatcttggggagaggggatagcgagaatgctggtatgattaagcaattcttgccaaggtagagagtgcactggtaataacaactataattttttctttctttcccaagttacccctcaaataattcttttttctccactacctgatacaatggtccttgtactagggccacaactgcaagtactggaagcagggatgatttctaaaccgaaaactgtaactgtgtttttcaaccttatgtcagaattcctaaggacctaatgggggtaggttatgctttgacccccactggcaaaactggggctaagagtgaatacggctctattgcctgggtggtaaaaatggttcactagttcagagcctatgtaaccttaccctacacgaatgggtatagactgaggagaggcccttgctggactagcattgttaccagcagtctggaccagcagagtggccaaacctaatgtcccttccagaggtggaaaagttgagtaaaaataaatgacaaatggaaaaaggagaaatagtagctgagggtaaaggaataaataaataggatgcactatcatctcgaaagagtctcagagcaagagacgacattgtctcagctcaattataacagatgccttaaagggtacaatacatgtttgccaaagaccactcctgcttttggaacccaatgagataaaaaggaagcctgcaaacccaatggccacagcctgggagacattcatgcagtatgacggactggactgataactaatgactgaataggattctagtaatgtgggggtatcttttgagttatacatacttttttgttgcttgtttgcttgtttgttttgagacagcatctcactctgtcacctgggttgaatatagtagcactacctcagctcactgcaacctctgcctcctgggttcaagtgatcctcccacttcagcctcctgagtagctggtactacagatgcacaccaacatgcccagctaatttttgaggtttttttgtagagatggagttttgccatgttgcccaggctggtctgaaactcctgggctcaagtgatctgcccaccttggcctcccaaagtgctgggattacaggcgtgaactaccgtgcccagctgagttgtgtattcttttgatgtaactgatctgtgtttgaaaaccaggagatggcctgtggtgacgtgtgtatgtgcatgcacacatgagtgtacacacacccagtcacatatatatatcgatgccctgtgtatctcttcatctataccctttgtaatatcctttatttacttatttatttacttacttatttttgagacagagtctcactctgttgcccaggctggagtgcagtggtgtgatcttggctcactgcaacctctgcctcccgggttcaagcgattctcctgcctcagcctcccaagtaactaagattacaggcacccaccaccatgcctggctaatttttgtatttttagtagagagagggtttcgccatattggccaggctagtctcaaactcctgacctcaggtgatctgcctgcctcggcctcccaaagtgctaggattacaggcatgagccaccatgcccggccctgtaatattctttagaataaagtgatgaacaacaataaaagatgttcagaactaaactcattagtgaactcccttttaaacatcagccccctttttttacacaaaattgcctaatatttattttattataaagagatcttttgacatggaaatgctgaagggattacattgtcttaaaccatgcatttgtgacaggaaattactcagcacaccacatagttgcaaacacagaaaaacattatagtaagatgatcaataatcctgcagaaggacctgggttcaaatcccagccccaacagctactggtgcttgcacctggcatggcatggacaagacgtgttccccatgttgtttcctcttcctagtcagtgactttagggaataacaactaaattctggcaaatggcatgtggtggaagggatagcagatgctactaggcactgccctaagaacattgcataggaccctccagccgtccctttgccttcagcagtactgtgaaggccacctcttgaggatgatatgttcataacatgaagggacctggatccctgagtcaccacctgaaggctaagtgcccccatcagactatgacacaagcaaaaattaaccttggcttggaagccactgaggcttgaggattatgtgttgctgcagtgtgtgtgtgtgtgtgtgtgtgtgtgtgtgtgtgtgtgtgttggctacaataaaaaagcagcactagaagctaagctaaaagagagagagagaaacctatgggaatgggggttcctgcagggaatcggaactggcaaagaagaaaccttcttaaggaaactcaagaacaagttatcagatagatgagcaaagagggagttatgatgccaaggtaacattcctaaatctcttctacccctgatcaggatttgtgctaaagcataaaaaagagtagagccgggggggtcccctggacccatctctgtgaaaatgcaatgaagaaaagtagctgggagtcagagagaccctgacagaggcaggggtgacctttgggcaaagtggaaggtgagacagatgacaggagagctacagattcaaggagagcagaaatgaattattttaaattgctactatggttctacggctgccttaaattatattaaacaagaaagacctttcacatggagggatttttctcacacatggaaaactaactctaagcaaattatacacgtttcaagaacctcagaaaataaaacaatatgatgtaaatgtcaatgtaaaaagatattatttttgaaacttgtttagactgtgaccaatgcacaaaggcacctatatctaatttcatattatttcatgaaaatgggagctttcaatctgcaatattcagaaaatggtagaactattatcagaaagcagcttacttaaaccataatttgctattatttacaagtgtggggctataaaatagctttgttgttttaatagaagacataacagatgactgtttcgtgaatcaagatcaatttgccatctcctgggttccagcacaattctgatgaatttaccagcaaccaccaaactgttttggggttgtattagtctgttctcatgctgctatgaagaaatacccaaaactgggtaatttataaaggaaagaggtttaattgactcacagttccacagggctggggggcctcaagaaacttacaatcatggaggaagagtaagcaaacatgtccttctttacatgctggcaggaaagagaagaatgagaactgagcaaaaccattataaaaccatcaaatcttgtaatgaattactatcacaaggacaacatgggggaaactgcccccatgagttaattatctccacctcatcccacccttgacacatggggattattacaattcaaggggagatttgggtagggacacagagccaaaccataccaggagtctaagtacaattatcaaagttcatatatttgtaatgcaaaaatgctatggcctttttttttctttttttttttattatactttaagttctagggtacatgtgcacaatgtgcaggttagttacatatgtgtacatgtgccatgttggtgtgctgtacccagtaactcatcatttacattaggtatatctcctaatgctatccctcccccctccccctaccccaccacaggccccggtgtgtgatgttcccctcctgtgtccaagtgttctcactgttcacttcccacctatgagtgagaacatgcggtgtttggttttctgtccttgtgatagtttgctgagaatgatggtttccagcttcatccatgtccctatgctatggtcctgatgtcaactgaaagtcaaagtattacaatcatgcattgcgtaatgatggggatatgttttaagaaacgtgttgttaggtgatttcgtcattatgctaatgtcatggaatttacttacacaaacctagatgatatagcctactacacacctaggctatacaggatagcctattgctcctaggctacaaatctgtacagcatgttattgtactgaatactgtaggcaactgcaacacaatgataagtatatttgtgtctaaacataactaaacatagaaaagttactattaaaacacagtattgtaatcttatggcacatcattgtttacgcatgtctaaatatatctaaacatagaaaagttaccatcaaaatacagcattgtaatcttatggcacaccactgtttatgcggtccatcactgactgtcagtatgtggtccgtcatgactatacttctattattgttactgttgtacatgtacatgtacatgactatacttctattattgttactgttgttagtagaaggcccaaggagattcctatatgcctacatgtgctataatgtgctattagcattggagacattaagtcaccttagatggtaacagtaaaattctttttcccattaacaagcaaaaataattaattacgtttctggaaatttcaaatcaatggtttaaccatgacagtgcagaaatgctgagaagataataggcacaatttaaaatacacagctatttagttattccaaattctgtctgtagctttgaagaaatagggacacgttataaagtatcatatactatgtatttatagaaatggtgtatttctgaagattaaaaataaaattataacataggaaattggatctctatttcatactatatatatgtaaatcaaattcatattgattaaagactttggtataaaacaaaatttttaaatgtttagtggaaaacaaggttaatatcctttagatcttcatgcagggaaacattttcttaaattggacataaatgtattaaccagaaaagtaaagtttgagaaatataatgtctattcctcaaaagagcccttgaagtcaaaagacaagttacaaacttgaagaacatatttacaatttgtataacaaattattagtatcaaaaataaagaattctaacaaatcaacaagaagagtgtgcacacacacacagataatggcacataaacatatgaagaggagttcagcatgattagtgttcagcagactacagaggccataatgagactcctttttatacctatccagtgggcagacattaagaactctgacactaccaaatgctgaagaagatgtgagtctacaaactcacttgtatactgcacatgtgagtagatattagtgcaacacttgggaaaaacagtttgatatgacctcctataattggtcaattacatattttatgttccacaattttacttctaggtatataccttaaaaacctccagcacatacacaacagaagacatacaagaatgcatatctgtgcctgttcatagaatggaattttatatggcagtcaagaactccaacactatggatgtcttagtaataacagtattaagtgaaaaagtaagtgccagagaattgcatgcatgataccataacatgaatcatgcatgataccatttttataaattttaaaagaattaaaaataaatgtttctataaaaacatgtaaatattaaaatgattaaaaaggaaaacaggctgggcgcggtggctcatgcctgtaatcccagcactttgggaggccgagacgggcagatcacgaggtcaggagatcgagaccatcctggctaacatggtgaaaccccgtctctactaaaaatacaaaaaattagccgggcgtggtggcaagcacctgtagtcccagctactcgggaggctgaggcaggagaatggcgtgaacctgggaggcggagcttgcagtgagctgagatcgcaccactgccctccagcctgggcgacagagtgagactccatctcaaaaagaaaagaaaagaaaagaaaagaaaagaaaagaaaagaaaaagcaaacaaagaactgatcaactcaagattcagggtggttgttatctgttatctctggagagaaaggagaggtgaagggatgaacaaaggaggagcctataaggttagttgtcagaaacaacttctgtttttggtggtggtttcactggtgcttagcaaatatgtaaaaataggctatgcgtgaacaagatcggagagtgccacagaccgggtgttatcatcaattcaattctgtgcacataaaatcctttaaaaaaagatgaatcccctttgagaacaaacctagataaaaaatatcaaactgaaatcatgtcagtccaaatatatcgaaaacctccaccagccagctctgattgagactatttgtaaaaggatctttatttaacattacttccaaaagagatattgcaaccatctaaaagattcatcaatagaggaatagcttaaaacatctgtctacatttatactctttcattaattcatctcatcaacacattgactgagtgtccacaatttgtcagacactgtgggaatacaatcatgaacaaaactgatccaggtcctgccctcatgtggcttaacaatccttttaaaaagggaagacaggccaggcgcagtggcgcacacctgtaattccaggactttgggaggccgagatgggtagatctcctgaggtcaggagtttgagaccagcctggccatcatggtgaaaccctgtctctactaaaagtacaaaaattacccgggcatggtagtgggtgcctgtaatccctgctacttaggagggctgaagcaggagaatctcttgaacctggaagacagaggttgcagtgagccgagatcatgccactgcattccagcccaggcaacaagagcaagactctgtctcaaaataaaataaaatataaaataaaaaaggggagacaggtagtaatcaaagagtcacacacacaaatgtatgctgaaaacagacagtactgtgaagtaaggaatacagggttatagaagagaaaaatggagagagacttatcttgaagcctgcagccaagacttcctgagaaaagggacatttaatagaggcctgaaacaacagagatctgggagtagttacccaagcaaaaaggagacagggaggaagtattgtccaagcacaaggttgagagggtggatcctgtggcagatgagagatcaagctattacagaggcaaaaggtaaaggtggctgaaaccagggcaagggagacatgggggtgagatagggctggaaaagcaggcaaaagacatatcctggtgcagaatgaggccaaggatttcaatcgttgttcaaagagcaatgtgaagaagaagtttaagcagaaaagcaactacatcagaatctcactgcgaagggatgccctgcagccacgtggagaatggagggtccgggcatggatgaggcaaaggccgatgcccactttgacatgagaaccctggctctagtgtgcagcagggtcaagaattgttggaggaacagcaggaggccatctcagcagcacaggcaaggggcaaaggccactagcctgaaggtgttggcagtggggctacagagggtggaggatttgagaattctctaggtggtaaaatggagagcatcagaggtggaaaaaatatgaagagagagggagagggaggcacctagaatgacttgtagagatgtctggcttctagaaatggatggaacgctggaagacgagctgtgtagggctgggaacacgatgagttcagtttggagatgactgagcttaggttgtcctgggacacctaaatggagatgccatgtaggctgtcaagtaagtaggtctggaggggagcctcacctggagataaaaatctggggacaccatgtaactgttcaaatgaatgaggtcactccatataaactgacttggtatgatgtctgtgatccactgccaaatgcatactgaaaaaaggcaagttatagaacaatatgtatcatatcactttttaaaaacatgtagaaaaatacttaatcatctggcctgcaagagaaatacacacactctgacctacacacagacacacacacacaatgaaagaatatacgaaatattaacctatccctatgatttgataaagtttaggtgggaatagataagtaaatgaatttcacttttataaatttctgctttgctgactgtcttgtttcttacaatgagtacttaataacccccatgcccacttcattccatccctttttcacccccaactcctaccttatcctgaatccccacccagtggcagaagctggcaagagaatgggatggaaagagaaaagatgatgtcagttttgcacattattttataacaaaataagaacaacttggtgtttgcttttaagatgcatcaaaatagctgtgtcaaaacgttccctggtaaaatgccattcctgctcctgaagggtttgtaaccaagttggctgagcagtaagtcaattaagatgattgtcagagcatgaagtctacagcaacactgtccactgcactctccctagaggccctcaatgtgctctgaggatttccaagtctcatgtaacacccaagaacacaccacactaaccaagaaatgttaaaaacttcccattgtggagaacaaggtagcaggaatttgaactaatgaacatacatgaacaaaaggaaattaatataaacaagaagattaggtggcttttgtggtttatcctgggtttttcttcagttacttaatataatcaccctgcacagtgccagcccacactcagtacatacttgtggaattgtttttaacatgtccaagcctctattgggctgagaatattattttccctgaacaaaaatggggtaatgctgaaacagaagcattctaatgtcagaaagccaagagacatattgcgtagccccatgtgaactttcttcttccattccctgattacataaagcatagactgatagcatcaaatgagatcttgaagctgccttgttcaacagctgggcacagcattgtttaaccatgcttgactaagaagtgtatgctgaaaatgtggaaccagctcaaatgcccatcaatcaacgagtggataaagaaactgtggtatatatatacgatggaatactactcagccataagaaggaatgaattaggctgggcaaagtgtcttatgcctgtaatcccagcattttgggaggtggaggcaggtggatcacctgaggtcagaagttcaagaccagcctagccaacatgatgaaaccccatctctactaaaaacacaaaaattagctgggtgtgggggcgcatgcctgtaatcccagctacttgggaggctgaggaaggagaatcactggagcccaggaggcagaggttgcagtgagccgagatcacaccattgcactccagactgggaaagagtgagactctgtctcaaaaaaaaaaaaaaaattaattaatggcattcacagcaacctggatgggacaggatactatcactctaagtgaagtagctcaggaatgaaaaaccaaacatcatatgttctcactcataaatgggagctaaactatgagaatgcaaaggtatatgaatgacacgatgaactttggggactcagggggaagggtgacaaggggatgaggaataaagatcacaaattgggttcagtgtatactacttgggtgatgagtgcaccaaaacctcacaaatcaccaaaaagaacttactcatgtaaccaagtaccacctgttctccaaaaacctttgtaaataaaaaacaagaggtgcatgctgtacagacatacacctaataactgaaccatgagtatgtgtcgtaccaggaaggcaaacacaggtgaaattgctcccatcttgcttttcatttgcatcaatacagctcgcgttgttttggcaaggtttcctctggcaagcatcgtattcttcacagaaagtacccacgtactgctcctcacaggtacaggaaaaagttgcctaaaacacaaaaaaagcacagtgtctattacctggcacctctcaacagtgtgctttggctgtgagactcaaagtttgaaagaaccacttcctttttataatcagcaatttaatcaaatcacttatgtcataatctagttgaaatcatcgctttaagacaaacagtagtttctttacagtctaatctcaaacacgtttttctattctttgttcatatttatccccgtcattttcgatcttcctaaaatagaaatgaaatgaacttgttttaagctaaaattgaagttttgctggccagacatggaaatggcaattttgctagagcagatagtttaatgctacagccattaaactagatgtcactccaaccaactaaaaccttcaacagagatagcacttgcaacaaagatgtcatcaaatgtccaacccagaccgtcctttcagaacactgagaaaatgcactgaatcactccttcaactggcctcaatgtacagccatgcagattacctgagtgcaagggaaaataaaaggagtataattcaagtaaccattttgtatcgcttatgatattaacattatcttagtaaaagaccataactcagacacagagaatggaatttgacttgaagcttcatttctgagataggtgcaaaatacaaacaaaactgggtttctgtccccttcttaatgacagcctaggggtacgggcatgtctgaaataaaccacaaatctgtccccaaagcctacacaaagcaatatagatcattacagaagatttttatgaggaagagaggaggagaggcaaaggagaatgacattaacagatcttactacttaagaaaatctaaacaaaacagacaaaagccccttgcccagctcatctccaagcctggcacatggggcagatgttcaatctctaccattccccagccattatcccctcaccctccctccctctccctgtcctcagcctcccgctgctaatcttagaaagagactctctcctcttctccaagcactgtcaactcaggatctccacccagtaccccccataagtacaacccactgcctgccttccccttgaagagaaaagggttatccattcttctctttagtacatttttgtctctcaatcaagtttcataattcctgcacatttcttgataaatttactcctgaatatttatgtttttgtagctattgataatgaaatatcttcttcatcctattcttgttaataccaatgatacttgctagtaattattacacaggaataaaatactagggttttgtttccagttatcacactgagcttttagtacacgtcagagtttttagttgatttccaggctttctacatgacacaaaacaagatgataataataagtccataacaattgcaaatagtaataatgtcatcttttcttctccagttctcaaggttacattggcagctcttccggaataattttggcctcagagggatgcttgtagaatttaccactaagcagattgttggaatgactgtgaaattttatcaaatgccattttagctcctacaggaatcatctattgttttcatctgtgacctattatgacatgaattcaatatccagatttcctagtactgattcaaccttatgctcctggaaggaacatccacttaagtcattatacaaaatggttttaatatggctggcttctattagtagtcatacttctagtgccttccatttcactctccctccaccctctttccccaacagatttcttttctaagaaaaagctgtcccttgcacatgagatcatgttttacactgcataggaggatgcccctcacaacaactgactgaacaagaagtgtgcagatccctcacaaaccaaccaagaggccagacaacaggatatgacatttagctcgaccaaactgccaaattgtatatgggtgtctttcttctgttaacagaatacggttttttgctaagggaatacaacaggtccttgtaatctgcataatcaagtctcctttagtttaataatacattcttcaatgatatcttagaagctaaaacaattataattttttttaaaaaaatcctttcttcttaagctggagctatattttctgccttctatttctatcacctctcacttctttgtggtaaatggaaattccctcttcattctagcaataaaatgaggatctatctgttttttcatcatgttttgagttttttccttttgtatttgtagctggaagctaagagaagctgtcagaaaggtatttttttaaaacaggaaactcctttttttagaactgtcttctaaggacaatcttgtccttgctcaaatgcataacagagtacacatctgatatgtgcatgagtcctgtttggagctctctgtgcattggaagatttgtggccacctttgaaatgtaaatgctgtgcacgcccagtgcatacaatcccaaagcaggcctccaaatcatgataaattactatatgtcattggtcttggcagctgtcttctaaaatttacttggtttgtatccagacattccatattgcggataaatttgcttggttatttgacggatacatttagcatgtaattcatctagtgcattccatggaaaatatgctgcttatggaaataaattattgagagccccaaatcaaatatcttcaagttagctttatttttttatttttttttttttgagacagtctcactctgtcacccaggctggagtgcagtggcacaatctcagctcactgcaatctctacctcctgggtgcaagcgattctcatgcctcagcctcccgagtagctgggattacaggctcctgccaccatggctggctaattttttatatttttagtagagacagggtttcaccgtgttagcaagctggtctcgaactcctgacctcagggtgatcctcccgcctcggcctcccaaagtgctgggattacaggcatgagccaccgcacccagcctcttcaagttagctttgattgaatttagagataaaacagaagccatccattttgttttgctttattgcaagcaggaaccttgaaagaaacctgaagaaactgttgaaacaattgcttttgataaagtagaacacaaaattgattcttaaattttcactgagagatgaggaaggaggttaacaaatgtttaacatattcatgaccataaaattttagttaaatatttgtatattctctatcatatcatctataaagttagattactccctgtctattttctaagaacaaagagctttcctataatattaaaaagtttgttttgatagttttaagactgctgacttgtaagagatcatgaatgtttattataggaaactatgttcgcacatcttttgtgaaaaaccatgtttgaccactgaagtttaactcattgcctgtgatatcactaatcactaatctaactccaattaactccaccagcataagggacaaaataaacttacttaaaattagcagcttagctaaattacagaaagatacttccttgtaaaagtattgtataagtacacggaaatgtacttttcaagtaaaatgaacagtgaccctcagagattaatttaaaaacccaataaagaatctcaattttcctcaacagcttgaagtcaaatatgccatttgtacattaatgaaactttctcagtcagtcagctgtgggaagacgtagtgccagctattggggaagctgagggaagacgactgcatgaccccaggaattcgaggttgcagtgagctatgatcatgccactgcactctagcctgggtaacagaatgggacgctgtctctaaaaaaaaaaaaaaaaaaagaaaagaaaagaaaagaaaaaggccgggcacggtggctcacccctgtaatcccagcattttgggaggccgaggtgggcggatcacaaggtcaagagatcgagaccatcctggccaacatggtgaaaccccgtctctactaaaaatacaaaaaaaaaattagctgggcgtggtggcacgtgcctgtagtcccagctactcaggaggctgaggcaggagaatcgcttgaacccaagaggcagaggatgcagtgagccgagatcgcgccactgcactccagcctggtgacagagtgagactccgtctcaaaaaaaaaaaaaaaaaagaaaaaaaattaataaaaggaaacttctaggttagaaaaaaaatcacacatgcattcacttatttgtcctttcaaccaatgtgtattaagcatatactatgtgccaggcactgttctaggagctgagggtcacagaagtgaacaagaccctctcctggggtttatattctagtagcgttgactgacaatgaataaaatgaatgagaaagtggtatagtaaattaagttataaatggcatggggaaaaacggagacagggaatagaagtggaagggctgttatgaagaacacaatttaaaaccggatgtactgagaaagtgaaaacagggccaggacttgctggaggtgcagagtggccatggaggcatccgaggaaaggtattccaggtgaggggaacagccagtacaaagacttcaaggtggaccatgcctcacatgttcaggaaagatccagaaaccagtgtcgctagagtatagcaaataacagagagaacactgtaacgtgagaggtcactgggcgtgccgtcaaatcccgtgggatggtggttttcatgtagggaccatattacctcccagaagacatttggcaatgtctggacatactttttggttgtcacagccgagggcttgctactagcctctggcggatagagttcaaggatgctgctaaacaccttacaacgaacacggcaggtcccacagcaagaaactatccagtcccaaatgtcagtggtgctgagcttgagaaaccctgatataggctttataggctactgtaagaaccctggcttggtgtgaaattttggaaaagatagttcttgcgccagaaaagacctgaaaatgcattgcacatagtaatgtcgctctacgttaaattaccttgtttcattacaatagtttgttttattcagataacacccagaccctgaacgtaagtaatcccacagccatctcaaagcagaagctggatggttatttattcagggaaattatgtttgagtcttccattttcacatgatgatgtcagtcctaccatcttaggtgatcttccaagtatgagaggtatctttactcagcattataaaataactggctattactggataatttaacttaaactggatattgtccaacatgtattcaataattccattcattcaacacacgttttttgaacactgccatgtgtctagcaatattgtgaatactagagatgtggtgaaggtcgaaaggacacagtccccattctagtggaagaaaaggacatgttctatgtcagataacatcctagagggacaacaaatatatagtttcctgtcacattgtgtaagtgctataaagaagtgtaaattgatacgaggagacagagagtgacagtggggtgtaaataggcttttatctcaatcaaagtctagttgggaagaccaatgtctttgaagaattgcacataggtggaattcaacccttcctccacacagtcaagctttttacacctaaatcgagtccaaccatcagaaaactgaatcagaaaactgaatcttggaccgtattctcttgttcctttggcagaactgctttcactgagctgttatttcaccttacactctcaattaaatattgaagagccatataagaaatatccctgttaaacctaatatgacatccactatgaggatattgttgagaacattatataccatatatcacttcgtgcaccatttacgaactcttacccaagaaaattcactcatttaagtgccacagttttgctagtctttagaactcatgtttcattctcaagaacgatgcaaatcatgcgattactcttttttttttttttatttttgatttgggctgctgtaagctcagggtctagttgaagtttagctttaacaactacatagggctctatgactacctgactatttctcctttctaacttggacaatgccttctaatttatatattccctgattctgacttttttgatatttttctatttcaatactttatgtaatatagagccaaatatcatgaataaatctaaccccctaacacagcactcagagcacttgacagtctggccccaacccaccttttcaatcttattctctgtcattttacctctctcagtaacgcctgtgtgttggtgaacaaatcattccagtgagacaagtcttctcagcagctatatttcttgctttatggatcagaacttataattctattttactttctcccttaaagaacatatacagaaaatatacttgtctttttttgatatcccagtgacatcagtatcaacataaaatgcccaactgactagacattgaatttcattgtttataaagcttgcttcagtgaaattattgcattaaccttcaccatgtctgtcaggtgatccatcttaagaattgagaacagactcaaaaaagaggtcaggaaaattatgtcaggtgtcccagctggcaagcagaaggtcaaggcttgaactcacattgtctaattccaaatcctttgtcattcacagcggcatacagtcccctcattactgtgatggcctcgggttcagaagatgcgtgtggggaggcccttcacccttaagggcatctgctaggtcaaaactctggctaatgagttgacaactctcaaataaccccggcaatggtggcattttagttctcactccagatttctgtggtttttctacttcctcccttgctgtcaggctgccttcatcagctctgcattagtgactatccctttggttcgctgattctaagttcctgtaatctgagactactactgaatttattcaaataaggtgtcaggatagagtaaaaactatcctatctggtggctgaaagtacctcttataagaggtatacataaagcgcctaattgctcctgaacagacttaggaacttcaggcaattcttcgccagaattggaagtccttgatgtctgagactctagttactcagacataatagatgcttaggtgttcactgaaataaactgacatcataataggctgcttagcagtagtcttgcgggagagttctgcacaggcacaggatcttctcctccttcttccgtgtctatctctgatatcctgggtttggctgtaagagcatcagagtcattctttgagcacatgtttatacaaactgggataactggaaccaggattaggaggacagtcccaagccaagaggcgactaacaggcccctaactctgaaaacgaaatggagatgattcaagccactccttgctaaaggaccccccaggccaattttgatttccatcgtgagccagcctaattccaaactacatccgggttattcatagttaaatgtccaaacatctgctaggtcaaaactctggctaatgagttgataatggttgaaactaggtgacacaggcatggtggtctgccagttactctatgtttatatatgtttgagattttccataataaaacaaacatttttttttaattttaagaatctggctaagtaccaagaaaggaaagctaaaactcggaaacactggaattccatttgagcatcccacatctggctcttccccatggaatctgccattgcatctgctgcaggactgctgtggagaacactgtgagcatgtgactgagtccccacatatgaagtcccactccagagatttatttcatatccaagtgccaggaaaatctctgctcgccttaaggaactaacatgttttctccttgtggacaacataaatcacataatagagcatatttccctccaaacaaccctgtcagcttgaagaaaaggctcagccattcctatgccaagggagggtctggctgcctctcagcttccccagtgtactggggtcatgactagggcacgcccagccccagccttggcggaagcagaggaattcctgcttacagagcctatgaataaaaagtccgaagacctctctaaaccagttccccacatactggcagcatcaagttgagttggtttcctaacatcggaaagctctggaatcattttgctcctagttaatggaggagctccaggagcctgtccgtaaagattccaggagtaagggctttctgcagccacttttaccgacagcttatgttgccctaagcagccatcagtgggaggaagacagtgtgtcctggccgactcatgtaacgacacagcattggtcagggtctagcgagaactgaccatcaccccaaatgcactgagcctgaatctgtgcagacagaggtcacagaaaccttgtcctgctaaccctcagccaaggatctattaacccagctcctaggctgtgggaaccagacaggacagtcatttaggtctgaaattacataggtgacagacactaaaacctagatacaaaacagtaaccattgacacattttgatttgattaagcataggcgagctatgactaaagggtcagacaaccagttcagcatccccttttagccatgtagagtttaacctcctactaaacccagatttagtatttcaagaagcaaaaaggactatgtggatgtaaaatttaagagactacctgagaattccatgtataatgtaaaaatgactataaatgccttttcctgaaccagaccacacaagaacacatggaacctagccacagagacaaactgttgctctttgggggaacacagtgctcaaagaaaaactatgaattacatgttttaaattcttgtcttttggctgggtcttattgttctattattcattacacatgtaacttaacatgttcatatcacttatagctcataattttatttcctcatcattcttagatatactatcattcttttattcgggttcagtaattgcaaatgttgtagcttattataaaaaaaaaagacaagcgtagaaacatgcagatcatctcagcattaaattcaggacttgacattcatgaattcatggaattcattccttcagcttaaatgataaattttaaataatagtagcaataatgagagtcctgctctttccttccaaggacattgaagtttactttactacccaggggagaagaaagtaaatgtcttttaggaaatgctgtagaagtctttcttcctaaaactagatatgtgggttggcagaatggagatgttcaaaagcagcttccagccatatactggcaactcatgtgttctcagcactcttggagtggttataattaggcatacaatttacatgtaatcagtcttgatcttcaattcactcacatctgtgtatttatttgccgcaacgttctaatccattaacaaaagtaaagtttgactttaaggaaaatgaatgtcactgaaaattcatctttgattgaatttccctgaaaaaagagcctgttcccacaagtagacaacataccattctactttcttattttaaaattccatttagccctctagttatttcctgtgttatgccacaagaaaatggaaaaaaaatactttaagaaatgaaaattgttatgtataaattactaatgagaagggctggttaaagaatagaaaacctgcccagcatcttcaagttacctcggatgggagcaaaaatgataaatcagtgaagcagtggtgactcttcctaaagatggaaagccgatggggacggaacagaggacaaagctatcatctcctgaaggaagccctgccatgtgccaggtatcatgggaggcttctttcatttaatcctcccaacagccttccaaaataagtgtgatttttccatgttaccaatgaggaaacaaatcagacaatttaagtggcttgctcaaggtcacacagctagtcagaggcagaggggctcagattgagtctcattgtaaagaccttcttacaatttaagacattcagagatgcaaggtaggagggacaggactcagacaacatcctgagaaaggtgatgaggggagcatgatgcactgagtgggaatgggaagggggtgaccccctaaggcctcatccactcttaggtctggtagccctgggttccagccccatgtagggcacaaatcctctctgctgctgtcctggtcccagagatctcatgtcactccagaatgctaacaaccccatcgtgggtttctttcctactctttctgtattcgtttgctagggctgccgtaacgaagtatcacagagtaggtggcttaaacaacacaagtttctttctcatcgctctggaggttacacagcctgagacgacagtgtcggcagagctggtttctcctgaggcctctctccttggtttgcccgtggccatctcctccccgtgtcttcacacagtctttactctgtgtttgtctatgtcccaatgtcctttcttattggatgaggacccacccatatttcactttacctctttaaagtgacctcatttcactttacctctttaaagagcctacctaaatacagtcacactcttagtaccgcaggttatgacttcaacatacaaatttggggggcaggaggacagaattcaaaccatactatttccctttcccctttctgcttcttcctccaactattttcagaacagccttcctcaaatgctgcttttagtccttcacagatatctgatgcttactgtattcagcctcttatcctagacggtgcacaatattccttgaacaattgctgtctgaagaggttagcattgcatgtgcagatgcatgaaacatagctcatgagctccaagaactgacaatctagttagagaaaatgtctgtgtcattctcatcatcatgatcatcttcactgtgaatatttatcaggccttcaataaatgccaggcattgtactaaaggctttgcaaaatgcagttatcctcatagctacctctgaggtggctgttattgttattctcattttatatttgaggtaactgaggcacagagagggtgagtaaattgaccaaggtccgccagctcgtaaattgaaaagctgacatctgaatccagctagtctgatggcaggacctgctctttacattagaagaacatgaagcagagatgacaaagtagcatagccagggaaaacacgaccttgcttgctgagatcttgttcctgggtcttctctctttttgaccatgggcaagtaatttatattatttattgcattgtttcctgttaggcctcacttccgtaataggagaaaataaaaggagatgtgcgtaacccaaagatgctattatttatgttatgtttttaaaatttaactgttgaaagctctaaaatgacacaactgatattcaaaaacacttatccagtaacaaaggagtcagtgcagacatgaatacaattactgtattcatgacccaggatggttgactggtcctccttcccagttcctgcatgagtgaggcaatgaaatcaaatcaaatcacaggctagattcatgaaccaggctgtatgcagagattagaaattgggctggggtaagatccccaaaccccatcccccagtctctttttttccattaagattacccagcccttcaccaatcttggagatagggaagaatcaaatgctgaaacagctgtggacaccagggaggagctgcacctgcacctggtccaggtaaaagggtgaagcccttgatcccttatagagagtctccagtgccctgactgtttcaaacactctgatcgctctgggccaggccgaggtcaatcctgagtggcagcttttgtccttctggggctgaaccatttagttctcaagacgtttgtcaccatctgaaactcaagatcctgagacagggagatggatgtgacgaactcccttcgggacgtcccctttaatgacaaggctgccgtctccatgcatcactctgatgtgtggctcttctctcatctcccttcctccatccttgtttccctctctctcctcattcccatggggctctttcacatgtgtggttcataatatcacaggctgcagctaaaaaatatgcgtgtgtctcaacgcccatctttagccgggatgtgggccttcttctgtgcatgtataactttaacccagcttcactttcctagtcaacctaaaattctttgcctcagtcttcacatcaactttcctcttagtaggttattttatggtttatgtatttttgtggatagcctcaagtctaatgcaaagagagagactgtaaataaatttttaaaagtagaacactgcataaagctgacataaggaatcactgtagtcttcctaatgggaagtgaatgccagctttacagcccattgttttcctatagaaataataatatacacttaaatctaaatattgatatagtctaaattccaagagttttatgtaatccttgatatcatggaagttaactaaaaaaaaagttcttcagtatttaaggaaaaacactttgcattttatttctatagtctctgatctaatcaatgcatttctttttttatttattattatttctgagacaaagttttgctcttgttgcctgggcgggagtgcaatggcgtgaactcggctcactgcaacctccacctgccaggttcaagcaattctcctgcctcagcctcctgaataactgggactacaggcatgtgccaccacgcctggctaattttttgtatttttagtagagatgggggtttcaccatgttggccaggctggtctcaaactcctgacctcagataatccatctgcctcagcctcccaaagtgctgggattatttcttactttatttgaatctagacccacacaaattgatataacatcagcaaaggtgggaaggtcctatcattcatcttaattaaatcttattaaatgcttgttgatttcattattttaatattgaacaaaaggcaggttagatctaataaatgtgtttctccagattaattagaaaaagaatcattttaataggggtctctggaagaaacttaacatatctaactcaagagtggcaaaagaattagaaaaattcaccaacaaaataaacctttcttgcttttgaatttttattaatctataatattcacatgaagcgatttcttttgtgtgataatttaatcctccaattctgagcaagaaaggaaatctgcatacgactttgaatttaagaacattaacactgctcgcgtgttcctctcaaaagtgcctgggttaacgtatcatattttaactattatgatgcttgtagtttctttcctaactcatttacgatccccagactaggaaattgaattcaggccctttatacagaggaaatgaaacccacggttaataccctagagcagcagtccccaacctttttggcaccagggaccagtttcgcggaagacaatttttccctggacagggtaggggggtggttttgggatgaaactgttccacctcagctcatcgggcattagctagatcctcataaggagtgcacagtctggattcttcgcatgcgcagttcacaacagggtttgcgctcctatgagaatctaatgcctccgctgatcggacaggaggcagagctcaggcagtagtgctcgctcgccactgactttctgctatgcggcctgattcctaacgccatgggcaggtaccagtctgtggcccagaatgggggacctctgctctagagcttctgtgtccccatctgatgatggggatggtgaaaatgtctgtcacagcgctgtagggtgtggaagtctttgagccaacacagatccatctaggtgctggaagaaacattaagtgacgtcctcattcacgtgcacacactgcagcaaaagccaatcgccttgcaatatggctgccatctactacggtcctcggtgtggaaggcaagctcaaattcttttttctaagtattagttacagaggctaattttaaaaaagaaaaagatcctatgagttggcctaagcgcctgtcctctccgaaagctgcataactgggcttttgctgtggaatgaggctgtcgttcacgtcatcgcgtgagggattcttccagagcctgtaaagctcctctaaacttagcctggtttatttggcataacctctgcctcagaagaataattcaaataccaccagcttcccctgtttctgaaatgaaacccagacatgagattcagatatgtgcacatatctgacgattcttacctccccaaacccagatccctgttctcacaacccatacctacaagttgcacctgccttctagaatgatctactattctcactttcactgaaaccaacccccaactaagctgagttgttccagttttagtaatagataacaccttaatgtgttactattttagggacattcgcatttaaatagaaagccatgcctttattatacaggaattaagttcaaagaacagaaatccaggcagcctgccaggctggtgtctcaaggaaatttggggttgagaaaccaccctagatagctttgaatcttacctcagtgccttctgtccaacagcatggacaaatggattgtatcaatgtttgagttacttctattttttaaaaagaatgttttgttcaaaagcaaaaacttcataataacttttttttaagttattttctcctactattactcctggctggtaaatatggtttatctattttttagaagacctatgtatcagctttctttctgggatggggaatgattatgtattcacgagtatttctggctaaaattgacatatgtcaacaattttgtattttaaccgcaaagctgaaatacatttagctgagtagagcttcaaagcaatggctaaaaagtgaggcaaagggcacatttctgtggccagctgcaccaacacttgtcacaacacaggtctttaaaaaaattacatgccagtgaatggagcatgtgctaatgactcgaactcagaaatttaagtatcaactttcttccaacaattatcctgcaagattagaactccaagagggaaattagacatgagtctagccccagtgatttccactaaagctaattacaatcccttctgttggccagaagggtccctgctcactcaaaagacgatgagtggtggcagaaacttcctaggataacagggtcaggatgccaagtgcaacaaggaccatgagaaggtgactgttgacggaggcaactgatggcttcttttgtggtttgcgcatcacatgtgccaccttttactgggaaaatgctctacaaagtgcttccacctttgtgatcttatttcaacttccattagaaatttttccagcatttacacagatttgtgcagcctaagtccttctacccaccacagccctgtgacatagatatttctatcatccccaggatctgatagggataccaaggctcttgggaaataagaagggcaatttcagtaaatgctggagtcagacattgaactctgatctctacccgcaagtctgctggcttccacagggccatgaagcctcctactctatcagatgattttgtacaaatatggaagcccatgctgacatcacctggaccgaggacaggaacacataaatatttgctgtccccatgaattctctctctaactaggaaacacaaataaggccttcccgtgcttcttactgctctaaacaaaactgaaaaatgtgagtgtctttgcagtgctaaaaattatctaaattccaacccttactgagattgtgtcgcttaattccctagagcctctgttcccattggataattccagtaaagaaaatgtccatgtcccggggctgtggcaggtgggagatgcttcctaccagggcatagcagtgggactgacgtctcattagcagtctgtggatttcaatcaagctaatgtcacggagtatatgtgattaaattgcaaaatggattgttcttctggtagaaaatggatgaataatattatgctaatctaaatatggaagcccatacttctcacagtttcatttattttagcaacgtgagaaagcccttcaggcaaaaggcaagtctacctgctgcttttgattctagataccacaacataatatctttttttttttaatccccaaatctaccatatgtgaagaaatcctaacaatagaggagcgagcttcggctgaaaaatcaatgaaaataattcaagcttgatgataagtgagcggatactgcaagtttccactgtctgtggttaagccccacccttgatctcctccaactccaagtgaaccacgacccttgccattcagccacccatcttaccaaaggctctttttccatccaagacccctaccacacttcctcggaagattgtttcatcatcacttcagctggtgctttcatgacatatataactcatccctttaatattttactttcaacccaacattaatacttctggaattagcatttaatttggctaacgtgtatgattttgttcaactgtccattactcacacctgtagtactttgcttaccagcacttacatctataggaaaccaaactaagaccagagaattacaagaaaaaaaaggtaaaggtaaaatgctaaccagaaagcatgtaaagacatgaagaagaggccaggtgcaatggctcatgcctgtaatcccaacactctgagaagccaaggcagaagaattcctcgagcccagaagttcgagaccagcctgggcaacatagggataccctgtctctacgaaaaataaaaaattagctgggcataagttggtatacccgtgtggtcccagctgctcaggagactgaggcgggaggattggttgagtctgagaggtcagggctgcagtaatcacatcactacatgccagcatgggtgacagagtgaggcctcaagtctttaaaaaaaaaatgaagaaggttaatagaaaagaaaaatgaaaaacacactaaaggagtttaaaaagcacctattaaactataatggggagatagaatgaagagagaaaaagcaaaaaaaaattttaagtttttctatagatatagacctaaacacacatgcataattatttatgaaatatataaatggtattctataagcagctacaggtacttattctgttcatatacttcaatgttcccccagattcctgccaaaatattgccactgtgcaaaaacaaaatgcataaatgacagcactgatgtcctacataattaatgacctttgaactctgggcaactctgggacattccacatttgccagggcctcttcagattcccaggaagactgttatgctagagtctcctgtgcccttctctctccatttgagccctaaacgatatcccattgcacatatcacataaccacttctgtctgaggactgagccacagctcaaattttctgcccagaaattgcatggaaacgaactacagtcacacagaagagagatgactgtattcacggcaatggcccgagagggcctgtagcaaccttgctgggtttgtccattactaagcagctgccgaattccagggggagctttctcattcccttctggagtcagtttctctatcccttattgacttggaaatatcctatttaaccacagaaatatcattaaactagaaactctcctctgccgtgaacttggaaagaactaatgcctgtggcacaattaaatgctgatcttagccttcaaatgctcattatgtgaaagaaaattgagtatggaatgattcccctgttaccgatcagtaacagatatgtgggtgtaggccaagtttcttgggattattcttgcagtacaaggaaaaagcaatctaaaggaagaaacccatacgagcattcatgacagcctgacagatgctgggggtgaggtgtgacctgcccttttcccacagtggtggtggcttccttttgggtcaaggcaatattagggtaccatcttctctgaatttgccttattttacattccctagaaacaatccaaacttctaaaagactctcagacaaagcataacctgagaatgagcagatatgtcagctctgccctagcctaggccagtactcaaggcagcacaggcaaactcaatcagccacctccatccaaagcaaagcaacccagtatttccaggagtgctgctctcaatcaactcaacgaagtgacgtgcaccattgtttcttgccctgtaacccagatctgcttcatgcacaaacagcatatggttggaattcagttttgttggggaaactcatttttttccaaagacataaagcacctataatatttttttcataaaactctgattaacatagcatcattgatcattagaaaaatgcaaccaaaagcacaagataccaattcacactcagagggatggcaagaataaaaaaaaatggaaaataacaagtgtttgtatgtggagacattagaacactcgcacattgctggtgggaatgcaaaatgcttcagccactgtgaaaaacactttggtaactcctcaaaaagtaaaacatagaattagcacgtgaaccagcaattctactccttaggtattcacccaaaagaactgaaaacaaggacttaaacaaatacttgtacagacatgttcatagcagcattaaccacaatagccaaaggtagaaacaacccaaatgtctatcggtgataaatggaccttgtggtatatccatacaatggaacattactcagccatataaagtagggaagtactcatacatgctacaatatggatgagccagaaaacattatgctgagtgaaagaagcagacacaaaaggtccattcaatatgattccatttatatgaaatgtccagagcagtaaatccacagagacagaatgcagattggtggttgacaggggttgggggaagggacaaatggggagtaactgcttaatgaatatgaggctttattttgggggtgatgagaatgttttggaactagacagaggtggtggctgcatgaagctgaatgtacttaatgccattgaatagttcaccttaaaatggttaattttatgtcatttgaatttcacctccatttttaaaatgtagagtacctctgtcaagtcttttgcctgacatcactcgctcagaaaaggaaggtttcctccccttctctgcagctttccttacctctgtcaattccatcccctccaagaccttcatctgttaattacaccccacctaaccattctgatagctcccacctccccaggtgccagtttccttccctcggcctatttcaatgtgatgtatcctctgctctagaagcaaaagcctttcttttgaccgaatttcccactcaggtaccatctcactctgtccttcttttcaatgccaaacttatcaaaaaggcaagccacacagattgccaaagctcctccttggttcctataatctggcttcctccccaccatcatcactgtcttctcaacataaagatccaggggcaaattatcaggccttcccacaaggagaaggtcccaggccctgggtggaacccaagaaatgaagcccagggaagccgaccaatttcctggaaagcaactgctcaatttccttgtttctttttactgtcttgaaagctttcaacaatgtttatcaaaaaagttggttttaaccactttagaagatttctataattttaattggctggctttcattttatttttcaacagaacttgggggaatgttcagttcacttctaacctggccccctgtgggctgctggcagagaaggaaaaggagagaaagtgccttgggaataataagggagacagttgctgatcctgggctgggcatgggggtgtgggtggaaatggaagagaaggggttgaggggatcgaggagcagacaaagatggggagtttgtcaaatctgcttttagtagattgacccagagctgttacaaggaagccattcaaagaatcaccacagatgagagactacaatgtgggttttcaagatcaaagcgagaaaaggctgaattattcaaaactaaattaagggttctcagaataataagttaaaggtaaacaaagtaaaaacagaaatctagaagaaaagggttagaggcatggcctgaaccagaacagaggatctcaaaatgtgatttccagacctccggggactccctgagatcctttcaggaggtccatgaggtcaaaatgattttataataatattaagacatgatgtgccttttccactctgttgacatggacaccaaagatgtaaaaacaatagtaagagaaactgctgatacctccgtaagaggcaaagccgcggctttgaagcggtagactggggatcatcaccatcatcagacatttgcagaggggaaaaaaatgtcaatttcacctcgaatgtccttgatgcggcagtaaaaattaaaatttgatgaatgaaccctcaaccctggagtgcacatctttccaacattgtctgacaatggaatgtgcgtaccaggcccttctgctccacacgggaagcactacggctccctcaaggaagtgcacttgggccatcgttcaccgtgacctgaggtcgtccatttttcatggaacaccctttctcctcaaaaaaaatgaccaaaagacaaactgtggttattcagacatggctatttggcagatattttctctcaaatgaacaaagtgagcctgtcacttcaagcaaaataagcaagagtttttgttatcggagataaaatctgagctttcaagagcaaattagaattttggaaaacttttatacaagcttgacagattcccaatacttaaagacttttctgatgaccagaagtgacttttttgatattgtaaaatgaaatgcatcaacatttggaagctctgtataactcagtgatccaatgttttccaaaggactgatgtgtgatgttaccaaacccattcatgggcaaaagatccaaaacacaagacagacattatagatcgtaatagatggtaatggaacagaccaatagattgtaatgaaacaggccaagagattgtaatgaaacagaccaatagattgtaatgaaacagaccaatagattgtaacgtaacagaccaatagattgtaatgtaacagaccaatagattgtgatgatatagagaccaatagattgtaatgaaacaggccaatagattgtaataaaatagaccaatagattgtaatggtaacagaccaatagattgtaatgtaacagaccaatagattgtaatggtaacagaccaatagattgtaatgtaacagaccaatagattgtaatgaaacagaccaatagattgtaatgaaacagactgaaagcgtttgacatggcttcagagtccacattgaattaacctttaagaatctttcacatgtcaaattttggagtattttctagaatatacacaaatatctgaaaggctattaaaacatgtatcccatttccaactaagtatctattgaggctgtattttcttcttagacttcaaccaaaacaacatactgcaacagattgaatacaaaagcaaatgtaaaaatccagctgtcttcttttaaaacagacattaaagaaatttgtaaaactgaaaacaatgccagtcttctatattgttttgttttagaactataattattgttcatttaaaaggtattattatgttaacaggtgatgagtttattgggtttactaataagatgaatttatattttttaattctttttttttattttgagatggagtcttactctgttgcccaggctggagtaccctggcacgatctcaactcactgcaacctctgccacctgtgttcaagcaattctcctgactcagcctcccaagtagctgggattataggcacccaccaccatgcccagctaatttctgtatttttagtagagacggggtttcaccatgttggccaggccagtcttgaactcctgacctcaggtgatcggcctgcgtcggcctcccaaagtgctgagattacaggcatgagccaccacgcctggctgtattttttaattcctcagttttaatttaatgcattaaatatcaatagatataacccaatcgacaaaagctctttggggtcctcaatcatttctaagaatgtaagggatcttgagaccaaaatgtctgaaaaccacaaggctaggtgaagccaaacagttttgtaaataaaacgactaacagtacccagtagacaaatcttcgagtctataactcaataggcagaaaatgggtcaagttctgaaaacaaaagcactatggaagtccagtgagggcggtaatgtttgtccagagggccagtagatctcaactaataccttggagaaagcctccaaatccaaccctgcctgccattaagactcattagttgccaatgcccagagtccactggtgcttcgaaaaagtgctactatactatcctctaatagcagcaaccttggacacatgtaactggtcactcagaagccacttgacaccccacagcttggaaggagatgttgtaaagccagactgatttttttttttctgagacagagtctcactctgttgccaaggctggagtacagtggcatgatctcggctcactgtaaacttcgcctcccgggttccagcgactctcctgcctcagcctccctagtagctgggattacaggtgtgcaccaccatatccagctaattgttgtatttttagttgagacggggtttcaccatgttggccaggctgttctcaaactcctgacctcaggtgatccatccgcctcagcctcccaaagtgctgggattacaggcgtgagccaccacgcctggcccagactgatttttaaaatctaagatgagttcaaagaaggaatggagcaattaccatgagacaaactaaaggtctaatctcatcagacttcagggaaacagatgagtctccttataatttaaagtcatatttggagtgggtgcagaggaccgaacaccatggtggggaaatgctaaaagtttttccctcaaaatctgaaagaagtaccaacttgcatctgatggtcattggctagttacatagttagaggctgaggaaggctgaggaggttggaaatggtttacaggagatttaggcctcagataagcagggaggtcagtggcttccaatgacagttttctgacatgaaacatcagggcagcagggacgcatccgtgtcctcaccctggtttggttggggcttagtttgtgcctcacagagaagagatgctcacgaaacactggatgagagaatgaaaatgaatgaatcctccaaggtgataagtggaagagatccctctttgggagcaagcagatggttttcaggtccctaaagaggggcaatgaagcagcagccccatatgggtgcccaccccaggcacagccatttatttccagtggctctcacatacacactgacttatgaactgaaaaataggacaaaggtataagcattccagggggaggaagaacaaggaaagctgacccaccaagctccaaagcgatcattttctgctcttgggcataaaaatccagccagaggcctatttctatatgttaaacattatggattaaaatctaagaacaatagttatgtctcccatacagttatgacatgagtatctctcctctttgtaaagacttaaaatctgtagcaaatgaagtgtgaaatcgggccacacacagttcctggaggcgtatgaaggctgcaggccacacccatgggaattctctttccccaaattactgatttcacctgtaccctcattttctcaaactttgctctggagacagagaaacccagggagttttgtgccccaatacaacacatgccaaataagaccatggaagagaggggctgaatcttctaagtctctctgaaaggtcatgagacccctgcctttagtgcgttggtgtaaggtccgtggtccccaggctggcagcgtaggcattgcttgcgtagcatctcggggccatcccagaccctctggccacattctgcatttaacaagatcctcatatgattcacgtgcacattaaggtttgagaatgctgcaccaaaatgccataaggtcaacccccgaccccgccaaaaaaaacccaaaaatgtatttctacctgctgcctgttttttctcgtagtgaacattaaaactttgcataaggacactgaatgggctacaaaggctgctataatcctgaatatcctcctagaggacactgctgggggtggaaggcattagaggcagtgttgctcagcagtaggaaccccagagaaaagtccagaaatctcacttcattcttgtcctacctttactatatattagctcttgggccttggataaacggcttaaatatctcttagaccttgatttcctggtgtttaaaataaaataggtggagagacctctaaaatccccttctactctaaattctctgaccctgaaaatgtcacccatgatacaatccttgccctaatatatttaacatgccaccaacattccccaatgcttctataactgtccgcatgggacatacatttcaaccttctgaaatagaaacatgacaagatgtctatcctttgggaggtcattttatttttctttttttcttttttattattattattattatactttaagttttagggtacatgtgcacaatgtgcaggttagttacatatgtatacatgtgacaggctggtgggctgcacccactaactcgtcatctagcagaattattttttaatttataataaatgattcaaatatgtgattgcattttctgtgcaggcgatgatacaatcatccttctgttctgtaacgtaaaatgcagcaatgtctttttaattacattagtaccaagaattataattcaaacacaagccaatgaaaatctagacaggcttattctttactcgttaaaaaaaagcaacagctgggctgcacttacttttatgatctctatggttaatgtgtttctaataattattattgtacttttattactcataaaagcactttctctctcagaggtccacaaagcagtttctgcaagtaaaatctgtggaagagatcaccctgctattagcaaataaacatatctcagacatcttcacgttagcattaagtctggagcatcactctctgactcaaaaatgtttaacgaacactgtcataaagctatttagtcaaaagaaagggtttccctcatctcttagaaaaatgtatatatattttttgacacagagttttgttcttgttgcccaggctggagtgcaatggtgcaatctcggctcaccaaaccctccgcctcctaggttcaagcaattatcctgcctcagcctcctgagtagctgggattataggcatgcatcaccctgcccggctaattttgttttttgtttttttttaagttcaagagatttaatgtaccacctggtgactgtagttaatgatgatgtatacttgaaaattgctaagaacaaattttaagtatatactgtggaatgaataaatcagactaacataagcattatgtcacataggtatcattttttgtggtaattttgtatttttagtagagatggggtttctccatgttggtcaggctggtctcaaactccccacctcaggtgatccacccgcctcagcctccaaaagtgctgggattacaggcgtgagcccccgtgcccggcccaagaaaaataatttcttataataaattagcctcttttatctgtaataacacttgccactggtttatcaagtatttcccatccactatcccactctgcaccccctctcactgctttcttccctagtgaaaggagaaattcctccagagtgctggcagagctctgggcacctaagctcaccacacactgaacagaacgattacaaagtaactgtatgttctgatgtcctccttgaaagctgcagttttggtgctgaaaaggatgcaggaaaggtctttcctttgattctttgtgggctccctcgactcctctcccatcctattcctttcttataagccaaccaggtcacagtgccttttcaatgtctcatgaggacctttgtgttgcattaatgatgtagaggaatgagttctcagggaagtgatgggtgagtgaagatgacatcttctcttgcacttctgtacattcccacttccgaatctgaaggggagttcactgatgctttcaaaccaacagaggagagcatcaaagatccatgggttcaaattttcctgacctacttctttttgaaatgataaggaagaactggcaatgctgcttaaaatattcccaaagggttactacaactttctgggtcacacaatctgtgagatggccttagatcagagaatattttctcactattttgtaaaactaaattcaccgtttactttccatgctcccatatttagcaagtatcgaacttaaagtacagatctaactcaaaactcagacaactggattcctatcttatttccgttcttttatttgtttttctcgtcccgttgatagacagttcctgagcatcccatttggaaagcaccatgctagttgttacgacagttactgaatgaaccaggcacagtcactaatgtcgaagagctcaccttccgagattccaaaggaggttctccatgatctcacatctgagtcagacatttctctgggctctcagaaatgtacttgcaaacctctcccacagcacacaacacactgctctctaatctatgagttactcatccagcaccctgtccctgcggccttgtaactgcttctcagaggctatgtcttgctagaccagtatgtatcctccagagcctagagggtaccagacacacagcaggtgctcaataacgttgcaatgaagggaatgcaaaaaataatgaatataaagacatataagcataaatcaaaagtcatgtgttcccacaacagaaggaaaattctacagtacttcagaggagggacctacttcccattggagattagggacagcttctagaagcaggaagattttgagctgagcctgaaaaatagttggggaggtggaagggtaagtggtagagactcagggggagcagggccagtgaggcaataagcattccagatggggaacagcatgagcaaaaccacagagatttgagggtggaactgggggtgcaggggttgtgagaggggctggggtcagacactgaagtagctgctcatacatcagctatggtgtgtgtgtcactcagtgagtgaacctggaaatagacaagcccaagaaatgataatttacagggagccctaaaaaggaggcacatggtttcggaacaggagaaaatagatatgaggcagacatggacctgaaaggacagtgtctcccaacttggccacatgggctatagaacaaggacagtgggtattatcaagcaatggacaaagtaactggttcgagtcattgatcatttccaataaaccaaacccaactgaaagaactcagttgtaggtaggaagagtaggacttcccagagcttgagccttcaaattccaaaggtaggaagagatgtcacagaagtcaggactcgtcaggggccagaaatgcaagagcttctctcagagataggcccacccctgggctctagaaggtttgaaaatgatgccagctcaattgtctctcaaaacaacgtctcagtagtcagctctggtatccgatcctaatagattaaggatggtgggttcctaaggcaagagacagtgaggtttctagggagtcttctcagagtggaggcctgatcccatttacctatcaacataggccagagccaatcaacaggaaaactatgggattgttattgaaccattatatcactgcctagcatttatctttattactaactccatgtggacttgaaatgattaacaacataatccttggatgaaaagatgttgtgcctatcctttagggagtcagcaggaagggggagatgagaagcatttttctgaggcctctgttttcagaattgttgtccacaatctgctctggcatcagaatcaccctgctgcccaataaaaggcatccacagctgagcaaaggacctggaatatgactttttgccaggggaaaacctaacgttgggggaaagggattcaactgggtagaaagggggcaatagggaattagaagaagaagagaatcttgtggtggttaattttatgtatcaacttggctgtgccacagtgcccagatatttggtcaaacatcattctggatgtttctgtgaaggtgtttttggatgaggtttacactgaaatcagtaagtttaatatatctagtgttccattattggaacgctaagcctgtgggagttatttatatcctactgctcaaggtcattgccaaggtctgattattcactcatacaaaaattcaaaaaaattgtatcctccagcataaatgggctaagaaaagcagataagcagattgcccttcataatgtgagtggcctcatccaatcagttaaagacccaaagagaacaaaagcctgacctccactatgcaagatgggattctgcatgcagacagcttttggactcaaactgcaactctttcctgagtctccagtctataggcctcccccattagatattgcacttgccaagactccacaattgcatgagccagttccttaaaacaaatcatatatatatatgtgattatatataatttatatttatatttatttatatgtatatataaattatatttatatttatatttataaattatatttatatttatatatactttatatttatatttatatattaattatatacaatctatattatataattaatatataatatatataatcgccatccaatgttcctgttcctccaaatacaaatttcttgacctagagagacatagtccatggaatctaatttggatctaaagaagaattaaggcctaaaccaaccaagagccccgtgctgatgccctgacactcacctgtgaggtaattaaggagtcaatcaccaataggccgcagctggtagcctaacaaccttgatgaacaagttcagagagagatctaaagctttttttaagcagaaggaaagatcagaatcaacccttggtaacacgaaagcagttttcaagaacagagagctccttgcgatgttgaagtaaacatttataaagaccttcccccaaatactgcaatatcaagaacagcaagcttgagctttatcacaaaccacccatcagctcgggattgtgaaatacgccctcgcccaagtgcctctgacagaaaagaaatgagttccattaccaaatgaaagcggggtggaaataacagaattgcttttattttgatggatgatctaataaaaagacataaaaatgatgagaaacaataaaattaaatcacaaaatacagttctatttgttttgtgctatggagtggattcttacattgggtggaaggttggactatataacttctaattttaggaaacagtaaaaagaaaaaaacgtgatgacaacagtctttcattgctagaaagctacttctaagacactgaaacagccattgcaacaatcataaaaagtcacaggaacccaagtaggcaaaaaaaaaaaaaaaaaaaagattttccattccctctgttcctgccttagggagttcaagtccccccagacatttctctccaacttaacagtgtgcgccaaggtggtgcgtcttagaatgaaatggacgtggtcattccagcctaatcatttgcttagagtcactgaggggtaataataatggctcagataagattattgccacagtttccttaaattcactgaagggcaatacagaatcaatgacagccgaggctctactagaaacacctgaggtggaactgggaggcaacacggaaggaggaggtgttagctcagaggcaccagaagctcttcaaaaacctgcacgttgtgcacatgtaccctaaaacttaaagtattaaaaaaaaaagaagaagaagaacaagaagaagctgctacccctgatggagatgcgctgcctctgaaaggatctgctaaaactgatttggattcttcaccacggcttttgattcgctttttttcacatttgacaaggctggccaagttacctgcccggtgctaaacacctacctctattgccttttcaatgagtccatttgaagcttccaggcagagccttctagctagagcttacctgcagagaagcccacaacacacatacattaaagtaacatgacgaccgccttacggaatcaacgtttctccagaagggccacccgtaataaaagaaagctcacaatgaatctcaccactttatcaatcaaaaattctggttcctcttacaggacatttctctcgtgccaatattaactttttcagagctaatcagacctcaaaattattcactgggaagcctgagaaggcctgggggaagatctgtgtgtctcctcctcctccccgaaggctcactcagaaggcaggaaggcctgcccctcctccaccccctgccagtggcttttcttagtctctcacccttcctctcttctggcacctccttatcaaatacgttctcccatagacaagtcctgcatatgaaaaagaaattatattgaaatgtgagctgactgaagagttaactatgacaaaactgagtattgatgcctgctctttcttccgttacctaactatgcatctttccaattcttgccccttttgcttctctataaaattcctcctattagtctcatctccatagcagcatcgaccatcatctctaatcagaaaattcacaactatacacacacgccaccccacttgcccttaccctcaaacctcacattttcctatacttaattctaaaaattgaattaaaattaaaaaagaaaaaaaatatgttctccttagcctcctcttcttttctccagttattttacccctccctagccatgactctcatagaagaacactgagtgtccttcacatttttttcccataaagtatgttgatacatgaggtttctcctcgggaagaagagcagactggtccaaagtggcatagacaggagggcacaggatgtaaagggcaggcttggcctcctggaaggagcctcctggctctgcacctcctggcctcactctagtggctcacctcactcccagaagcagggagagtttgggcttcagtttccatttgtgttctttttcaaagatttagcagaaatgattactttcactatgctttcgggttcctgaccacattctgcctcctccaaggaatatcctacagaaaaatgttatatatctatttattaatttttattaaatatatttatatattttatttatttattttttgagatagagttcagctcttgttgcccaggctggaggccaatggcacaatcttggctcactgcaacctccgccttctggattcaagcatttctcctgcctcagcctcccgagtagctgggattacaggtgcccaccaccacgcctggctaattttttgtatttttagtagagacagggtttcaccatgttggccaggctggtctcgaactactgacctcaggtgatccgccagcttcagcctcccaaagtgctgggattacaggcgtgagccactgcacctggccggaaaatgctatatttaagcagctgcaatattacagctaacaggaaagtcacaggttttctaagatgacaagaacagtacttgaaagcttctgccaatattccttctgttagtccccctcctcacacttatcaaagtccactagtacccaatgtgctgacgttctcacaagaaggcatcaccaaagaaaacctacctgtgctaccctcaaaatctcaaacaaaccatgctcttttggggtttgggaatccactgtcactgaacattaactccaatagaaatatgtgtataactagagacaaaaataaagaaaaggtgctggagatggatgtagtgagtggtgaggggaatagatgtcccctaatggaacaggccccccttgtaaggtatgaagtcttccttgttagagatcttcaggtggaccctggatccacctgcaaaatattttaaggaagctctaggccaggtgcagtggctcacacctgtaatcccaacactttgggaggctgaggcagggagatcacttgaggtcaggagtttgagaccagcctggccaacatggtgaaaccccgtctctactaaaaatacaaaaattagctggacacagcggcacatgcctgtaatcccagctacttgggaggctgaggcaggagaaacgcttgaacccagaaggtgaggttgcagtgagccgagatcgcgccactgcactccagcctgggtgacacagcaagactccatctcaaaaaatatatatattttaagagagttctatactgatgaactttgacctcagtgactgctgtggtcctttgttcatctgactcccaaactgctgcctggaaacagaaaacaggaggcagaggaggaagctgtactcgggccttgcccccatgccctggccacatctgctgaagaaaaagtggaacagggctcagggttcccatagtgtttctgatgccggctccacaaagagcaaagttaatgtgtcatctcatccatgcctcttctcggtttcttctcttacttttctctgacgtctgtaactctattatcatagccagggaaatgcgaagactaaggaggaaattaccacattggcacacaacagtccccaaaacgggtaagtgaatgactgtgtttaccttttgtttcttccatttctcttgattgtactactggatataatgaccactacttctcacaaaatctctactttataccaaagcaagaggatctatcactacacaaatgcattacaattactttgaaaatcatatggagatttaaatatctatatgttgcatactggcatataattgaagctgtacattctgaggacctctttagcaaatgcacctgttttcttcccttccactcttgctaatgtatacagtgcactttccccatcccagtggttttaattccattcatattcagatgagtcccaaactgaaatcttcagtcctgatgtctctaaatactcatgtcctatgtccaaccaccattcagttttaaaactactccgttaagtttatgagcaaggaatttaattgggctgaaacggggcaacaaggaattagaaaatagagagaatcttctaatagttaaattttatctatcaggctgggcacagtggctcatgcctgtaatctcagcactgtgggaggccaaggcggggggatggctggaggccaggagttccagaccagcctggccaacatggcaaaaccccatctctactaaaaatacaaaaattagcagggcatggtggtgtgtgcctgtggtcccagctactcaggaggctgaaacaggagaatcacttgaacccaggagccagaggttgcggtaagccgagatcacaccactgcactccagcctgggcaacagagcgagaccccatctcaaaaacaaaaagaatgtatatatcaacttggcttgagacagacagatagacagatagatagatagatagacagacagacagacagacagacagacagatagatagatagagcaaggatgaaaggggtaagaacacacacatacttatgtatttattcaggtaaatattcatgtaaatatgtgtatttacaagctaccaggcatccccttacctctgacggcttcgtggtgcattttccttttcctgaacactccaagtcatttgcgtgactctcccccggcacacaggtgctgaccttcaccaccagagttaagcgcaaagccacaatagacttagtcacagaatcattcacaaaacctaaaagaaaatgaggcaaaaggaaattgtcaagtgtctcctctttaaaggcagtgtgttgaaagctttaccaacagcctttctacaagactatgaatttagtgtaggcagcactcaagtctgacaaaacaaaatgcagtgaggcaagggaataaagcacatggccaccatccactgagacctcaggactttagggcaggctggtcctcccaagcctcataagaaacacctaaggccaagcaaaatcagcaccaggcacttgagcaaccacctcagatcctttcgctttgctcccgcccttgccctctgggggctgctttgtctctcaatcccatccctgtgctggcgtcttagaattcagtttctgctttggaaccccagtcttctaccagggagcagcttacctgcattacccaagtcctcctcctcctggctactttggagtcacaaatgctggaaatcctcaaaggccccacccagttatcacctgccctagtctcggtccccttggagtaggcatgcagcatgggtacaaattctctgttgggtttattgatcattgataagatatgcatcttacttgatcaccaatctgactccacagtatcaagttaagccatacagttttagccatctaataaaatgggactaatcatagttgaatatggattgcagtatcattgacacaccgtatttgtcattgaatgatctttatgtcctagagcagctattcatacatagtaggtagcaataaatatggaataaattgatgaataaatatagcctctaactggaaaggagaaataaatattataagtatttttgcatcaaggattaaattattttcactaagtgagcatttttttctaatatgaacattcatttgtatctaatttttaattttaaaacaaaatatcgaaattaatgaatatgattttaaaaagtttcctcagctctgtcaagagtaaaagttaaaaagcctcatcattacaaagccacattcatagatagttttacaacaaaagatttgtaagaccaaggggactactaggagtcagtggggaaaagagagagaaaagaattgattctagggcaactgaaatgagttccattatcaggaaaaagagtaggtttggatccctcacacctcacactatacaaaagtaaatctagatggcttaaagagctaaatacgaattaaaacctttaaagtggcactattcacaatagcaaagacttggaaccaaaccaaatgtccatcaatgatagactggattaagaaaatgtgacacatatacaccgtggaataccatgcagccataaaaaaggatgagttcatgtcctttgcagggacatggatgaagctggaaaccatcattctcagcaaactatcacaagatcagaaaaccaaacaccacatgttctcacttataggtgagagttgaacaatgaggacacatggacacagggaggggaacatcacacactggggcctgtcaggggcgggggtgagtaggggagggacagcattaggagaaatacctaatgtaggtggtgggttgatgggtgcagcaaaccaccagggcatgtgtatacctatgtaaccaaactgcacgttctgcacatgtaacccacaacttaaagtataataaaaaatatataaaaaacaaacaaacaaaaaaacctttaaaacttcaagtggaaaatatagggggctatttcattgatctaaagataggggatttattaaacaagggcaaaataataaccataaagaacaatcaatttaactttacccgattttaaattatatgtacatagctaccataaaaaaagacagtagacaagacacaggcttgaaaatgaaatttataatgcataaaaccagcaaatgcttagctgccagaatatatggagaatttttttggcaaactgcttttttctcaacgttatttatacttatataaatattgaaatctatgaagcattaagaaacgctgttacgcatatgtatacatacagtaaaagtataccaagatgcatggaaagaaacacaccaaattcaggaaaaggatccggggaaataggggtagccagggagatggagcttctgaccacctatataatattttatttatgtattaataatacatagagcaaataccacaaaacacttattcgatcttgtgtacaaaaaaattatattcatttccatacttttattttatttttagacggagtctcactctgttgcccaggctggagtgcagtggttcaatctcagctcactgcaacctccgactccagggttcacatgatcctcttgcctcagcctgccaagtagctgagattacaggcacctgccatcacacctggataatttctgtattgaggcggggtgtcaccatgttggccagactggtcttaaactcctgacctcaagtgatctccccgtcttggcctcccaaagtgctgggactacaagcatgagccaccacatccagcctataatattttatttctttcttaataacataggccgggcatggtggctcatgcctgtaaccccaggattttgggaggcagaagcgcgtggatcatgaggtcaggagttcaagaccagcctggccaatatggtgaaacccccatctctactaaaaatacaaaaattagccaggcatgttggcatgcgcctgtaatcccaggtactcgagaggctgaggcagaagaatcgcttgaacccgggaggcagaggttgcagtgagccaagatcgtgccactgcactccagcctgggtgacagagtgagactctgtctcaaaataataataataatagagcaaattttgcaaaacattaaatcttgtgtacaatgaaatcttatactcatttccatagttctatgcttttttttcttttgagacaaagtctcactctgtggcccagactggactgcagcggcataatcttggttcactgcaacctctgcctcccaggttcaagcaatccttgtgccccagcctcccaagtacctgggattacatatacgcgccaccacacccagctaatttttgtggttttagtagagacgggatttcaccatgttggccaggctgttctcgaactcctggcctcaagtgatcctcccgcctcggcctcccaaagtgctgggattacaggcaggagccaccatgcccagccaattttatgcatattttaaatattgtgtaaccaagttttttatttcgattatcatagttcaggcatcacaacttcaaacaggctttaacaggttaggaaaatattagtatccagaaatctagaatacacagtcccaaaatgactttgtggtcaccttctctagacgtttcctcacaatttgttcttataagtacgttaagttggccgggcgcagtggctcatgcctgtaatctcagcacttttggaggccaaggcaggtggatcatgaggtcgggagatcgagaccatcctggtcaacatggagaaaccctgtctctaatgaaatacaaaaaaattagccaggcatggtggtgtgtgactgtagtcccagctactcgggaggctgaggcaggggaatcgcttgaaccgggaggcggaggttgcagtgagccgagattgcaccactgcgctccagtctggcgacagagcgagactctgtctcaaaaaataaataaataaataaataaataagtatattgcattaaaaagtaataattaactggatagaaacagagcccacgttggttcaccttgcctgcatggtacctagcatcacctcattaactgatggtcacttgagaacatgctgcttctattgacaacaaattagcaaaacttcccaaatattttcaatgttctcaatgttgaagtccttgcacactaaggtgttgcacactcctaaagcctgttttcacaggtttactcaaagtattgcttgacacaggttcacttttcatacttttaaagagaaggatattttgagaaatttggcttaaaaagtcaggacagacttcctacattgtttcatttttcatacttcttttaaaagttttcataaatgtaagacttctctcatggcctctcagctatttctgtttgtcttttctgtttgtttattatctttggggaaagatataaaaatgatatcacaaatatctacgatgactaataacccttctgaaaacagattgagcctctaaaaatttaataggaagtgcccacattaagtaagtatatataggccaggcacagtggctcacgcctgtaatctcagcactttgggaggcagaggcaggtggatcacctgaggtcaggatttcaagaccagcctggccaacacagtgaaaccccatccctactaaaaatttaaaaattagccaggcgtgatggtgagcacctgtaatcccagctacgtgggaggctgatgcaggagaatcacttgaacgcaggaggcagaggttgcagtgagccaaaatcgtgccactgcactccagcctgggcaacaagagtgaaaccccgtttaaaaaaaaacataaataaggaagggcgcagtggctcatgcctgtaatcccagcactttgggaggcagaggtgggcagatcacgaggtcaggagttcaagactagcctggccaacatagtgaaaccccatctctactaaaagtacaaaaaattaccgggcatggtggtgggtgcctgtaatcccagctactcgggaggctgaggcaggagaataacttgaacccgggaggcggaggttgcagtgaacggagattgcaccactgcactccagctgggtgacagagtgagactccatctcaaaaaataaataaataaataaataaataaaataataagtatgtatatacaaatatatgtagtgtgtgtgcattttatgaacatgtaatatagacgtgtgtggaatacatatacgtaatttaaagtacagtcatacaatgaagattactgagcagaatggatcttaaaaaattttgaaccaaacaaccacctttgagaaggctgtgaagagcctctaccttctagggtaaaagcaggactgtctatgggacaggcagtgcatgcttgagggaccactctggaagcccagtgaacctcgcagccatgattcagggaaatgcagacggtccttgaggcagtcctgaagtcctgaaggatggaattaacctacaggcaggtgtttcaggctgagatggtaaatgtttggcccaataatattaaatctgtagaaccatttgcttcctctgaaagaaatctggagggtgctgctatggtttggctgtgtccccacccaaatttcattgtgaattgttgttcccataagccccacgtgtggtgggagggatgcagtgggaggtagtttaatcgtggaaatggtcaccctcatgctgttctcctgatagtgagcgagttctcatgagatctgatggttttataaggggcttttccccctttttctcagcacttctacttgctgccaccatgcgaagaaggacatgtttgcttcccttccactatgtttgtaagtttcctgagggctcccaatccctgcggaactgtgagtcagttaaatctctttcctttacaaattacccagtcttgggtatgtctttgtagcggtgtgaaaactgactaatacaggtggggttctcttaaattgggatccataccatcatctgcctatactgttttgtgtggctttggagcttcaaaaagctaggcctggactatgggaggagaggagccagaccccatcttctcctttgtctggccagaggactataaaaagctattatcccgggcttgcgacaaggccacctggatgaaatcaattgctgtggccatgtgctttggaaatgcaccaatgcatgaagaaccaccagggttacatggcttctcagctcatccaggccatcgcatcctagaggtgagggagagtagatacccaccatctaccatgctaaatgggggccatcctagggcaaaaaataaagcaagctttgaattgaagagcaaaaggaatctgtacactctgaatgggattctgatgtgcaatgattcctggagatccctttagtgccaggggattggcacaaatctgatgaggtcctctagctctcagaactgcttccagtagctgtggtcaattgatctctgggttgtacttgtgtgtttcctgggcattcagtcaagtcttgttaaagctaagccagttccccacattctatgcagaattagtcagaattcctgactctttttcaaagtcaggaaatcagaggcactcatacatagagagaaggaagccctgcgaagatgtcatctcatgagtgttagacagaggaacacaggggagcagtggggacaagacaaaggacagggataagacccaaaatggaacaaaccaattggtgaagggaacccatcaaggaagaacccgagtaactgtgccgagtgagaaactgacatgtccggcctgcccatgttggctgccatgccagcgcaggtgggttcctaagtggcctaggtcccccaggcaaacaccttgtgaaaagccgcaggttcctccgtacttcaatctctattgtgtatgccagtttctcctgtgggccctgtactggttgagaaaatagaaaactgccaacgataacaactctattcataattgtctagggtttgtctcagacctgtgggatccctcaaatcccatcactgaggctatgggaaacatttaccctgattctccttgggacagaggaagacacggctatgactttagccagcccagaatgtaaatgaacaacgtacaatcaacacctcaattatctagaagaaacattcctgcattactcataaaaggtgctaagacaatgtgctggacattgttaagtaggaataataacccaagtaggctgaccatggaatttatcttcaaaactaagatgcctttcaaaatacaactttttataattatgcctggacacaggcataaagtgagactctcccaggcaatgggacaatatagtcaccctgcacttaatgtcccagggagcatctggagacagaatatctgcaaagtcctacatcaatgctaagaatgtttttaacaggcagaagatggattcaaaaaagtagtatgacgttcaattcagccaggcatggtggctcacacctgtagtcccagcactttgggatgctgagactgggggatcactcgagcttaggagttcaagaccagcctggacaacatagtgaaacctcgtccctacaaaaaattttacaatggccaggcatgatggctcacgcctataatcctagcactttgggagtccaaggtgggcagatcacttgagggcaggagtccgagaccagcctggccaacatgctgaaactccatctgtactaaaaatacaaaaatcagcagggcatcatggcatgtgcctgtaattccagctacttgggaggcagaggcaaaagaattgcttgaacccgggaggtgattgcagtgagctgagatcgtgccacttcattccagcctgggtgacggagtaaggctctgtctcaaaaaaataaataaataaataataaaaattagttgggcgtgatggcacacacacctgtagccccagctactcaggaggatcacttgagcacaggaaggggagactgcagtgagctttgattatgccactgcactccagcctgggtgacagagtaagaccctgaaaggaaaagagaagagaagagaagagaagagaagagaagagaagagaagagaagagaagagaagagaagagaagagaagagaagagagaaaagggaagggaagggaagggaagggaagggaagggaagggaagggaagggagaaaggaaggaaaaagagaaagggaaggaaggaaattcatgggcaacaaggtcatgataggagattaataaaagtcagagtgagtggagacattcctcaacttcaagtagggcattaggagacaaatatctcttggtgtctcagtaaagacaggcaccacaggtctgatgcagagtggtattttatgtccaaagagaactaattgctatcttcctaagatttcttactgaaaagtttatttaaattggctttgggaagtaaggaaattaacaatttaggcaaaagtgcctcttctgtggtgctttctattcttcctttatggccctgaaccatgtagacaccttacacctctcccagcagcctttacacatcttgctcaccccaactctgtaaacatttccacaatgccccctttgtctggaatactcctccttcttccagtcttacagccattgagatccagctcagagaccaccttattcataagcctctcctccatattctagcccactctgagctctaccatgtccatctgtgctcaggcgtaaaacatcatgtacctcttcctgatcattttgtatcttgggtggcttcttataccacctttactgaagcttccttgatggcaagggacaagtcttagagaagtggtgagtagggagtcaagatacaggtacattaatagccaaagcagcaaagacaattcccaaataggagttcttaaaatgtcttatcatccaatatgtccactttgaagaacagcaatcatttggatgtacaaattccagtttactaaaaaaaaaaaaattgcttaccaactggtgattacctttggtagagaaatggagcctgctagaatgttgggatgctaccagttcttattccaagtaacacttttacgcataaaataataaagataaaatcagacatcagttattataaaagtatttttcatacctttgcttcattctctagtttcacattaaactatttattaagatctatatcatctctgtctacttactaagcatttagaccacacaatgatctaaaatgttatagacaaggctttcttccaatgattagttttaaagtcctatttaactattatacttacccagcaataatgcaaatgaatgtgtagttaaaaatatacaaggcatagttttctagataatttgcttccatttccttgatgaacacttactgaactcgcgtccaccagtgagacaccactgtaaattctaaggttacaaagataagtcacgcttggtttctgccactccaaactttcaggcaaaagtagcagttcttaactagtgttgaaaccagtagcttcaaaagtttgcaggagctttttcaaagcctgtatatccaggctccaaaataagtgattcagaatctatagtcttggatgggtccctggcaggcatgtttttgtgaaaaatgctctaagtaattctgatgtgtgcttccagttaagaaccactggtctggtacaaaaactaatctaagtcacatgagtgatgcgttttattattaaagtaaaaatcaccttgaattaaaggcaaccttatgcacatctaaaattggaatattttactcatctatttttgaaatctaggtgatgagatgatatttagacaaaattgatattcccaagttcatcataagtctctgaagttcttagagacaactctgaaaatggtttctgtattagctttatttgcttattaagactgtattttggtcctaaaatctgttaatagatgattactgaaatcagtctttgcaacagtgtgtcacacattaccacgtaactcctaattattttaaccaatcccctaaagtggatcaataggacaagcatgttatttgcagcaatgtgctgttcactcaataagaacagtggctggaggctccttccaggtaaaagtgcaatttcagttagttgtttatatctccctttgatcacatctagggggaaatgcctgtatttcctcataatgaaaagcaatactgtccggtttaactttcatcaaactgcagctgggtcagaagcaaagtagccctcaggaaattccacatgccaagagcaggaactgtgccccttacaaaggggcagcaggaagaatctgaaatgaaatagaattcattcaaaagaaggaagttctttggggctttataaaagagtgatcatttgagagctgttgaaaagccagtgtgagttctttgacacagcactcaaactgatagacacttccaacatactttataagaaatgcagagcacatgctcactttttctcttccttaatggtaggaagtcaatgtacatagcatagttgctgctgcatagaggtctgtatagaaagacttgtcttcatactcagaattctaagatccacaggccaactgatcagagacgaaaaccagtaaagtagcagtgagaatgacagtctggatgcatttacgaagctgtttgagaatagggaatgggcttttgtcaacacctgcattcccatggtctttttaggctgaagaactggtgccacataggaggcaatgaaggtgccccaataaagcctgctgtgaattacaagcaagaaagagaaatagaaaggagagatttataaaagaaagaagaaaagacagaaaaagagagagtaaaagaggaagaaagactaagaagggtgatgggaaaagaaaaccaaaccataagatagatactgagggagacaaaagaaaaaaaaaaaggaaattaatacagagaaacaaagtcgaaatggaggaaagaaaatgaaggcttattttggaagacagtgtggcaattcctcgaagacctaaagacagaaataccatttgattcagcaatccattgctgggtatatagccaaagaaatatagattattctattataaagacacctacatgtgtacattcattgcagcactattcacaagagcaaagacatgaaatcagcctaaatgctcatcaatgataaactggataaagaaaatgtggtacatatgcaccatggaatactatgcagccataaaaaagaatgagatcatgtcctttgcagggacatggatggagctgggggccattatccttagcaaactaacacaagaacagaaagccaaacactgcatgttctcacttataagtgggagtgaaatgatgggaacacatggacatatagaggggaacaacacacactggcgccttttggagggtggagggtaggaggagagagaggatcaggaagaataactaatgagtacaaggcttcatacctgggtgataaaataatctgtacaatagacccccataacccaagtttatctatgcaacaaacatgcacttgtaccccagaacttcaaatataagttttaaaaaagagaaaataaaggctttctgtcaaaaatgtcaagggttcttatatcttttgttataaaaaggcattctatcatcatctgatttttataaccttatattcctcactgcaacccacaaaaaatgtaaaattcgagttatttcaaagttttcacaaataaacatttgcttaaatcataactgtatatattctaagtctgtgattccatttatgaggctgaaatacagaagcaccctaactgaacagatcatgagtccatgtaaggactgggctgcaggatggggtgggagggagagcagtgtaggatggagggagagctgagtccattcattcaacattcagcagatgtttgccgaggtcaaggtaggaggtagcatttaggttgagccctgaaggtgaaaatgagccagcaagaaaagctggggaggtcagtgtgtcagacagagctccagtcaccagtgtcttagctgaggcagagaagcaggaggggccagatcacaaccggtctcatgaaccttagtaaagatgtggattccttgccaagcaccatgggaatccattggagagttttaagcaggggaataacacacgactggtgcattctcaaagaccacaactcaaagaacaaacaagattttcatatagattggatgtgaggtatgagggaagggaagaaattacacatagatagtttaggcaactttgtggggggtgtggtggtaggcaagtgaatcaagatttccatcgttagtgtactaaatttgggatgctgatgagacccccaaagggagcaatcaagttggtggttggacgtagaatatgggtagttagaaacatcatggctgaagatttcagtttcggactcatctgaatacggatggtattaaaaccactgggacagggaaagtgtacttagggagagaatagagggtgacaaggcccagaaccaagctctacagcctgacagtcatgatataaacagtttgacatagatatcagaccatcatcatactagaaaaatcaactaaaacataaatatcttcattattttcccaaagcagagttataaggaaagataagatctctgtgacctgaagaacataaacagcttcgggaggtcagacctttggcaacgttagcatggaagagggagactttggtctaccagaaaaaaggaagtctcaaggactctacacagctcaactcaacatttagatgctggagaaaaaaaagacagaagaaagggaaggaaggagggaggaggaaaaatgacagtgctggacttgagaggctcacttctatttgctacacaactgggagatttccctaatgagtttaaaactgtaatgaaggggaactttctccaaagattatccagggatctgttaacacccttgagtaactggttatgatgacaaataaaagttgggtttccttctctctccttccatttccactctcctccttccccactctcctatcacacaaacaaatgcacttactctgctcttgcccacaactccaagctgtgctcattaggatggcaatgaaatgttctgccatcattatggcccttttaaaaccaagactttgccaagctcacctcccttggtgcaaatgcaaagctgaggacaaccaaaaggggctccagtcattatctctggaatggagtggtcaagcatcagtggaagcacaaaatgctgggcttcaggccattaactgtttgttttactgcttgtctcccttaatattaatactaaagagtcttaaatggactttgtagttaacacctcattgggattaatagcaaatgggatttgcttttctcacttcagccatttggctaaagaccattttctttcctgttaaagggaaagcataagtggaaaatagaaattctgaccataaatatttgagcagtacgtgttggaaacagactgtgccaagttttcctattaagacacaacaagtcatttggcacaaaccaataacctaaaaaaatggttcacagtccacaaagtcccatggctggcaccagataggcatgaaaggtttgcaatatcacagattccatccccagatgaagacccagggattttgcattaactcggaggtgggggaagacaaacacctgcaatcccgcatctcacccctcagaggcaggggtgaaacagcacacctgtgccaactctttcagaaggtgggataaggttagtgcaaagctaataagccggtcaggatccccctggatttgtgactcaatacttgtgggctgggaaacaaaactggagaaataaatcaactcttgacaatgtcgggccaggtgcaaaaattgctcgatgctgagagcaaacttgagccaggacccagtccagggtggcaatgattacacgaggcttactaacatacctcagctgtgtggactcagatgtccttccattacacgtaagcagaacgcagtccaaaccaggaggtaaaggggccgggggcattaaataagcatttaaaaagtgtcaccacacccatggactatcacaattatgcctccatcactgaagaatgtcacttgcctggtcacaccaactatcccaggatttcatgtagagtattctcaccttttgtaaaaaggcttttaaaaatttccaactaaaggttacttgtggtttgcttgcttgcttgtaaggcacgtttagatgcttaaaagagcaaattgctttttggaaaattcacccacacagaatctctcattttctctgggttcctaagtaaagtatggccaaaaaatgctttccaaattagaagacacaacagtacatcccagaaatggtccaaatatttttacctttgtcacttatgtaaaccatcaggtagattatacctagccaaatgactatgaaaattacatattaagtaatatcatttgctctagggaaaaaaattgtaaagatactgtgatgatatcctagcaaacatacaatcaacttgctatcacctgaagatagattggcttattctcaacaaaccttactgtcaaatatagcaatccttaacaactaccttcctactttataaacatctcaggtacactctctgtctattcatcctgcagagaaaactctaaaatttatttaatatcaaaatacaggcttaaagagtgaacaaaaaaaaattatattgagagtccttcctagactgacattctacacttttccaaaagaaatttctattcccatagtaaagtgttattagccaccgtgctacatttctgtttaatattttttcaagattcaccctaccacactcctctctccattaatattagactaagttatgtgtcctaagtcaaatcatttgtcctagttgagtatttgaactgcgggaataactgctaattgcccactgatatctattctcctctcatgcctataataatgggatgtggagtttttgctgtgaactgggccacgcagctaaagtatgtttctcctctgtgaccagtgagacaaagtacagaaataccgtattgtacatttacaaggaccgagcacgcgcccttcctattggctaaaataccaatgtgattgtgacagcttggacagccagtttgcatccagagatggaacctgtgtgttgagagcacacaagtgtactctatcggtcctagaccaactacctcttgatggtaacagtggggagaaattaacttgtaccttgttgaagccactgtatttgaggtctctctattgcaacagcttatcctgttccctaaacaatacaggcctgtaaataaatcacacaaaacccctcctgggccacatcccaccacctctgccacctggcccagaaagaatcaccattcagctactacttagagtcataaacacaaaatactaactccatcacatccccttctcggtcctcttcctttgtagtgacaaagctgagtagtcatcaaggtggctcgctttatattgaatagggaggagtgggaacatcaacttagcaaaagtgtctaatgtcattcctctgattaaatagggatatatgaaatatgcatataaacatgtatattctataattcgatttttaacactttatgtattctgtatagagtatgtttcacattacagaagtggtaattgcccataatatccattcattaattccaaatggatgcttcctgattagtggctttactatgaatatttaaatgagataccaggctcctgtgctgacacaagggtaatggaaagattacaccaggctctgccaccagatggcctgagttctcaccagctctgtgactttgagagagttagttatacccttcatgtcctggattccttctttctaaaataaaaataatagcactatctatttcctggggtggttgttatgattaaaggtcttaatatcagaatagtttttaggaaagtgcaagcattatgtaaggacactataaatcatcatcaacttcatcatcatccttatcccattaccatcatcatcaacttcatcatcatccttatcccatcaccatcatcatcaacatcatcatcccaccaccatcatcatcatcatcctcaccccatcaacatcatcatcaacatcatcaccccaccaccatcatcatcatcctcctcaccccatcaccaacatcatcaacatcatcctcctcaccccatcaccatcatcatcaacatcatcacaccatcaccatcatcatcctcctcctcatcccatcaccatcatcatcctcctcaccccatcaccatcatcatcaacatcatcacaccatcaccatcatcatcctcctcctcatcccatcaccatcatcatcctcctcaccccatcaccatcatcatcaacatcatcacaccatcaccatcatcatcctcctcctcatcccatcaccatcatcatcaacatcatcacaccatgaccatcatcatcatcctccttaccccatcaccatcatcatcatcctcaccccatcaccatcatcatcatcaccccatcgccatcatcatcatcatcctcaccccatcaccatcatcatcttcatcatcaccccatcgccattatcatcatcatcctcaccccatcatcatcatcaacatcatcatcccatcaccatcatcgtcatcaccccatcaccatcatcgtcatcatcctcaccccattgccatcatcattaacatcatcaccccatcaccatcatcatcatcaccccatcaccaacatcatcaacatcatcatcaccccatcaccatcatcatcaacattatcaccccatcaccgtcatcatcatcctcctcaccccatcaccatcatcatcatcaccccatcaccatcatcatcatcctcctcaccccatctccatcatcatcaacatcatcaccccatcaccatcaacatcatcaccccatcaccatcatcatcatcaccccaccaccgtcatcatcatcctcctcaccccttcaccatcatcgtcatcaccccatcaccatcatcatcatcctccttaccccatcaccattatcatcatcctcaccccatcaccatcatcatcctcatcccatcaccatcatcatcatcatcatcctcaccccatcaccatcatcatcatcctcaccccatcaccatcatcatcaacaccatcaccccatcaccatcatcatcatcctcaccccatcaccatcatcatcaacatcatcaccccatcaccatcatcatcatcctcaccccatcaccatcatcatcaacatcatcaccccatcaacatcatcatcagcatcatcaccccaccactatcatcatcatcctcctcacctcatctccatcatcaacatcatgacagcatcaccatcatcatcatcctcctcaccccatcaccatcatcatcctcctcaccccatcaccatcatcatcttcctcaccccatcaccatcatcatcatcatcctcaccccatcaccatcatcatcatcatcaccccatcaccatcatcatcaacatcatcacaccatcaccatcatcatcatcatcctcatcccatcaccatcatcatcctcctcaccccatcgccatcatcatcatcacaccatcaccatcatcatcatcctccttaccccatcaccatcatcatcatcatcctcaccccattaccatcatcatcaacatcatcaccccatcaccatcatcatcatcatcctcaccacatcaccatcatcatcctcatcctcaccccatcaccaccatcatcatcaccccgtcaccatcatcatcatcatcctcaccccatcaccatcatcatcaacatcatcaccccatcaccatcatcatcatcatcatcaccagcaacataagcaaccaacatgtatttaaaatggagtcctggcttattgagtttggtggctgtaatgaatgaccatagactgatggctttaaaacaaaggaaatttattgctcacagatctagaggctgggaagtacaagtagattgagttccactgagggcccgttcctggctcacagatggtcatcttctcactgtatcctcacatagcaggagaagtgaggaagctctctggggtctctttcataaggacactaatcctattaatgagggctctgcccctgtgacctcatcacctctcaaaagccccagctgcaaacactcctcatattcggtgttaggatttcaacatatgaatttggggaggaaataaacactcaatgtacggcaggtcctaagtggaacttagaattgttagaagtctgaggaagaggctctggaaaagtttgctccctgagaaaacagcaatgccaggatgaaagcatggaggtcattcagagagtcctctaagcccttctcaattcaaatctatgaaatggaatttgtttaaatgattgctactctttaaaaattattgctagaatttttaaataatgtccaaataaaagcataccatacattcaaatgcaagtaaatgatttttactatctgcctttttgaataattcatgccccgtctctccattaaaaagccttggctctaggcattacttaaagttgtaaaaaatatgtgaataaacaagatatggctaccattcataggatttgaaagactttttttaaaaagtataaccagaaactaatacaagacagattggttggcataatggtataaaaatattcaaattataaaatctttttttgaagcaaaatttacaagtagagctgtcaaatctcccaatgtgcctatttctcacattaagtaatctccaattagcaaaaatattttcttattgcctgtaagaaccacatcataataggacacctttttaaaatgccagtttctgaatacccattggtagaacatgaaaattaatttgcactttcctttgaaatttttttggcttgcacagaatatacaattaaaattctttatttaatctctttttcaatgtctatttgatcaccttttcataatcagttcaaattgtatcactttatctcccactagtacagtttcaacttatcaaatactagtaaatcagttttaaattactgtagcactcatatccaatcacccaccacatctggtcattaatactcaatgaatgcctcctgattaatggcattactatgaatgtcgaaataataataacttctctgtgttgatgtgaggggcaatgggagattctaaacatagctaattgggctgcagatgacttcataaacgttagggagtccgggaatcaggtcttcagatgagctaacgtgaaaagctgttgattgacatgtttacctgcctggctattgcaagcattgtgaacatgatctttcaattgtctttgttctaatacagctctttgctccacactgatttaaaatcccaagttgaagtggtcaaggtcatatgaaagaaattacctgaattttcaagtgttcaatgagatttctcatttgggttgcatttgcttcttaaattatgcataacactttatttttcagtgcatgtatttattgcactaaaaatagaactaaccaatgtattgcaatgaagccccagtggtgcaccatgatttgagagaagaaaaactgtagatgtatgggaaggttgactctgactcagcctgggttatttctagttcatattagcatttgcatcacgggtgctgtcataccctcagcctcaggcctcaagaagctctcaggcagtcttccttatttttccacttgctagagatccagaaaggtcttcggcacccagcctctctcccatcaggctcacaaatacctagaatctgcagtgattcataattgcctaaagagtttatttaatcaattgtaacttaggctccaagacacctgtgggtttacctgctcccccagatgtctgttggccaggtatggaagctattgacttagggatgacttgtttttctgcaaaattaagatgcatatattttcactgggatcctacaccaggataaatgtgtttttcaaccttcccttcaatgcctcctcattgtcactaggatcccatcatggcctccacagcccaacatgtctgacccaagctacctcttcaccacatctccaccaccttcctccttactctccaagctccagcctcatgctttgttgcagttcctctaatattatgcactccctccaacaacagggcttttgcacaagcagttccaaccttctgcctacaaggggttttccccattgcctagttaatatctcagcctaatagtccttctccaaggtagtaaaccctcctccacaaggttgttatatttttattatcaactacagtcatagcacagtgtgctgatcacagttgtaattttctatttattctgcaccctactaaaacctatgattcatgagagcagagacttttgtctgatttgttcattgctctatcaccagctccaagcaggtgcctagtgcacagtaggcactcagaaaacattttgaaagggaaggaggaatatgtgaacacacaaatacaagagggtaagtgagctgactatggtgatggcaaatatgggcatacaagagagacaaagtggcagagagaaacaaggaacccagaaaagaaagctggtagtgatgagaaccaactggctaacggcttcagtgcaggcagtcaccaaaaacagccctgaccatggagcaaagtaacttcaaccttaaccaggattacatatcttgagcacagagccccaagccaatttaggtagaaggcctcattctaaaccacgccttgctgcagaccatgaacaatgccaccgatcctgctttgagggtttaccaagaaataatgaattactgattgtccctgttcccaatcagctctctcctgaaattaaattctgtaattcaatgtgactatcatctcagtaggctgaaaagagtctcccttatctgtccagaacagattttatttatgcttcagtctctacaaaagtcttgtaccgctatctgatcatcaattctttctgtaatagtcaatgcagcaaattaaaaattcaatccctctccctcacagtctttactgtccaaaatcccaatctgagtgtgaacagactgccttcactattagaatatctaacacggatcacagcataaaagacggatgtctgaaaacaaaactaaacaaaaatgaacttttgttcctattccaaagaaagaaaaaatcatcaagcatatcaagtagatctcatgcttttctagtttccatttcttttttggtttttaagccgtgttccaagaggccccctgctttcattttatttattttttattgttttaatttttttagagatgatgtctcactatgttgcctaagctggacttgaactcctgggcttaagcaatcttcccacatcaacctcctcagtagctggcactactggtgcgtgccattgtgcccagcttctagtttccatttctaatgtcatttttaggcccctgccttggtaagggctgcctgcagcataggagagagacctgactccgcagtaggaaatgcaggctttggattcaggcttatttgtaggagtcaatcacactttaatattctaaaggaaatgatttataaaatacaagtatcgcactaatagaaaataatttttattttgcaattgctttgtagtcatggatattaactatttatgccatacactcattattataattatagcattatttctaattctaaatgtttctttgcaaaccattgtttcttttacgcatccctactgacctacacactcacttttgaatgctccaagctatacgtttccttttttttaaaattttattatctgtagagatgaggtctctctatgttgcccaggctggccttaaactcctacgctcaggcaatcctcccacttcaacctcccaaagtgcttggattacaggcatgagccaccacacctggccctaagccaacagatcattcttttataatgatctattatacctaccaaatcttgtaaatgacctatgtgcatatacatgtctgtgcatctctgtatatgtgtgcttatggatggatgtgtatctatgtgtgtgcatatacacgaatgtgcatctctgtatgcatgtgcctatggatggatgcgtatctatgtctgtgtatatacatgtctgtgcatctctgtatgtgtgtgcctatggatggatgcgtatctatgtgtgtgcatatacatgaatgtgcatctgtggttgtgtatacagtcatccctcagtattcacaggatactcgttccaggaacccccacagataccaaaatctgaagatgttctagtcccttacataggctgagcgcagttgctcaagcctgtaatcccaccactttgggaggcaaggtgggcggatcacttgaggtcaggagtttgagactatcccggccaacatggtgaaacctagactctactaaaaatacaaaagttaacagggcatgatggctcacgcctgtagtcccagctactcaggaagctgaggcaggagaatcacttgaacctgggaggcagaggttgcagtgagccaagatcgagccactgcaatccagcctagatgacagaataagactccatctcaaaaaaattaaaaaaaaaaattttttaagttctctatataagatggagtagtatttggatataacctatgcacatctgcacatcttctgatatactttaaatcatctctagattatttataatacctaatagaaggtcaatgctatgtaaattattattacactgtattagttttttatttgtattatttttgttacattattattgtttattttttatttttttcaaatatttttgatccatggttggttgaattggcagatgtggaatccacagattcagagggctcactgcacttacagaagtgctcccatggatgtgtgcctgtatgtataatggatggatgggtgtgagcacgtgcatcaatgcatctccacaatgtattctacgaaatatgatcagatgcacaaaatctaaaacaagtcgaaaccaaacgtttcagagggccataattttcttccaggagatctgtgtgattccagctggctgtaacacttactgaaaccagatccacccctggactttcaactgcatgagattctcgcttatcacctttgctagctggttttttggttgtttcctgtaagcaagttggagttgggtttccacacttacagaataattcctcctgactatttaccaggaatgtaatatttaccgaatttattcagtaaacatttattgcatacctactatgaaccaggtactgaaataagtcattttgatgcaacagtaagcaaaacacacaaagttccctgcattcattgtgcctacattccagcagaagagacaggtaataaataggtgttatagtctatattagaaagtgggccaggtgtggtggcttacgcctgtaatctcagcactttgggaggtcaaggctggcaaatcacctgaggtcaggagaccagcctgaccaacatggtgaaaccccgtctctactaaaaatatgaaaattagtcaggcatggtgttgggcgcctataatcccagctacgtgggaggctgaggcaggagaatcctttgaacctgggaggcagaggttgcagtgagctgagtttgcgccattacactccagcttgggcaagagcaaaactccatctcaaaaaaaaaaaaaatcaagagtgatacattctatgggggaaaagagagcagggcacaggcatgtggagtatgaggggcacgagaggagaagcggggttgcagttgtataagagtggaggttagactgagaaggtgatgagtaaacaaagaggcaaagcaggtgggggagggagtccagatgagggcgtggccagtgcaaaagccaaggcacagggatgcctgggaagttctggaagtggtaggagcacgggggagaagaggggaagccaggatcagagaattaaggggcagacatggaagattttgtctgtgtttaagtcttggcttctgctctgagggaaatgagagccattgcaggattgtgagcagagatgagacataaaatggtcctccccaaatatggtcccagttgtaggggcctggggtgaagcggggaggccagtgaggcagcttctgcaataacctaggtaagagaggctgggggttgggccatgctagtagccgtgaaggtggagaaatgaggtcagatgtgagatctgttgaagtttgagcccgagtgtccttctgataaatagatgtgggaaagagtaaagttaaggatgatgcccaggcctgggcccgatgtgcaggaaggaggaagctgcctcatcagaagagggaagccacactcagagtttaccgccattgaaatctacttgctgctaaaatctcaaaccttgaaattccctctaggatttgcttttcccctcccactccctctcaccatctgtctccagctccacctctcccttactcctctttggctggctcactttctcctcccatgtgctacacatagctcaacactcgcgtttacccagattccttctctctgctccccacgccttctctctctgtgtgttccttcctccccagcagcttccattctaacctccctacggaagactcccacctctgcactcaacttctacccctggcctccccgtgaattggggttctgcacttttaactgcccactgaatgccaaaaacacatccaaatgcaatgcagcagttcttttcagaaaagaacctttctttctaacttggtatattcccattgatgagacctccccccctgaaaccgtggtgtctgtcactcttgattctgccaccttgtttctcagtacttccctcacacacaagcacgtctagagttgactttgacagtggtcctgacacccataggcctgcttttgctcccacttccacccactggattctggctcttcattttaccaaaagctactccataacactccccatgttatatctccaccacagccaccaccagcaccccctcctctacttaaaaccctgcatcaccactgcctacaagctaaatacagatctcaacacagcacacacacccctttgcagtctggctcttacatcctatccctttgttaattttccataactttccactaccctagccaaattgtcctattatttctaaacagagcattctccctcccgtgttgttactcacaccgttcccctttaccccaaatgcctttccctctcatacctgctcttcagttcaaggccaagctcaagatacacctcgagttctaaagccttcacttgccccttggtgactactctcaacttgcgatgtgaattcatgtagaccctaaatggactgtacagttcatctaatattgaatagacactccttgatcttccgattaatctcttgatgtgccacatcatctcaaaatcattaacgtctaactagagtaacaattacatgttacatgaatgttagcaattgccccttacttcagcttgaaagggagaaaggccagcttgctgggtcatctcccagtcaaattctttgcagtggagaatccaagtaaggaaggaaatagaagaactaaaaacaaacagagaggctacagtgacatataaagcactgtgctaaaggaacaggacaagaagagaaaggaaaggaaagcctcaaaggctgagacattgggaagcagaccttgatagtgggagagagaatttaagaaagcaggtgccaaacacatggagactattaagagaagagaaaggacaagataagatggatgcagttttttgctgcacgacaggaatgcattttttccactcttattcataatccctcaaaaagatgagtaaacatatacagtgttttaatttttggttacttgaatgtgactttatgaacaagactaggacatgagacaacaagatttatctgagttacataatgagtataacttgtttgtttggaggctaaaatctcttaaagtcagggattgggacctggtatttctttgtattcccagtcctgggaacagtgtcctacatgtagtcattaatccataaatgttagttgatgataaacaaggatgcagataaatgagcagatgacgtgatccctgttttttatcatggaatgttccagaggctgtcatctgttattagcgatgcagccaaacagcatttgtcatgtatttatttaaggagattatccatttgtctaccaagcaaatataacttttgtaggtcaaactcacaattacggcattaaaacaggacaaccatgtgaggattgcttgtgaagaatgcacgtgaataccaaaaatatcatggcattcaaaacccaaatgtcagagagagcatttgagatgagaaagcaagacagcattttcaaaatgcaatcccaattatttatattcttcaaaaactagacaattttcttctgctgacatgttcgactctggtccattttcttgatgctctgagttttatacccaagacctttgtgagaaacaattaaaactaccatgatttcatgtcaaaagtaaatgatcatctctaacacctctctgatgggttttcaaaacatttgcattttctgaaaaatccttccttccattctcatgcactcattctgacctcgtaaaaagtctatgataaaaggtacttaaatatctaccttcaggagattgtagtggaaaagcaaaaggatcacagagaaggaaatggaaatgaaatcaggaattgtgatcttctggaatatgactgttctctgcataacattaaatgagaggaatgtcactagaacttggcaatgtgatagcgtccatgaaagaccatgaaagcagcaaccccctgtttatttcctaaccttcctggccattccacattgactgtgatgtgcaaatgtagtaatacaatgaaaccactacatttaccattactccaatgtataaatgcaatattgtgatgaaaccacttaaatatcttctgcttaaggagatttgcactgtcctttttctgaaaactgttaatgatcactgttttttccttgaggagatccctaaaagtctcagattcttaaggacgttgctaaaaagtacacgtaaatttcaagttgaatgccacctgaaggttgatggaagtggagcaacacagaattctgaagataaactggctgtcctgagcgaaaactggaagaaagttaaagacaactggataatgtgtatcaaatgtgccattaaaatatacaaaccctttgatccagtaaattccatatctgggaatttaacccaaataaatcatccgagaagacacaaagatgtggttataccaacatttgaaattctgcccaaagaagcagaaaaaaggaagaaagaaaggaaggaacgaattgtgtaacgatagcctattgataataaattatagtacattgattcaatggaaccctataccaccacaaagaaaactgttagagatttatatttattaacataaaagattgtcagtgaaacattaaatgaaaaaagcaaataaccagacagtaaatgaatgtattcttctttccaaaaacagtgtatgtctatatacatgcactgtcatgcaaagaaaaggaaatatcacaaaatgtaaacactggttgtcagtagaggggcgggttataggagaagaaaccagtttttcttatctttcttgtatatattaatttcataataaatagacaatagagtctttttcattcttcaaaagaaaataaattaccttgttgagagaaacgcatacttctggaagtttgcatattttgtcctgagaaattctctctctttcctgctctccttctctttcttcctctctccaaagaaagagaagagatgctacaaaggagcagaaatttggctataaaaaaaggcaatttaaaaaattactttcttagttgaaatttgcactgacagaagctaagaaaagcttttgaccgtaagctggcaaagccccgagaaagtttgtctctaagttaaaagaaaaagggaaagttttaaagaaatatttaatcgaattccacagacaagatttcggttaaaattcattattattaagggataaagtatttctttctagaattaagaagaaatgctttaaaatataaaaataacttattatgtaattttcataaattaacctgtaaataaaatgcactagctttattttttttaaatagagtgttgatggggagagagagaaaatgaggcagaatgaggaaggagagaaaaggagaatttatggctttgaagtcatatcttcagtttgcttctcaaaaccaggcaatcccccacgtaatggatcaggcccaaattgtagaatatctgcaactgctctgttctattaaattttgaaactgatgctcaaaaactgcagaagcatcttagtaactcatgacagtgcccttccacatggactcagactggctttaccctactgagggttgtcctttacttcttgataaattcctagaatttgcataacttttagtgctcaaagaaattggctgagagcattgtgaaagagtctcctgaggagctaccaggtccattggggggaccagggatcttcctttctaaccaacctgatttcagggacagtcttggtaggaagagaaacatctcatccatctttgatcacctgctccaacaccaccgcagcctgggaagcccatcccagcagggccaatggaccttagactgccagctccagggacagacgtatccagaatggaatgctcggggtatcaccacaatcaacaggtaccaataagtaaatcatgctgaccatgacaatatttaggattagggcatatagaaatagggcatggagttcaggccaactaatttttttaaatcctaaaatccattaagtaatagaagatcaaaaagaataatcttgattgctgacaatattaatatgaggtctcaatttaagtaaaactcaaatttcatagaaatctttgaactaagcaaatgtgagctataagaatttgatgtaaattatgccattcagggaagctttatatttcctctgcttttgttcttttcaaactattgcattggaacattccaatggttctccccgctacactccctacccccaccattgcagtgagttcagcagaacttactcaattgtggttttaaaatgaccatgaaaaggtgaaatatttgcattttttttaaatcttaagttttcagtgaaagatgttaatgattctatagatgatatcttttccaaactttcttcaactgttttacccctggcccccagagcagggtatcttagaggacaaaatgtaacattcccaaaagaatgatgaaagtttctctctctttttttttttttttttttggcatttgatactctaaaatacttttaatataataaaaagggggaatgaggatttaaatgtcacagaggtagattgtgaaaacctacaaataattcttaaggttgacattttgcagctgggaattttcttcacatggcattaggaaatggcagaataacttttacataggaacaaaatttaaccagtcaagtgacgaacatgtggtcatcatggttgcaaggagctatggcatggtccaatctctctagaagtttacagtttaattaaacatataaaatcatcatgccagaaaaggtttgtgggggggaacggagaacattctgatgctactttgtgtgatactggctgtcaatgtgattagcagaaagtaatgtgagacacatgactggtaaagcaaagattttataaaagaaggggaagggaatcagagtggagagaaatgacgccagctacacggagaagaaccagtgggaaacctgcagagctgagttaggtgaacagctaggaaggctgcccagcaagccaaaccacagggttcagaggcaggaaagacacagccccaatctgagctggccttggtatctaagaagagggcatggtccaaggcagaactaatgggactatcatgaaatcagggtccagaccacggagaaggggacctaccacagatgaagcagctggtcagggtaagggtcgtgaagctgggactgtgggcagtgggactttatgcctaaggaaatcaggttttgctccaggaagctggaggaagcttagtgtctatgcatttagaggagaatattccagttcaatgtacaaccaaggggccagggaccccaggaaaattgatttgaatggtaagatgtacatgggaactccctccaccaataaaagctaataaagtactgcaggcttgtttgagaatggatcagagactagaggcttcatgtaactgggtaggtctggagaatgcagggcctgacattatgagaatgaaaggggcagttatagaaaatgggcagttctagaagtgtggataggctgggcgcagtggctcatgcctgtaattccagcactttgggaggctgaggcaggaggaatatttgaggtcaggacgccatctctactaaagatacaaaattagctgggcgtggtggtgggagcctgtaaccccagctactcaggaggctgaggcaggagaatcacttgagcccgggaggcagaggctgcagtgagcagagatcgtgccattgcactccagcatgggcaacaaagagagactctgtctcaaaaaaaaaacaaagaagtgtggataaagcagatatgccctgcctgagttttctgatccaaaggagaatattccaggaagaataacttctttgaatattccagggtgccagtgtgctagtaagaatttacattcagtaaagatggattacaaaagatgagttaacacattttaaagaatcaacccagcttcactgcatcagagctgggaaacaaagatccttaaaaatatataatcaataaagatattaccaagttaaagaatattccaaaaatttaagtgtcctgccaactatcttatttctttatatcttaacttactctataagatctgagaggctcatagaaatacataagattaaagagtgaaattcaacttaagtgaatattagaggcagggaaaatatcacctaaagtcagagtgtacagaaaagagacacgcagaccctcagctcttcacagtaccaagaggtgaatttccagtttggttctgcatctccccgtgggcttttctgacaagagaaaaacgtatgctaagcatctttcacttcctatgggagtcctttcttctggcatgtcctggtcggtcgctcgccctgtctcctcccatctcgtccctatcaccctgagtcttccacagggagccaggtcccagctgctccacatggccaggaagcagtcacaggagctggtagtcagacagtaacaaaatggaacaggagggcagctagggagtggcaggatctggcctttttatctctggattccttttaattcctgagcaggaaacaaaaggattcgtcaagaaatggctgagacaaaggaatacacatctagagacttgatgcctgaatagctaaaatagacacacacagaaaattaacactggccactatgcctggcttcaggaagccctccagccaagctgagatgttagcaacatcccccacccctacttttctactggaacttttccccctttcaatactgccagcagccctcaccccagctaatacagccccagtggtgccccctgccttcaggaagactttctccaaaatcactctctctgtcaaatttacagaatgaggtaccccagctccagttgcttttgaaactttcattttaaaggacaaggcttataggaatagtttacccagaagggagggaagcagagttcaagaataagaaaatagagctttactaaggaattccaaaggactacccagaaattcacatcgaagactagaagatccctctttttcgtttgaaagataaacagagaactcaagaaatatcatccacatcttgagcacctacctttatataaatgtgttcatatccaagatgagaggcagctgggtggaggcaggtgacatattcaaaggttctgttacatgcttgttgaaatatctctatttccagttgtgatggtcactagtccatttctagcactattatgaaatgatcttaaatagcacagactactgtgccatcaaaatgccacacacacactgccctttgtatgtccaaggagaatactggcctgccttccctccctctggcagagttagctgcttcttcatctgaatcccatggccacttatatacaaccctgtcttgggcacttgtctaagcttttgttgccccattcactcagagaccacacctaaatcatctttgcacatccagactaccacagtgcttggaaaatgagaggcatgcaatgcatcttttctaaactaatacggaactgagtatttcccacagccctgctacctacaaatataaataaataatttaatttcctcaatatggagacttaggaagcaggtacatctgtcaaaggaaatatcactgggtgagcggagaatgctgaaaaacatacatcctcccacaggtagctttaagcggtgctctacaatttttagggactcagatatctttgagaatccaatgaggttttgactctctcctgagaaggatgcatggatacacaaaagtgcattttcaggagattcatgagatccatgaagtggatctttgacccctatgactacctcaaaaccaagggcccactgagcctaaattaggaacttttgcctaagagtaatggtattagttggctgggtattgagaattcctttttttttttttctaaacatagtataaactgttaggctacaaaacactgttatctccagggaagcatcactatgccagtcaagatagaagcttggtaagaagactttatggtaagtccataaagaataaaatcctggggactgtgaagggccagagcaccaggacagtcttactactttagtaaaagaaaagtcttattcctccttgtacctcctaaagtacctagttattcatgtcttatttctcaagagaaaaaacaaacaaagtgaatacactaccgtaggaaccattttcaaaacaagaatcttttcaggctagaaatgtagaatcaaggcaactgaaagcactctctctagagctcccaggaggctcagaggagtcatgggctgactgggaaaccttctaatccagttaagacgtcaattagaaagacctgcaaattgttgatttccagggttccatggttaatttgatggctataatcctgaagaaatgacctcagctccaacaaggacattcttatcagccatgggttgtaccattcacccctttgaagttacagtggacctaaagttatgagagaagcattttaggaggtcatacatgaaataccaatggtctggattaaacagtaacatgcacttatgttataagttagacattttaataaatgtactgaaactgtaagaaaggatggtacaaatgtgtacctaataaaagggattgaaaaaatagtaggctatgggcaggagaacagaatgaaggaagagaaaaaggcaagtataagaagctagaaagaccactataaaggaacaaatggagagaggaatagactggatcaaaatgaaaataacttcaaagaagagagaagggataaaatttcagatggaggtaacaaaacgaaccataagaaagaaaagtgtgcaggaaaaaatcggggtttctctgaggcaggcagggagtgtggataaagcagtcagtccctgcctgagttctctgatccaaaggagaatattccagggagaataactgttagaatattccagggtacctggaatttagcagttaaaggagatctgagaatgcatgctgaatagaattttaactggccattttctacataaaccactccagaagagggggatttcagtgaggccttagaaatgagctaagtttgggggtctgaggctcagacagaatgggggtgggagagggttgcacccccagtggggatggggccggcagtgagctgcagggtagaagtccactgtgcagaacagaggagaactatgcctgaggacaggaggcaacatggggaaaatccttaaaagcagcacaaaggggctttcaccaaaggaaatggtgaccttcagcagcttcctaacacagaagccacaccccagagatctggtttggctctcaccctgagatcggccatcacatctaagcaacagcaagtttaaagatacatatatatcccatacttaagacaggcaagccataactgtttcatggaaatgtgactggagcaatgaatttgactctttgaaaatacgaaacatccagcaaatgaatcattcaggacactaatgagcacctccgatgctccccgagaagcgggcaatgttaaacaaaaggctaatttagatatttaccccaatgcgtggcatcaggcaaataacatatttggaagtaacatatttagggtaaacaggacagataagtaaagagaggccagaagagtcgaaatttggtggcaacacagcaggaaagaagttgaggcacagagggaagaacaacacacttggtaaaaagttctatcaactctttctttctgcaaaatactataaatattaacaaggcagtggtcatgaaggaaaaccataaagaaatgaactgtagtaacatggaaataagccaaatgtaagtatattctcttaatccggaatgtagaacattaggctctcggcaataaacttttaaagagtatttgtgtaaatctggttacagcaaccaagtttgtctcccaaagacacagaaggaactcctctgctctgttgcatagaaacaggaaaatacctttggtcatcagttatgtttatttttatttatttatttattatccagctgaatttaagatttgtggtccttagttatgtatgtgcaaactattgagagtgaatgggaagcaggagacagtcaattcctgaaagtgcctcagcttctctctaaaaaacaagcaggagggacagaaacacagcgacataattctgaaactttactcttcctttaccgtggaagttttcttccgcccaccctaacattggtttgtttgttaaatgaacgccactgtactcttaaaaatagtctgagctaaaacgtatttgtgtctggagagtccagattgtaaaagtaaattgctttaataagctcctttttaaaaacaaaacaaaaagagcgttaagcacatgttaacgtagtgagcatcaggcttccgcaaagattgcaaaaggtacatcttgtttctgaaggatgaaaagattttgtaagagaagcagctggcggtgtggaggtggagttgatttatcatggttaggaacctggccatccctccccaggaagagctcgggacaggactgctggctacctttgaagagaataacaccaaaagatcgtgatctccttacaaagccacataaaagacccagaaagccctaactagaaaatttagaaagatatcaaattttcaaaatgaaaaaaaaatggtttatcaaaataaaggatgttactcaaaatcattgctttctcctcataatcaaaagtataatttggggaaaagaattccttaacatagttattaatatatcaaagttcttttttgagttggagtctcactctgctgcccaggctagagtgcagtggcgtgatcttggctcactgcaagctccgcctcccgggttcacaccattctcctgcctcagcctccctagtagctgggactacaagtgcccatcaccacgcccggctaatttcttgtatttttagtagagacggggtttcaccatgttggtcaggctggtctcaatctcctgaccgcgtgatccacccgcctcagcctcccaaagtgctcggattacgggcacgagccaccgcgcctgacctaatatatcaaagttttaaagattattcccataaggaataatacgtttcatccaaagataattttttccacaaaatttttgattagcaaaatgagctcaaaatatgtacgagttcacaagatttcttctatcccaaaagaataaatttacattaatactggaaaatccatctcaattaatccccatcctcaatctcaatgtcagtctaaggtcatagttatgttaccatcaaaagtagtataaaatatgaacttatacagatgctcctcaacttgcagtgaggtcatatcccaataaacctagtgtaaactgaaaatactgtaagtcaaaaatgcatgtaatgcacctgacctagcaaacctcatagcttagcctcgcctaatttaaacgtgctcaaaacacttacattgaccagcagatgggcaaaattatctaacacaaagcctgttttataataaagtgttgaatatcttatacaacttattgaatactgtattgaaagtaaaaaacagaatagctgtacgggtgcttgaaatacagcttatactgaatgttaatagctttcaaactgttgtaaagtcaaaagtcattaagtggaaccagcgtaggtcagagactgtctgaatgctaaataagtatcttctggtaacgttaaggacattttaaagagtagtgatactttatatgttttcttgaaatattagctccatgtgataccaaacagaaaaacttaaattcaatataaaataaaactatcaaaatacagaaactacatccttttagataaatctttacagcagatatggaagtaaataacagttacttcaaatgtattggggagtgaaattcagatttgattcttgacaagtctttatcacacaatttctgattatctgtcattcatcctgatagtcaaacaccagtctgaagtgaaatgcactcgtctctttgtcaagctatgttcattcccgaaataaatttctctttaccttcttttcacccagtaaaattcctgctcccccagctggacttccaaagattaaaaaaagaacttctcatcagaagagggtcagtcaaacataaagtgcaatataaattatagagacctgagcattttcttacatccctttatcttcattatgatatttgcatcatattttggagggtgagtctaaatgcatattttccatttagcaaaatatttagtgtacaccagaaaaaaatagagaaaatgccctaggataatccttaacatttgtcaattatccttgtacattcgttatctaatttaagctgacaaacaaccctgagagacaggtgctgctaggaggatgcctaccccatcctccaggtgaggatggttgcaatatatagtcagacaggagaaggaattaacagcaggatgcaagaagttgcctgggtgcattggactgggatgggtagattctaaacttgagctcaggcctttgaattgagctgcaaggtggaacattatgtcagcacacgaaggcaccagagttccaagttccaaccccaaaggtactatatgctggatgagaaacaaagacaactgaaaggacacagaatgctaaactaggggaaaggtgatcctctgggaactgtccaagtgtccaagcaagaggcagtgggtcggggagggaatactgagggtctctctttctggcggccatttctacgccaaagcggaggaattagaaaacaactaattagcctgtaatcccagcattttgggaggccgaggcgggtggatcacgaggtcaggagatcaagaccatcctggccaacatggtgaaaccccgtctctactaaaatacaaaacaaaaaattagctgagcgtgatggcacatgcctgtagtcccagctacttgggaggctgaggcaggggaattgcttgaacctgggaggccaaggttgcagtgagctgagatcgtcccaaaaaaaaaaaaaaaaaagaagaagaaaaagaaaagaaaacagttaattggacacgtggtagtttgagaaggttaaactacagaagcaagttcaagagagagtaaaaagttagaagtgactgatgcaggaggggtggttatggaggagaggggccccaaagagagctataatcccaccagttacttctgagttggggaccctgcagtggcaaatcactgtgaggtgctgtgtttgaacgccctaagtcaggccaaaatcaactgggaacaaaggttatcctgagagaccaacatccaacacctcaagttttccacaatttctggaaaaagaagcagatgaaagattccaaaggaaaactgatggccagagcattcagtaccaaagatcacacacctgtgatgccttcgccagggctggaacacagtcgctggattccagagcccatgcctttccactttgagccacactagaaatattatgttagggccaggctcagtggctcatgcctataatcccaacacttcgggaggctgaggcaggcagatcacctgaggtcaggatttcaagaccaacctggccagggtggtgaaaccccatctttactaaaaatgcaaaatgagccgagcatgatggtgggtgcctgtagccccagttgctcaggaggctaaggcaggagaatcgcttgaactcaggaggcagaggttgcagtgagccaagatcgcgccagtgcactccagcctgggtgactgagcgagactccatcatcaaaaaaaaaaaaaagaaaaaaagaaatattatgttagaatccagtttttattctaaaaccttaccaaagtgaaagaaatagcattgatggatagaattcagattatctgagcaaaattccctacctactgtctcaacaccaaaccaaagttgggttgaatcagatgcagtgttgagtagaagattttggtaactcaccaataaagtgattattccccaaggcgagcatctcctccaggaggaccagtccccctgaagcctgaaggggggtcacacttcgtccatctatgagggagcactgttggaatcctgtggccgtgaccttccagagcaaaatcagtgaggcagtggcatcttgccgaatcctggaaacaggaatgatgtaaacagaaagctcctttcagaaaaattcatcttagaaccagttcttcaaattaaaaataaatacaaagatggtatgtgcatctaccaaggtaccaggagatcgatggcataaacagatacgcgggcgtccactgtaaaggcgtacactcccacttgttcacagtgtaccacaaaatgagtcactggtaactcacctttgagtaaccactttgatgaacagtaaaagagtacactgagttctctttcagacaaatccttccatagccacacaatataaaaagagttttgcttaaatttgtcataaacgtggactgcaacccaacacagccacctgagttatgctgccaaaataagcaaaagtgtgtcacctttccccaacaccccccacccacccacccacacacacacacaatcacatacaatccacctcccaatgcttcaggcctcccctggctcatttttggtaaaaaaaaaaaaaaaaaaaaaaaaaaaaaaaaaaaaaaaaaacacacaaaaccaccccacagagaataggatgtcacagaaagcccatcaaccccaaccccaaccccagctgccctcctgcgcttttctcctcacagcccaatgcttcagctactacgagctaccccaacccagttctttctcacctcccaagctttgtctccttctccaccttggaaatgtgttcctagcccacatattacctcttcccagagactcctgaccacttcccaacatcccaacagctgcccattctccccagtgctcctggagaagatcacagtagactccgcacagatccgctcccccagcacagggctcctggcgtgcagcaggggctcagtaaagctttgatcagtgactaaattcatgaggaaatgaaagcgtaaggagctagtaacccccacaagtgaattcagtgccctcaggtcattcggcactcccatctcacttcgtctgagtcagactctgctaattcggtcccgttctgcagcttaagggagtctcagagaatggcaggtttgttgagaggaaaaaaacaaaagcatttaacgagatagaagaccagaaaatttggaaaggtttatcaaggtaagataatatgatctagacaagaaagggccgagagatgttttaagagtaaaggaaactagagatcctgctcctaaaactagcccaggacggcaggggtttcagctgtagtctgagcagtgaaagaaacgcttaggaccggggtccccctgctggtagagctcgaagctgcctcaggcttcacctctcccgcctctccggatgggagcgttcctcctgagcccaggaattcccaagcagcccttccaggctcttcccctgccagagtgagttcaaggctgtggtgacccagggtgcaagagcaatgtaacaaagtccctcttccaaacatgttcagggactccactgtttagaaagccaggtagacaaaaatggcgatggatacatggaagagacctacagtgcccgcaggccccttaaaagggagccagtgcaacagattggttaaccaggccacgtgttcccagtcttctaaaaatccccaaagactggacagcaaatgccccttaggttgcatggaaagtgtggggagggtggtagtcaatggcaactgaaaaggatgggcagtggggggttgtcagccggcctggggcaccctaatactggcccataccccacccccagctttgtgctcctgggcacctgctgacttgagcctcatataaagcaccacacatatcaggtctcaaccagcactgcttccctatgcctctccctcttccccaccggtgacaatggaccctgtcatttaaaatagcttgaattttaaacaaaacactctctttgtacgcttgcttttaaagagaaaactgtaaaaataaataaataaataaaaattataaaaaataaagagaaaattgtaatatgtagaatttaaatttggggcaaagtatgcatctgaatgtaactgatggtccaataaaatcttaagaggccaataatttgggaagcaaagcatttgggagacaaggaatctggctgagatcttatctaaggcctcacggtttgtcacctcacaccagactcatccagtccaatttctcaattccacttgtccagcctgaaaaccctcactgtaattgcctctgaaatcgcttcctctagttttcaaatggcaggggccacatctacccgtggaatctgttcacgattctcacttgacaggccacttacacaccaggtccgcggatggacacaaccccacttataggtcatagcatcactcttaacagtttgtaactcagaattttcttacttgactgaggtgttctgtggcacttcaaaggataccaggcggccacccgcagagctgttagaactggcattcccacaggcaatatctgggatcacctgggaagggaaaaaaaaaacgacatatgattggggttgtttatagtataacataatgtgataaagcaaaattccatgctgaatttccttcatcccttttgatgatgcgggggtagggctagagaggagatgaagaagtgaagccttacaaactcaaaagaaaatgaaatctttgtcatttgatgttctgaaatgcaacagcttccctgagagcaatctacaaattcctgggattgttaaaactgatcaataggatattgcaggacaggaagcagatgtcactccctgctcattttccattcatttaacaagcagtcattgacccctgcactatgcttaacctgatgctaaccaggaggccaactttaaggactaacttacaaacagcaggtaaaagcctaatgactaggcaagccagccttcgacttgcaaagtgcatgcagtatcaggtctgatgactcttctgtgtgctgatgggtccaggagcacatgctaaggctggggagcttgaacgctgcctttctttttccttgtaggctataccttcgcttttaaattatttcccaaaagtattatatggatgtatatttttttaaaaaggagatcaattggtggggggaggactgtgctcatcaaaaagcatactgcaaaaccttgagctatgtccagtgagcataaacctggccaatttatgcacttagtcctcatgccacaattactgtcctcccccatgtcaatgaaaatgaagcagtattaaaagtattcatcatcacagaattaattgagaacaatacagaaactctcagcaatttcactccacagcccacacttagatcttattttccagaatgccctacaatcagattctatggattaagcccaccactgatattcaaagatgtgagtataacttgttaaatttgtatgacagatggctgctacccaagcctctaagtctccaaataactttatgtttccaaagcatcattacttcacagaaaggggataataatatgcctcctggtttccatcaggttaggcatacatattaacatgtcttcctctggcactttaaatctgcttcatgagcagcctaagaaataatccatgatataggaagatgaggcatttcctttttttcttttttacacttaccaactgtaaaataacatgactttaaataaatagattgaaatggctggttagggagaaattttcttttaaaggacacttctttgataaacttgaatcaaatctagttcacattcaagaactgagtcatccagcaaagaagcattaacatcataacttcaaagcatttattaaaagcctgaaatcagagcaagttcacagttttttaggtaagctaaaaacattgccctgcagtctgaatgtggccttcataagctgtgtggtaatacaaaaaaaaaaaaaaagtgggtcaactggtgagaattactcaagaaaataaaaggagaaatgctactatctcttttataataaaggaaatttctagatgcagtccttgactctaatacatgctatgcaaaaatctatttttttttttttcatttaaacgatgaaacccgtaataataacataccgacacaggtttatatggatgtcatacatataaagtataagatatagaatggaattacactccccagtgtcacttcaaactcatgatttggatttgttccccaactcttctacccagcaaatttattttatgtcaacttctaggagtctactgaaaagacttttgaagagcttgaagataaaacagccaaactcaaacttgataggagaagttccaacaaatagaatttgctgctgccaaaataaataaaacttggaagtttctttgtcaaatgcattctaaaaatatgtcaaaatcattgatagcttcttctttctaaaccccattgaaatacttcaaggtaccaaaaatagaacctaaatgacaacagtaaaaaaatagttgagtgttgcggtctgctgtggtctgaatgtctgcgcccctctaaattcatgggtgaaatcctaaccaccatgatgatggtattaagaggtggggcctttgagaggtggttagatcagcagggcacagggctggtgaatgagattagtgcccttgtaaaagacctgaaagagctccatagcgccttctaccatgtgaggttacagtgagaagacgcgggctgtgaagaaacaggccctcaccagactctgaatctgccttgatcgtggacttccttgtctccaaggctgtgagaaataaatgtctgtgatatgatttggatctgtgtcttcaaatctcatgttgaaatgtgatctccaatgtgggatgtgaggtctggtaggagatgtttgggccatgggggcagatctctcatgaaagacttagcaccgtccccttggtgataagtgagttcaggtgagattggattgttttctgggacctctcccttccctctcttgccctcactcttgccatgtgacacactggctcccctttgccttccgccatgattgtaagcttccagaggctcagcagaagcagatgctggtgccatgctttatgtacagcctgaagaacaatgagccaataaacttcttttctctataaattgcccagcctcatgtatttcttcataaccactcaagaatggaccaatactgtgtgttggttataagcaacccagtttgtggcatttttgttatagcagccttaacagactaagacacactcccagaaaggaaaataaggtcaatgatggagggtcctatgacatgttcctttacatgactacactgagctgtcttccccaaaatctaagattatctcacagaaatacatgtggataccattccaaaaaataatttgattcatttttttgtttactctttttatacttataaaaccatcgtacacacaaatgcagacaggaataagtttagggagatattttgcttcgtgatttaacttaaaatgctttcatttttaattgctgatactagaaccgctggagtcactttaagatttctggtttctaatgtaaaaatgcacatgatataacgttctcacctccacttgatcccatttcatttctacaactttctgccctgttttcggctgccaggtaggcagtgtcaccgttgcctgagagcgaggcaggattttgtcaggctcctgagtagcaggaacaggctgaagctgtcggggtgccatggattcggtccagccagtggctgggagactgggaagtgcctgttcacagttgggaccttcatagccttcattgcaaatgcagaggtagccatcgctgctgctgctgctgctgctgctgcagttgccatggtgacaagggttgctggcacaaggatctgcaacaagctgaaacgagaccataaatgggtcaattattccctcataagaaaagtggtgccatcgctgggaaattagctctgtgtctcagagcgactgctgtaatggaaatgctgttcctgtggaatacactccttaactacttgtgctgttgtggggtggggtgtacaccaaggtcatccgaacattaaccttaccacagataagaggcacccagcaagaaaatacaaagtggagagcagcctcctcaaaacccaaaacacccaataatgtcgatttcagtaaccagttatttagagtaattttctagggcaaaaatagttaaaactcattaggaagatgccaactttgacatttttagctgtcaaatgatattaggaatctaaattggaatctccttttccacattctggacctgtgcaaggtctcctcatgagaaaagactgccccatttatctgccctgcagatgtgcttacctgtatctctcaatttcctaaccggtcaacaatactttttaaggtgatactgtactatttaattaaagacttccaaaatgatcagtttgcatggcagttgctagctagaagagactgtggtggggacttaagcagaattttatgaaattttttatttctttattttggagggtgattagagagaaatgtgaccccttccctcgccagatatggaagatgagaactcagtcatatgtgtttcaattatgctcatggtctggggaaagtgtttatctcagagtccttctctgttgacctctgaatggccatgtgttggtagttgcagacacgctacaaaacaatgtgaaaaaatcacctgctcctcttcagatagcgcaagggttcagtcatgttctcagcacctgttcaattaggatttgtttctgtgataaggagaaaattagatctctagctgatatacccctggcttctcagggctgactacaaaacagaattcagtagagaataaatgacagagaagtgggaccctcactctcttgttaaaatgagttcacacacttaaacatacatggagagaattctgaatggtaaaacggctactcgttctgctaattattcctatcaagcaacttccaacagactcctgaaggaatatattaagggatttggggttgaatcaaatgaagcttcaaaaataccacattaattctatgctatcacttggcaattccctcacagaatctcagatcagagtcaatggatttgtatctgaagagaatatttaaattgtcaataattaatttacaatattcacaatctatcaactcaaagtaaaatccaaactccttcttcggcagacaaagctctttttggtcaggccccttcctctcctcccacaaaccttcctcctcccttgtagcctactgtcctcaccctgtctctctccatggactataccaagttgattcccacctcaggccctttgcacctgctggacccctgcccagaacactttttctccagacgttgcacggctttcttcctcatctcattccatcctctactcaaatgctaccttctaggagaagccttccctcactgtgaaatctaaactaatctcttctttacccctctcctacaaaaatgtgagctgcacgaattcaggtattttatctactgtgttcactgctctattcccagcctgtccaggaacacagactgtatgatgggactttaaaaaaaattgttggaaaaaggagatatgatagattgatcaacatttggaaagcaacacgtgatgagggagggatgtgaacttgttgagtcacaaagttgttatcttgtttctgatttatttttaggaaggccttgtggaacgggtgtcaccccaagaattatgcaacaagaagaagaattttattcacgtgaacaaaggagacattcaaagccatgcttctgaaatcaacttttaaaacatctgaggttgatctagtcacaaataagaatttcaatacatgcattaaaaaggcagaaatacatttaaaccacaagggatcaatacaaaaattaattctgaaagtccaaacctccattgcgcagcttagagaatgacattactaaggcaaggaccacccatctggtggcctgagaggcctcacagcttcagctccattgccacagcccacatctgacaaccatcagtcctcagagaggcagaggcctcctcaaaaggggcactgagcacagcagaagtccacattccttcagagaaaccagttaagcacgtgtacacacccttcccacggtaacaggcacaacacctaccctccccaagatagccgttttgagttttcaaaggacactccatagagtaacttctcttcatgccaacactgaaatggagaaggatcttctgaatccatatcacttctgagaaaaagaagagcagagggccgggcgcggtggctcacgcctgtaaccccaacactttgagaggccaaggcaagcagatcacaaggtgaggagtttgagaccagcctggccaacatggcaaagcctcatctctactaaaaatacaaaaattagtcgggcatggtggtgggcacctgtaatcccagctactagagaggctaaggcgggagaatcatttgaacccaggaggcagaggttgcagtgagccaagattgcaccactacactccagcctgggcaacagaacaagactccatctcaaaaaaaaaaaacaaaacaaacaaacaaaaaaaaaaacaggcagaggagttgaatgacctctcacagctactatactaggagaccatgtcttctgattttcagccaagagttctttccataacacagcaccacaactttaatatcatgttattatcatgccaaaaaaaattcctgtagagaaggcagaaggtaagggttatatttttgtaagcaatagaaaacaagtagctattaaatgtaggccaattaagactgcctgaatgcttttttgagaaaaatgtatgataatggtaatactcaaggaacactgattgaggacttactatgacaagaactgtaccaggtctcggtataaaatgctgtttaaaaaaaaaaaaaaaaaaaaaaaaaaaaaaaaaaaactctaaatctgtcctagagagtctacatctagtaacctagtacaagcactaaaagtttacatctagtaacctagtacaagcacaaaaagcacctagtcctacctgctattcacaatacttatttgtgcgcctgccattctgttgggtgttttacatttcttattttagttcatccttacagcaacccttttggtaagtacatttgtacatttattattctattttacagttgaggcttaacagtgttacacaaatgactgacttttacccagaataaaggccaaagtattcactaattttttttttttttgagatggagtttcactcttgttgcccaggctggagtgcaatggtgccatcttggctcactgcaacctctgcctcccaggttcaagcgattctcctgcctcagcctcccaagtagctgggattacaggcacctgccaccacacctagctaatttttgtatttttgttagagacgaggtttcaccatgttggccaggctggtctcaaactcctgacctcaggtgatccacctgcctcggcctcccaaagtgctgggattatagacatgagccactgtgcccagcctgtattcaccaagttttacaggccctctgtctgtaatgtgcctgccctagtctccctgacctcacctcctgcccctgacctccctcactgactgcacaaacactggcttgctcactgctcctccaatgctccagtcactctcctgccccagggcctttgcaccggcagtaccctctgccgggaatgccttgcttctcaaggctgctcctgagccacctttgagtctttgctccaatgccatcttctgatgaggagcctgcttaacagagcaaggtctccagcctctgtcaatgtcaactcctctttctttttttcaatttttgttttagattcagggagtatgtgtgcaggtttgttacctgggtatattgcatgatgctgacgtttgacccttctttccttgcttttttttttctaaaatatccatcatcttctcacacaaattttaaattatttaatacattcatttttttctttccccactagaatgtaggctttttgaggtccaatttctgttttccgtttaatttacttgtgtatccacagccctagaacagtgcccagcacatgggagctgctggataaacatttactaaatgaatgaatgagtgagtgaatgaatgtgaatgatgttatatacacgcagctgccagagcctatgaagtgtactgccttgttaaatggaatcaggattctccaaggcccagtctcaggtcttgagaacataagtcaaggcggagccttaaatgtcccactgtggtgttttaaagtgattaaataactttaaatctgctttaaaaggagtaaaagctctgtcgacctgagaggtaagacagaaccagcacaacctgcagcctcagccttgatgagggcaggaagagtacagacccacttcacaggtggctttcaacacagtgagccaagccacctttctctggtcctcggagaccatctctgggagccactttgtgaagccattcaccccagtgggaagtgtcagaggtgctggttgatggagctgagtggcaaagggcaggtcccatggcaatgttcaatttgccacatccaggagtcagtcccaccaggtaaggggataaagagccagaaagaaaatatgatgagaatcaataataccctaagtgctcttgtctgagcttcatagatgagaggaatgcacaaatagcatgtgggatgaaacaatgaatgactgacacggaaggccaggagaaacactcttagtgaagaagagaggacaaaagctaaaaattaaacagtcagttgcataaatttctaaggggattcaaagtagtggataatgtgatggagtgtgtatgcacacacatgcacacgcacatgcacatgcatgcacatgcacgcatatacatgcacacacctgcgcacacacatgcacacgcacacatatacatgcacacacacatgcacacgcacacatatacatgtacacacatgcacgcacacacaaatgaacacaaacatgtgtgcacacatgcacacacacatgcacacacacatgcacacacacacaggagtacgaggcagagaattaaatgcattgcagggtcattgggccctttttaaaaataattttatcccaatgctacttccttggcgtgtatattagttgtttcattaacaatggcagctttctgccattattttctctaactcttcagactagttttattttttgggaaagctatctgtttcaattcataacagcatatataagataaggtgcaatcattaacttttaagcaaatcataaatatttatcttaagtcctacgtttctgtatacagtcaagatttttttaaagttcgtatttgtattttatctcattaaggaaaaggtcctgttgcagaggtcgcatctgctcttgcgtcccattaaatctgaactataagcaggtaataaccaaactgccaaaatgcataatgaggcaaaatatcagaattagtagacctaactttgggaatgcataaaatgtaatacatgatattttccgagctataatttctagattctaatgatggggaaaaatgattaagcctttgtaataccagctataataaagaggaaagagaaagcccatgggttaatggtcttctgcttacagtgaaccaacaggcccatttattaaatgccgtgtgcttgctgcatcagatcaatttatctgcttaagccacattttttcacatcatagaactaacctgaaactattttccacattttattttagacttttcacccgtgtcaaataatgtctactctaaccaagagcagttctgggggaatggactgagtaaaatgggaggccagacctgagcgagggtgccagcctctcctgggacttgtgattcaaaggcagtagcagtgtgaccctttagccatggcctgtttttcttccttaaattctctgctacccatgtttctggcaattcccatatcctctgcggcgtacaaacagaaggacgaaatgccaactttaaaaggcatgaaaaaggcccattgatagggtcattagatatagtaagtcaaagctaatagggttgctcgaagtgtggacacctgcatcagcattacctggatgatggtggggcctggggagacacagaggtgactaacttcccttccatactagtttagaaaatgtatgggcttcagccctgcctcttctgtacttttacagacaactcaatatggccactcagcaattcatgtgacatttatcaagcacctatgatgtgcaaggcaggatgcctataataggggtcaggaagatgaataaagccttacctggcccttgaaaagctcacagtccaatagatgagtcagagacgttaacttggacttgccctgagcagtcggctcatcaattgcttgccctgctggtatgcatgtcagctattgggatcctttgtttgattgaggttacccaccccaacacctttatgttaaactaccttacatttttttaatgctgagggagagaatggatctgatcatagcaaataggaaacgaaattatgagcaggtgttgggaccagtctcttttagaatgatagcggcagctttcggcaaaacaaagacagcaattctggatgcctccaccaagaagaggtggtctgggagttttccaatgagaaatggagccagctgagcaagcagtgccctggcgttggccctgttcttcacaggtgggtgggacaagttgctcacctgctctggacacacacccctcacgcattaagggaggagctgggtttgcatctcgaaaggcctcctccagcttgaagacttaagattctattgatagccactaagcttgatggcagttttcagaaggttcagggaagaaccgagccgaccagaggtcagctcctccaatattatacccaagctaagtgggcaaaggcatccagggggaatgggacggtgcttgaggaaaccaaatgtgacaaagccccagaggagaacttacaaattctgggcagtgggtggggaaccactgtcattatatgacccagcacgacgctggccacagaggggacacaggggactcgtgatacttacagagaagtggagaagaagatagaggcaaggatgggaaagaacagggggaatttgtgtatggtattaagaaggaagtaaagtggaccattacgttagtaatttgtctgagtggcagaatcaattttaaaacttttaatacagactttaatagagatattagtattaaaggaagagggagtgtcttattaaacaaagaacaaaaacaatagccttaaagcaggttttctcaacattggtacttttgacaccttgaattggataattttttttatcactgggggctcccctgtatgttgtaagatgtttagcagcatgctgtgtccttactcactaaatgccagtagaatccctccttccaagttatgccaaccaaaaacattgctaacatcccctggggaaagatcatctctgattgagaccactgccttaagggaacagtgcatttcactccatcaaaattatttttaatcattgcaactccatgagtaaatttaaaatgcaacactatcatgaaggaagaaatgtacaacatactataaaggactaaatcccttattatagaaagaatttttaggataaatacaagataaatgcctcagcgaaaagggcaaagaaataaacaagcaatctacaaaataaacagtctacagaatcatgccattttatacaatcttaaacacaaataaaatgttatgtatttatttgtatgtatatttactggaggatggaaaggagggagggaggaaaacagaaaaggaaagaatgaagaagggaagcaggtaactagaatggaccattgttttagtgatttgtctaagcagcagcatcagtcagggaacttttaaaacacagattccccagctccaggccattcatcagaaactctaaaggtgaagcctagaaacctggatctttcaacatttcccagatgattctgatgcacctggccccaaaaccaaaatttagaaattgttagtacaaattagaggttggcaaatcacaaccacaggccaaatctggtttgttttttgtaaataaagctttattggaatacaaccacagccacctgtttatgtgctgactgcttttgcaatacaccagcagttgagtactgacaactgaaagcgcctggcccacaaagcctatatgatatttgttatctggccctttagtttcccagtccctgatctagacagtacagactttggggttcacaaaagagggaaaacaggtaggtgggggtcacctggaaagacttcaaaaaagaaaactatcttgaactgggccctacaagtttgatagcaataacatctattttctccccccatgcaactccctaattggactggtgtgcagcaagtgattaaataacagaagaacctttggcaaaacaacttaaaggaccagatattcttttagtcataattatgtgcaggaaggttgcagaataaatcttggtactatgaaaagaatgctcatctagatagtccaccttgaagcaagaacacaatgaagggtcatacccctacctttccttcactagaagaaatatggaaattctccctctacctttccatccatcagctgaactaaatggagatgaatgatgagcaacccatgccaaggctaaatatagaactaggtggacccatggaagacgatggatggggaaaggtcacacagactaaggggatattgaaatagcaggagagtgactctgtctgccagttggagagggggactacagcaaagatgactccagaatttatagcttagggttactggagaaattagaatgaacaattgccacctggaggtactgtgatatgggagagaaagactggggttccagtctcatttgcaggtgatgttggacaaggcaagaaagcttcctggggctcagcacactcaactgtaaaaggaagggatgggactagaacattctaaaggcgtttaagttcttaatattgtgtttctatgtccaaaacaggaattgcagtggttgtaaatgtcatcttccttctgaaacgcaaatgaacaatgttggggtccaactgtcacagtatttttgtctcaaaaagaaatttttcccaccttcttcaataaggatttcaactatattccaacaccaactgcttactcaccaggaataaagatataaaaaaaaatcactatagtgcttatgccagtagtagactcagccaagaaatgcatcccaagatttttttcccaaatccaaataataaaaatgctcattcgctttactgaatcaagaactatatgtcttagtgaaatacacattccatgttttgataggtctttacttctgtattagaaactctacatcaattcaaaaaattattccaagactaatttggtcagtccattattccctcaattctgagtcagctttcttgaaaccagcttgtcctgatttttgtatgtgagttgagtcacatttgtaagtaggctaaaaggaaattataagcagaattgaaacgtggctataaaatgaatccattaaaaataaactcttacatattgtttccctactttttcatgctgtctctttaaaacatactgcatttggaaattaccttgaaatctcaaggtaattgctttagtctgattaacacatagtgataagtcatagtgatgaatctataagccctgctcagctgcagatatatcaagaattaaaggaattgttcttcaaaaacctgatcttccctttgtcccttggtttccatatttaactaagtcctaagagatagcactcaattgcacttactgacataggcacaccagcctcaaatgaaatgcttttttttttttcacttttaatcattcaaagaccaatttcttgaataaaaaagttgcagaacaattccagtgcacacatttttgtttcgcctctcatcagagacactcatacatcctatcaaacttttttacaaaaccacaatgccatcaatacaggaaatatgtcgacttctgcctctttcgtactcaggaaaagaaggctgcaggcaaactgggaattaaatttcctgtgaagattgtatgatcatctcaaccaatgcagaaaaaactcttattaaatttaacatctaggtagagtgaagacttttagcaaactaggaatagaaggaaatttcttttatctgataaagagtatctacaaaaaaccttcagcaaatataatacttattggtgaaaggtagaacagtttctctctgaaactgggaagaaagcaaggatgtttgctaataccacttccattgagcactgcactaaaggtcctacacagtgcaatgaggcaaaaataaaaagaaagtataaggatccactaagaaaataagctgtcaattacagactgtatgattattcatgcagataaattattaaaatatggaacttcagcaagtttgctgcatgcaagatcaaaatttaccaaaaaataaaaatattttgcatctccatgtatcagcagcaaactaaagatccttttctcaaaggtacagtttataatagatgaaaaaaattaaattcctagtaataaatcaaatgttaaaaatgcatgatctcaatgaagataattgtaaagggggaatattccagtcatgaattagaaaacttgatattagaaagactcaaatttttcttaacctacaagattcaatgctgctacaacagaaatcacaacatttgtgtgcttctgtaaaatggcccacgatagcacagacacgcttgaataagaacaatgtgggagggcttgctctattagaaagcaggaattttaaagctatggtaattaggatagcatgacactggcagaaagatgaacaaatagaccaatggaacagagacaagaaacagaaaggatcacacagggacacttgacttctagaatagagtcttttcaataaactgatatccaatgagaaaaaaatgaagacttttccctctctcaagccatatgcaaaaataaacaccaattggattgtagatccaattgaaaggtaaaaaattaaacttcaaaaagataatagaagagaatatctgtataaccttatagtaaacaaatatttaataaacagaacacaaagagtactaactataagaatattaatattaaatgacgagttaatgggtgcagcacaccaacatggcacatgtatgcatatgtaacaaacctgcatgttgtgcacatgtaccctaaaacttaaagtataataaaaacaaaaaagaatattaatgagctggatgacaacagttatagtatactgataaaatatactatacagccatgaaaaagaaagaactatagccttatacaacaagtagaacaaattccccaaacacaatgttttttccacttgtgtaaagaatataaacagcaaaagtgacccatgcttgaagtcagaagagtgattagctttgcagagctgagagaggtggggacgaggaagctgctggagggcaacattgtcaaccttgatctgagtggtggttacacaggtgttcattttatgataatacattgagctgtacatattttgggggggtgcttttctgtgctttgcaagtttgtgctttgcaatttttgtgcatattttgtgctttgcaattttggaaaattgtttttaaaacacctaccatatacacatatctgacatactctttgttccttggttgtcatatttaagaaagatgatgaaactaacttgcctctacccaaaagtaaccataaggttccttcctgattttcctcccaggtaagaatggcacacagattccagagtgactctccctccagcaccgcggccacatgaagccacagggaccaggagggccagcagaagccaaaatccagcagcctctgtgtcctcctaatgactttgaccttccttctagaagacacagaaagccaatgaaacatgccaaacaggggtggaaactcaagtcagagtagcactttgaaaagaactttccacttttgttggggactccaaagacagggactccaaacattttaaatgttctcatttctttatttttaaataggacaaatgacatgctctttatttttaaagaataaataaagaacaaatgacaccaatgtggggtagcagggagttggaaaaccaggcacatagtaggctctcaaaaaatatttcttgtctgaaacaaagaagagaccccattgctttctaaatcattctttattcagagtattccctaccaggaagagtgttcttctgtatctgttaggctcggtggcctgggatccttaagagaagttggagagagaaatctatgagtgcctgtgaaaccaggtgcaagagcagaaaaatcagggtcaccttgtttagtaaaagtcgggggaggctttgggttgatccgccaagtgccaagtgttcttgtgtacctgcctggcttcttgactgctttgatgtgtgtttttctctctgcaggcacacaaaattccctctgctctcttttcagcttttctaaccttacttggaaacagctgctctaattttaatacccatctgctcccgggaataggacaaaaatcagtggctctgcagataactctaaagtctttgggtatccaacttcatttatctggagataagccttctatatacagcaggcttcatatagacagctacactaggaacaaaactaaaaaggaaaatgaggaaaaattcaagcaaaagagcaggtggccctagatatccagtaccaattgttttaaaatcaacaagagccaaagacccacaaattgcacgtgtgttcagattgtctcattgcaagattaaaaagaggatctttgattggctagcaaatctgctcaaaggccagggttgttttatttttttttctccatgaggaagctgagaggaccttcgtagttatgaaagacaaaagaaacaaaagaaaaaaataataacagaacaaaaaacagggctgaaagtggaagaggtcacccgtaaaagccctaccaactagaaacagtcatggattgtgaagcagagaaacaaggatggtcacaacagagacgggagtttctgcagcctaggagttcagacaggaagcaaagggatgagggcagaaacccaccaccaccttaattctgcagctctgtggacactatatataagctatacagggaagcagaagaaacctgtataattgtatctaatgaagcagtatggcaaaggtactgtagctttgaagacactctacagtactgatcattcaaattatctcttttaaatgcaaatatttagcatttccaattaaggcataacattagaaggctagaagaacccactgggaaaactgtcagaaaagtatatccataatggcttttcaagctaacaatttttgaacacagagcatcctctgaactgttttagaatgttgatgaaatcaatcccatttaacaatgcttgccatgttgaactatgtgaattgttagtgtataaagattatagacaccataacagcctgggcaacatggcgaaaccccatctctacaaaaaaaaaatgcaaaaactagctgggcatggtggcacacacctgcagtcccagctacttgaggggctgaggagggaggattgcttgaacctaggaggcggaggttgcagtgagccaagatagcaccactgcactccagcctgggtgatggagcaagaccctgtctcaaaaacaaagatcatagacacgtgacttaccttgcatatgcaaatgccataggcatccatacaacagaaacttcgatggaaaatttcaccattcaagattttaattgaactgatggccaggcccttctccggtggaaaaaaaattagataaaattaaaaatgctttcatttggaggtaagctttaaaaaggggtggaagaaaagggggatcctcaagtttcaggaatgattagaaaattcacaaccagagaacttagcacatgatgacactgcattgaccacacagcctacagagctggaaataagacctacagttctgggaattggggttctaaaaatcacatgggagtgttccagctcttttagaatctgtctagcaggctttctggtttttacaggaaggcccctctcacacacacacacacatactcaaatggggccttgagcacaggaaaggagaggcaactataactgagcccacaaatgaagcctcttagagcctcctgtctgtttagagagagcagaagggacactagagaaatccaccagcagtcccgaggtaacagcagaaaaactgacatctctacagtctttggattaaaaaaaaataaaattcccatgaataattaaaatctcccatatgaatgtcccctgtgattaacaacatctccttcatgtggacatcctaaaccaaaaattaacataaaaaatgtgtttagggccaggcgcagtggctcacatctgtaatcccagcactttgggaggccaaggcaggaggatcactggaggtcaagagttcaaaaccagactgaccaacatggtgaaaccctgtctcgattaaaaatgcaaaaattagctgggcgtggtggtgcgctcctgtaatcccagctactcgggaggctgaggcaggagaatcgcttgaacccaggaggcggaggttgcggtgagctgagatggtgctatttgcactccatcctaggcaacgagagcaaaactccatctcaaacaccaccaccaccaacaacaacaacaacaaaaacgtgtttaggatcagtacagaagtggagtgacacttttcacaatacaggacacatgggactcacgcacatgcctgtgtacacacagactcttatcaaatcagcacacagcaaaaaattacaaaccatacaaggaaataagccaccatcagcacttggaactgtggataaacggtcaacaaaaccttttccactcctgcatgaatatatatttatgcattttaagatgaaataagatgcttaaagtagatctaaaacttttttttaattcctcacaacttctttaattaactgacctgattaaactgtcctgatatctttgataagaagacttctactaaagatattaatagctaagatttctgagtgcttatgctatatctggcatggttctcgtcgtgctccctatgttaatccatttaatcttcactatcaccctgtgaggcagttactgttatctgcatattatctctgaggctcagaaactaacttgttcacggtccttcagctagtaacataatgagaatactaatccaggtagaacagtacaattccaatcaaaatcccatgcttcttttttgttttctgacttatcaaattgatctaaacacaaatgagagatgaaaggaccaaatattttcaagataatttgaagaagaataaagatacatgctttattccctcccagaaataaaaatttattataaatctataactacattgaacaatgtttcagatgagagagcacagagatttgccatgtagagaaacttagaatataacagggaaggcattaacaattagtgtaggaaggatgggcgcgatagctcacacctgtaatcccagcactttggggggccgaggtggtcgaatcacttgggcccaggagttcaagaccagcctggccaacatgatgaaaccccacctctactaaaaatacaaaattaaccgggcatggtggtacatgtatgtaatcccagctacttgggaggctgaggcacaagaatcgcttgaacccaggaggcagagtttgcagtgagccgagatcataccactccactccagcctgggtgacagagcgaaactctgtctcaaaaaaaaaaaaaaaaaaaaagtagtgtaggaaagatcaactttttagtaagtgatacttgaataattgctaattgctgacccctgggactgacataaatatctaacttataccatacatctacacacacaatgaattccagatggattttgtaggacaatgttaaaaatacgacctcaaaacttttaaatcaggagttgacaaattacagctcacagaccaaatgtggcccatcacccaattttaataaatcaagtattcttggagcacagtcacacctgtcagtgtgtccattgtccaaagctgctttcccacagttgagtagttgcaacagacatgtgacccacaacgcctaaactatttactctctggctgtttgctgaaagtttgctcattcctgctttagatgaaaatataggacaatatctttctgacatcaagatagaaaagaatctcttaaataagactcataaaaggtgaataaattaaaccgcatgaaaatttaaatgaactagagctatatctgaaagccacagacaaatcgcagaaacaccatagtgagtgggaaaaaagcaagttgtgaaaggatcctgcagtgtcatacgtctgtgcacattttatgcctatattgtaaaaatattttaagagatgaaagcttacaacccaacttggaagaatcattgtttctgggtagagagggagggaagtgggttggggaggagtagggtagtggcagtgagggtggcgggctttaactgtatttgcctgttttatttatttatttttaataattggaaaccaatatggcagaatgatgtttgttgaatctcagtggcagatgctaattatactattctccattctttcttgtaggtttaaaatagttcataataaagattttaattaaaaatgtgatcttggtcgggcacagtggctcacgcctgtaattgcagcactttgggaggccaaggcaggtggatcacttgaggtcaggagttcaagaccagcctggccaacatggtgaaaccccatctctactaagaatacaaaaattagccgggcatggtggtgagcacctgtaatctcagctacttgggaggctgaggcaggagaatcacgtgaacccaggaggcagaggttgcagtgagctaagatcacgccactgcactccagcttgggcaacaagagtgaaactctgtctcaaaaataaataaataaaaatgtgatcttcatcattcaagcaccttctctgttccaggcatttctgtagcccaggggctggcaaattctgacccacaggccaaatctgacctgcaacctgtgtctgtacagcctatgaggcaagaatgatttttatgctttttaaaggttggaaaaatcaaaagaaggttaatattccaaataatcatgtaaatgttcgataagattcaagtttcagtgcccatcaataaagctttattgaaacacaaccacactcattcgttttacatattatctggctgccttcacatggcaacggcacaggtgaacggttgccacagagaccttgtagctcacaacgctgaaaatattaactatccgccctttacagaaaaagtttgctaacccctgcactaggccctgaatacatgcaaagcctctgttcctaacgtgctggtggagggacacaatgacaaacaccatagacacagcagcagtgtcacacattgctgcttatgtgtatgacccaatgcaggaaaaggcaaggacgattttcttctgtggattgtacattctactttttatagcttcaataaaaatggctaaataattgtggagctctcccaatgaggcaggagtaatgtctggattgtaatatttttactatgttcttcttcccagaattatatcactgattcagcccattggctagaaatattcagaatgtgaaattttatcacataaaagtttttgccatgagaaaaatcaatccatcctgcaaaaattataataggaatttaaataacagcataactttgcagatgattattttaatgtcatttgtgttttaagttctgtttgacgtaaaatattaacattgtgccctggtaccatttgttttgacgatggaagattttcagactttggaataagccatgcccaataaacctaagcacaagttctgaaaataaacaggaaggatgagtgtcctttatcaatgaagagagcaaatgacacagaaaagggagcatttgtggcccactgtgtcgtgctgcagaaatctcaggaaacactctcaacggcctcacagcgcatggacacggtagaagagaacggtttcctggaaagtagtaagttcacttagaagaatgttattcagaaagcaactgttccacattcttaactgagacccgcattcagatggccagttctatccagcggggagcctgcagctgacgttcatgaggatggctcagggtcatgggaacaccatcattgggtttgcatttgctccgtttggcaatgcgcagaaatgtgtcatttcctcaaccgccgacagtgtactggaagatcagtcaccaggactgggttccagtctgcggtcctttcgtgatacttaggcatcttagagaacggtaagagcagcttcatttggcaatgctcagaaatgtgtcatttcctcaaccaccgacagtgtactggaagatcagtcaccaggactgggttccaggctgcagtcctttcatgatacttatgcatcttaaagaaccataagagcagcttccaagtctgtcaaatgccaatatggcaatgtgtacgctgcttacatccacagttcccaaactgtgtgccaaagtgctatggggtgccaagctgaaggcacaaggcaccacagattatattttttaaattttcaagagaaacacaggatctacaacttctgtcagatatttcacaaactactagctagaagtagttcattgtttcaacattagatcctgttacattttgatgataccatatcttaccaaagctgggtttttcagcaattactgggataagaaaagcaaacactccctgaaagtcgatgtgaacaggaaatgaggtgatcaactgagcagctgtatagtgccccacaggcacatagtcccagcagtatgtaactgcaattacttaagaataaagtaaatgtatttttttctttcaatttatgtgttatttttttcaaacagctacgaagtcatttgcacataagttgttgggatccaactacttaataaaaagaaccattagcaatgccttttggcctgaagcactataaaaaatttactgagatgctaaggccaccaggaaccaagaaagtttgggaatccctggcttacatgaaaacagttgttgtgacacaacacattaaaagttcttcataaaatgggtcactttataaattacataagaagtaaatttacaaagttctgccacttaacaattttagaaatctcaataatcagtccttatcttctaaaagaaccaaatagctggaattccaggagaccagtaggcagaccacagacagaacaggcttatcggcaaattgattgaaatcaactaggttggcaaagcatgcaactgacacagctctgaaagatcccccaaccactccaaccttgtgaggtttcaccttcgctttacagagaaggaaaccaaagtcctatggggttagatgcaggtttagggtccctaagtgacagagcagaactccaacccagttctttgaacctggctccaccagcccttcctctaagacgtactgacaggaaatcataaataaccaccttgaaaccttcgtcacacagtgtcggtgggatgttacaccgtctccataaccactcagtcctgagtctctttgaagcccttttcttcgatatgcaggtaaggagtgtgaagcttttgcattggtagcctgtcactttttgttatcctattgttcctatgttttagcagctgatcaatcacagcgtggattaaggcattagttgcaaactgaagtcaaccatactctggagtcaagcgctgctagagtcaaatcccagcacagccacataatacctcttagtccttaaggagttaaagtaacttctcaactcctcactttttgaatatttgaaatggggatagtactttctttgagggactgctgaggattaacagagagaatctaggacttgggtacaaaactctgatcggtggaattgggatctctggtcacccacataaatatcaactgaccaggccagaaaggcttcaactgagtccactgttggggatcagacattatgggcattctggatacactgggggaccctggtggaagcctgactgttaaaaggacaaaacatcccagagagagatttactgtaaagggggaaggcatctggtagagccagccacagccagtaaagatgcctcaggtgagggagaacagctctgggtccaaaacttccattggtatcagacttagactggcccagctgtgcgtgagagctgtccacaaagagagctgtccctcggaagcttgcagctctatgattccagaagcctcgctgcggacacaaagctgggtggaacatgctgggctcactgttttttgcactttgccagaatggcctggagttaccaggctatttggcccaggtttcgctttgaccaatagtaggcacaatgagctccaaactggttatctttggtcttctgacctaacatctagagtctgtgataattttatgaaggactcagttatttactttccctatcacatctacacacacggggagagagaactggatgaactaataaaaaatcttaaagtgacaagttctattactatgtggtagaaagcaagaacgtattccaatatacaaaactattttggaccaaaatatgtatttgcatatttcaggcaaatgtacaagtgacttgctaaaataaaacaatagcttatctctagttaaaattcaatcgcacttgcatcctcattaaaacattcgcattgtaaaatgtccaacatgagatactgttatcagtatctctattgtgcccagctcttcagggaagattttcagcaaacagccattaaaaatctaatttcgctgaatagaatatagattaacggccagttcattctataaatattgcttctaaaaacagaagttttgctggtaacagaaaaaaataaaatccaaacagcagtaccaattactacagcagcatttttagtagtttggcaatcagtatgaaccattgtaaaaagcaaaatcaagcattcaagcatgtggctgccaaagagccagatcacctgaattacagtcacagcaaatttaatttatgaacaataacatactcaatgcattgcgtagaaaataaaattcatgacaaattttcatataactgagcagtgctatgagcgttgaaaataggatttccaaaactaaaagtaaccctgtaaggcaaatattaccaactccatttcagaggtgagacatctaagacttagaaaagttcacaaaccacaaacataatatatggcgcagggaagagtcaatgccagattgtttttactatactctacatttccaaaaaaaaagaaaattaagagctaagtttcctgggtattttttttttctttactttaaaggaaagacgttacttttactttaaagacatttcatttactttaaagacatttcatttactttaaaggaaagacagtttgagctgggtgaatcttagcatacattcagaaacaagtaactacatagagtatcaagcccccaaatcattagtctttgtttcagccacccttcataactgttgagttttaaattccttttttttttaaaccatcattctcagcaaactatcacaaggacaaaaaaccaaacaccgcatgttctcactcatagatgggaattgaacaatgagaacacatggacacaggaaggggaatatcacactccggggcctgttgtggggtgggggggagcggggagggatagcattaggagatatacctaatgctaaatgacgagttaatgggtgcagcacaccaacatggcacatgtatacatatgcaacaaacctgcacattgtgcacatgtaccctaaaacttaaagtgtaataataattaaaaaatttaaaaaaataataataataaaataaaaaataaaaataaataaattcctaatcatgcgtgctaattgaaggacatcatggcacagacaagcaagttaggagtaaggcaaaagtaattttgtttggcactgagcagagtttgagatttacatctgaagataagcatctaaaaattcaagatccatcagaaaaaaacatgaaacacaaaaagatggaatgttcgtttctcaagtcacccagcctttctgaagtcctctaccattgggaacaagtgagagtagctccaagcccagtctcctggccttaactccatcctccttcccaccctgtttctggactctcctacaggacgtttttattaacagggtcataatttcctgggacaaggaggtagctctgtatgccccaaagactttcttgcagttcttctggagctagacagggttgtcttgaggctacagaatgaggcaaagaacagagctatgaacccgggcataagagactgggctccagccctgcctcctctgcagactggacagtgactctgaattgcatcttcctcatataaaatctaaaagaccagtgcccactttcctcatggctggttagagaaatcaaaagtacagtgcaatatgatattaggtgattattttaaagttgtattaatatttacctcccattaaccaagatacagtcacttgaagtctaacattctgtatgtatagttgcttttatttgctaggattaggaactaatctacgaagactttatctactaggattagcagtaacatttatcaccaaagtttcattcttagaagggtaaatgggaatttacaataacgacatagtcaaggcagggaagctggtgacacctccccacccccactcaatgatgcatttttcaagtcgtccaaagggtttagaattgttctgtagaggccgggcgtggtggctcatacctgtaatcccagcactttgggaggccgaggcaggcggatcgcctgaggtcaggagtttgagaccagcctgaccaacatggagaaaccccatgtctactaaaaatacaaaattagccaggcgtggtggcacatgcctgtaatcccagctactcgggaagctgaggcagaagaatcgtttgaaccttggaggctgaggttgtggtgagccaagactgcacctttgcatcccagcctgagccacaagagcaaaactccgtcttaaaaaaaaaaaaaaaaggccgggcgcggtggttcacgcctgtaatcccagcaccttgggaggccgaggcgggtggatcacgaggtcaggagatcgagaccatcctggctaacatggtgaaaccctatctctactaaaaatacaaaaaaaaattagccggaagtggtggtgggcacctgtagccccagctactcgggaggctgaggcaggagaatggtgtgaacccaggaggcagagcttgcagtgagcagagaccgtgccactgcactctagcctgggcaacaaagcaagactctgtctcaaacaaaaaaaaagaactgttttgtagaggacaaagtgtcacatttctgtagtggtcatcccttcactaggagactagcggcaaaaaaaaaaaatctgtctaaagctattgcaaagcaagcagccacaagaagtgagggtagctaggatccagctaagagtctgggtttctgagggtctaattccccaggtagacatggacctgcatgtaggaatctgaatgataaggccagcgtggcatggaatgctttatcaaagtttaaaagtgaaggaaccccttttactggaaaacaagtttcacaaacacccaatgttaacctccattaaagttgttacccaaatagatacaagtatatttttattaaaaactgcaaaactgataaacttaaattaatataatgtggtagaaaatattattttgctgcagctagttggttgctcataggtgaccatgctcatgaagtttctctggagtgtgcccactgatgctactaccacggaccaccacgggctatggggccaccatgggccgtgtgatgtggaatcctcccacatcctctcctcattcaacccaccttgaaacttttgtcctatggttccatgtgactttgggccttcacttggagcaaatacatcatttacttattactgattttttttttctcattggccaactctatgatcaacccaaacaggccttgtatctcagagtggtactcaatcataaagtggtcacttctgatctagggtgatgataacaagagagcacacgaacattacacgttttctcagccaactcacagacctccctgagaatacacccacagacagtgtgtatgtccctccttcctctttctgtccccagaaacattgctgtagaagaacactaactggggaatcaagagaacaatggcactctctatccacttgtggtcatcatctccactctctgggtgtcacgggtgaagtgagggagctgtctcagatctagatcatgtctagggcccttggcagatccaccttctataatgccattaatctctaataccctggggtgatgccaggaccatctctgggcaaaaggctcacataggctaagtgagcattcctaatgtatcttaaatcatggtgtttatctggacacgtggcttgtcctggtctctggactgaggcctttggcatgcttatgcagatgggagggtctgctacaggttgctctggccatgctgtgacaacgtgccctggaaaggtcctgaatatggctaattttggcagacaccagagcgcatccactgaagaagaaccgaaagatgaaaagccgggatttcaaccttgcattgatttcaaaacatgcaaaatgaattcaataaataggaaatcatttatgacacttgattttatttatcaaaacttaacattagctctacaatgagtaaaaatcaggatggagagtatggtaactaaaataagaaaaaaagagctccctttcttgattccataacagtaaatgtacattccagaacagagattatgacatggttatatttccagtatttagatccaatttattcaaataattgcaacctaattgtgtggagctattttaaatactgatttgctttgcttcccatttaaattaaaacctcatcacctgtgactattataccaaatatgttccttataatttagacaatgaaatattaattataattttgaaaattagctttgcttagatacaactgttctcaataacttttagtcttctgaaaaaggctcttaaagactgatccactaaacacattggttgtatccttttctatttcaattttctaacacacaaaaaaaaagtttatattttttgctgatattgtaagtcatttatttccatacttcataaagaagacaaaggaaaaatagtttttttgttataagcatgaaaagagtcccaggtcagaaattcaggctgggcatggtagctctcgcctataatccctgcactttgggaggccaacacaggaggatcacttgagcccaggagttcaaggccagcctgagcaacatggcaaaccccatctctaccaaaatacaaaaattagctcggtgtggtggcacacacctgtggtcccagctacttaggaggctgtggtgggaggatcgcttgagcccaggaggtcaaaactgcagtgagccaacatcatgtcactgattatatgattgcactccaatctgggcgactgagtgaacactgtctcaaaaaacaaaaaagaaaagaaatgtagtcccctgatctttgaaaagtcacatgacccctgggcttttgttgctacatccatccaatggagataaccccccttttcctgcaagaggcaggagctgtgcccaatggccttcagagcctgccagccctatattctcatagatacataatgtaggcaatagagcataatggctgtttttttaatcacaggtactactggccaggaaatagtgaatccaaaattcccgtaagagtctggaggtaggtggaaatacatagtgttattacacaaaaagcttcatgctgtgaaggccccacaggagaagacactgtcagtctagaaaggggatgacaacaggccaacaccattcgtttgaataagagttcttcccaattcctccctgtgaaaaatatagtcaggaaaaatggaaccgcactacatgtttttttattatgctttatactatgtggctccagaaggtgggctccataattctcaactcaaactcatgtcttcatgaaggcctatttccaagggcctctcacgcagcatgtgatgtagctcgccacgcatcagcctcgcaaagctggtgccccggacgcacagcccaccccagtgaattctgccttaacaaggcttagttcttccaccagggcaccaagtctcagctgccgtccaaattgttatgttgcacatttcatactctatttgtgagtagactaaagtcaataaaattagtaaattggctgaatttaataatttttaggtatgccaattcagtaactgttatataagctaaataaaatgatattcctctttttaaatttcctcgcttttattttaatgtctcttaaagtggcctcatgactcaatcaaaattttacatagctgaacacacagtggcttatgtctgtaatccctttgggaggctaagggaggagaatcactagaagccaggagttctagaccaggctgagcaatatagcgagactccctctacacccactcctgctgcccatctctacaaaaaattttaaaattagctgggcacaatgactatacatgtaattctagctactcaagaggctgaagatcgcttgagccaaggagttcgaggtcacattgtgtcactgcattccagcctgggggacaaagtgaaaccctgtctctaaaaaaatttatacacacacacacacacacacacatacacacacacataaaataatttacttacctagcatatgccactgaacaaagctaaaatatcctaaagtaggtaaaatttattgaataattatgcactgtatgcctggagaaggcctatggttaggatattttattttcattttgaacacgttatctaacaaaattatctagttgcatagcccaaataaattagaagctacacattagaaagaaaagtttttactaaaaaccagctcagtgatgtaagtgcagagagacatctggcttggaaagaagcaggaaaaatatatgaaagggagcaacatggagtcaagaagttggccactggaggccactggatggagttgggggtgagacggcaatgtcctagggcttctgttcagttactgcctgattctaaattaatgcccaagataatgcccttcagttacaacagagagggtaaattatattctgtgtgctctgctggtacgtatagtgtactgagggaccatttcttaaaaatgactgcaaagaataatatcagaatttaaagaataaacttcaggtatctgggaaactcatttaaagtaatttatcaaatgctaggtaaaggagctggtactatattttaaataattaaataatagtgaatataaacttactacattaaataatagtgaatataaacttactacagtgatttctagttggataatgtttacatctattatttcgtctctcaccccacgggtcattctccacctgcactactattccatcctcacctttgtttttgaacaaggaaaagccttgtgaaatcaagcaattaagtattcttttattattatgaagctgagaggaagtgaaaaatcaccagggtgaagtttcttcgcacttgagaaagcagattgatgaagctaacatgggatgcacgggaagtttgttcagaaccaaagcgactcggatgggcaccctctcagcctgtgggtgtcgcggaagaacgggatcaccctcccctcctgggccggaatgtgatatgaagagagcatcgctcccgagagacacaatggatagaaataataatggaaaggaaataaattcagaaagcaattaaggaactgtcaacagaaagggctgagcaaaaccagatatcaaaattaccatttaatcttttttcatgtatctttttggctcaaattactttcatatcagagttataattatggatatcaccacaagccattagcctcacagttggcactctccttacccccaacaaattaaatgtcagccatcgggcttcagccatcatcactccttcaagaagggctcctgtcaatcacctcactgcgtgtgatgagatgagccgcagcctcgaggcagaagcagccctctgcggtttggggtgctcggtagctcctgcagacacaaacgttctcttttgctttcctgatagagttccctgcaaatcctcagagaaacaccaaccccacactgggatggggcgtcagtcccttgagaagtgttatgggctgaattgcatccccccaaaatccatatattgaagtcccatccctcggtatgtcagaatgtcactgtatttgaagacaaagtctttaaggggtgatgagatgaaaaagaggccattagggtggggtcctggtccaacaggactactgcccttaaaaggaggagtcacaccagggatgcccatgccaggaggagaggccgtatgaggacacagtgaaaaggcagttgtttgcaagccaaggagaaaggcctcaggagaaaccaaacctgctgacacctaatctcagactcccaggctccagcactgtgagaaaataaatatctgctgtttaagccacccggtctgcggtgctttgttatgacgccttagctaactcatacaagaagtttctgcgtgtttccaagagtaaacaagtccttaaggacatcattactaagtgctcttactaagggttttaacactgcagatattaaaacaaaacaaaagtgataaataataactacatgagtacgcctaccatcagaaattactgcaatgacttcctgtttccccacagtttctcattgccctattttgatcattcctacataccgttgtcaaagtagaatcttcctaaagcacagcgttgaaaattgtattcacctgctgagaaaagtccactggattctcattgacgaccaaatgaaagtgtcatatgaggccctggagaggctggccccgatgctacttcccagccatgcccactgcaatacttcccacacttcccacctgctcccagccctgcccaccacaatactccccacacttcccacctgctcccaacaggaggatctgaggccacctggatgcacctggcctcaccctcactccttgccctttggttttttttttaacctggaaccatgggcctcttgagctcagaaagccttcccagccatgcctactacaatatttcccacacttcccacatgctcccaacaggatgatctggggccacctggatgcacctggcctgaccctcactccttgccctttgtttggtttttcttacttgggccttttgagctcagaaggctcccaaggggtctcagaatctattgaaattgcatataaaagggccgggcgcagtggctcacgcctgtaatcccagcactttgggaggccgaggcgggcggatcatgaggtcaggaaatcgagaccaacctagctaacactgtgaaaccccgtctctactaaaaataaaaaaaaattagctgggcatggtggcaggtgcctgtagtcccagctactcgggaggctgaggcaggagaatggtgtgaacccaggaggcggagcttgcagtgagccgagatcgcgccgctgccctccagcctgggcgacagagcgagactccgtctcaaaaaaacaaacaaacaaacaaaaaaaagaaattgcatataaataattactcctctctatacctgacctctttccagaaagagggctataattctcatcagattttcaaagagcttgacagcattgagttttacctgagccctgtacacctggaaaatagtgatggttgtgaaattgccatccctttgtattccaggaaacaacttactgcaaagaaccacccttccccatatgacttagataagactcaccaatgacccctttgacccccaaaggccagacacaaaaccctcaaattctcataaatgaatagctgaagctttgtccccattgacccatctgagcaagatacctgctaatgtgacttaaccaagcttgagtcttttctgccctgcgggtctttgaacttgatcccccctcagcctgagtcagcacgggaatgcagagtaacctccttaggagccacggactgtgttacaagctgaatcgtgtacccccaaaagaagatttgttgatgttgtaatccccagtacctcagaatgtggatttttttggaaacagggtctttgtggacatagttagatatgatgaggtcatactaattagtgtgggtcatggatgcctgcatgactggcttccttataagaagagaagaagagacagagacacagaagctggagacagacaagggagtgatccatccatgagccaaagaatgccaagaattgcaggcaacaccagaagccaggagagaggcttggaacagattcctccaaaaggaaacaatcttgccaacatgttgatttcagactcctggcctccaaaactgtgagagaataaattactgttgtttaagccactgagtttgtggcactttgcacagaggccccaggaatctactacaaccaaggaaagacatctggtcaaccgttggtttgtgccacctgctcatccttactcctccaccctaggtctttccagcatgtttaatcctccctacaaaagaaagttcctttctgcctgacctttgagactctcgcagacctcatggtgggagcattctccctattgcgcaatagtcccctcctctaattgtaaaagctccccctcgccctacgacaatcaccgctttcgatgaagtctctccttacctaagcccgggctgtttttttctttgacaagctctatggtccataagtggttaagaaccagtgctcctcatgagctaatctccacccaccttctttgcaacttaccttagcttccgccatgctgcctggccatttcccctcaaatccttgcctgctccccctcccatcagcaggaaggagcctttccaagtctaccattggtaaagggatagtgtgtgttccccacccccatacctacttgttttccaagatccctgcccccagcccaggcagccgggcatgagctacttgtccttaggggaggcctgctactgggagcccgagaaggcaggcacagaatcctggcatttgagtttcaaaaccacaataaggaagaagacagaaattgttggacaagtccttgatcgctactgcagactacagaaagactccatgggctgaggctgggaggtgggcacagagctgctgtcattggagtgagcactgttgtcaccagcatcaggtgagtggggacctatggatatctggtcccactgcagtgggtgctgccttagggcattgcttcccatcccagagccaaggaacccccagctccttccacctctgcttctctccctgctgcacacattcctctctaagaatcacatgcttcaatgcttaaaggaaagtcctaaacagatgtcccatattatccatgaactgggacaatcaggcctcacgtgaataaccaacagccatggtggggcttcacggaatcacagaggtcctgggttggaatggactttaaaagtcttaaaatccagctccccagccaccccagctgcttcacaaaaatttttcagacagtgtttataaaagtctcttgagcaagtgaaagaatttgttgcagacacaacagaaagctggggtcagctagttgttcctcctgagcacctgctaaagagatgcatcaggaaaatgaaacagcagggaaggcaggtaagaatataacaaaaggaaaacacaactctaagttaaaagtgaagttaagaaagagaaaaaagcaggaagatggagtaagccacgagaaaacttaaaggttcctaaatcctatgctagcagctcaaatctctcattaacagacaggaaatattctgcagcaagacacctactagaaaaatactaaaggaacctaaaagtccgttcttcaacattttacccattttctcttccttgcactaaaaagtaaaaaggtgagtctctggaacaatataataaactaaaaaaaaaatagttaaataatggctttaagagactttccaaacttttctccaaaaccagaaatacactaatgttttcctacctccagcaaattaacagggcataaaatagttcctgtcttaaatagtacttaaatagtagcgtgtcctgatttcaacaagatcaggtacgtttgcctgcatgcaatcagcagttttcaccaatgctaaaataacccgaaatcgtttttctctctgcattttttagactatgacattccaccctcactcccaggcagtcttgacagagccagagttgagctacataacacctttgtatttgtgtacatttctggaggctacacaaattatcatttcaaatcatccctcttaattttcctgctgaggttagctcaatggactctgggactccaatttctattacttcttttttagtcaatttcctcagatttcaaatatgtaagcaaaatctcctaaagtatttctacatgagggtgagaaattcgctattatttcattttactctttatattatttcattttattattttgttttattatatattgaagataaatatgagaagattttataggatgatggtatttctttaaaataaacccctaagcccaaggctaaatagaaattgcgatcaaatcaaggaaaatcacataaagcaaattcagaaaaatctgcttcctcagtgtagctctcttgtattttacaatgtagctctcttgtattttattttcatggaaaatcaccgggggctgggaggggtggcaggaggaagctctccctcttcccagttgttcttctttccatctaatcccacactttcccttctgacacctgcttcccgattccactcccttactgccaccttctcacatccttaccaacatctactgacacctcccccatcaacccagcctcctccactgctcaggtgaacaaagctgtcatggccagaatggagcatgaaggcccggtcaccgagtcatatcaaaggccagaaaacaagggagacggaggggagcgggctcaagggccagaggaaagctccacttctgcctaggtaggatttaagctctagaaccaacaaagagcctcttatcaaaagcttacagattatataagttgggcacattatcaataggaaacataattatggaagaaatgaatgtgagtttgaatgaagaggagagcataggggtagggcaggaaagttgtcctaagtattggaaaccacttaccgtgagccttggtagcaggaatgcaataggtggcattgaaggacagcaaaaaggtccagtttggctagactggagggagagttgaaagagttcacaggtatggaaaggccagaaggactgtctactatgcaactttgtttttgttgtttttgttgttgttgttgttgtttgttttttgttttttttttgagatggagtctcgctcttttgcccaggccggactgcagtggcgctatctcggctcactgcaagctccgcctcccgggttcacgccattctcctgcctcagcctcctgagtagctgggattacaggcacccacaacagtgcctggctaattttttgtatttttagtagagacggggtttcaccgtgttagccaagatggtcgcgatctcccgacctcgtgatccgcctgcctcggcctcccaaagtgctgggattacaggcgtgagccaccgtgcccggcctactatgcaacttcaatgacataggttggagtagaagtttcttttgcatccaaaggctaagggggaaatattgagtgaaggaggaacgcaatccgctgttcaaaccattacatgcaactccgaacaactcatcagaaactaggatgtatctcatgatctaagaaaaatttgtacagactaatttttctttaattttagaaataggaaagatagacaaagcacaaatttagcagtttctcccatgtgcttatacaaccattattcaaacatattaccagaagtagttacagagaatcgggcaattacagagaatcaatgttcctttcattgtaagggcctaatgaaagggctggaacatgctgaaactataaaagaagcaacattttcctataccccatctgcctgtttgggaaataataccagcttttcccatataaagtaaattaataaatcaatacaaccaacaaaaaggcagcattggtaggagatattttaattgagtcatcctaaagtctggacttgtttaaagccttctcactttaaataaatatcaagtcatttaagttttgaaactgactttgaattcagtacatacaacatattgtccacacagtaaagaagagagcatgcagaaatgcctgtttgaaaataaaagaaatatccaactcaagtcacctttaaaaaaccaccagggcattttagagctgatgagaatgacagagatcatggggtcgaaccctgttatcaatcacgttggaaaactgaggtcaagggatgttaataactcaacccaagtctcagagcaggcaacacatttttcttttcactgaagtgcatggtcccaatgaatttatcagaatgtctctttgtatgcagtgtaaatctttatggtacctcaacttgtacttctagtccccttccaattagccaccagaaacaatatctagtgccagcctcagacaaagaccctgtgagatatccacacaaatgcttcactctctcaattctttcctcacaataagcacctacagatgcagactgcgaatatctgtaatttaataaacacacatcaccctgtattttataaatataactagttacaagatagaaaaggaaaatagctcaacaggtcacctaaaatcagatagttctgtttatttcacaactttagacataacagatttcaattaataaagacttttcctaatttttataaaagcttaaccacttggtacccaacctttctagacttctggtttagtgccagctccagaagaaaacaatttttaaatatttgaagcaactaaacaggtatttaccacctattaacaatgaacaaaaccaaggaaggaaataaagacacaaagattgcatcaatgaaaccatgatcaggatgccatgtggaagaaagagaggtctgattaacaagcgaagccttatagatggcaatttgtttgctgaaaaaacaagactcccagtaaaaacaagctgtgaccagcaagtttactgtaagcagcaagttgtaagtgtgactagggaaggagagagtccctcacaagcaggaaatgagagaagagctaggaaccccaggcaagttggaggtaataaagggattaggcagtgaaattgcatctatagccccaggggcactgcagtggtgagaggcagcaggcggtattttccaacatggcgcaacaatggttcccaccacacatcctcttctgctgagtgacattgccactttccaatcaggaggtagagtccttttctcccctctcttacacatgggcaggcctgtggctgctctgaccaatagagcagggtagaccatcatgccaggtccaggaaggccctcgcctggtccagtagctactacttcctgcctcttggaagacagctactgtgttggaactgaggctatccaaaaaccaccatgctgggagaagcctacaccacatggagatgccctgaagcatgagacaccgaggtgagcggcagaggaggggaaatagatcaaacagtaccagggcaccagctgtaggaaggaggaagtcatcaaagtcatatatccacagtttcaggcactcctgctggtgtctcatgcaccagagacaaattcctcaacagagccctttccgaatgtccaacccataaaattgtgagcaaaataaaatggcagtttcagacaactaagttttggggtaatttgttacacagaaatagacaccaaaaacacgggaacacggtagtaacaactaagtgttgcagagaggccattttcaactgattttgaacgactgggccttttgtccaaaagatatcttataagaaccccaaaatattcaacagaaataaccagagctgctctgacgcggtggacaagggtgtccagaatgtcaaggagctctgtggtggaatgaaggatgatcctagggccagtgcactgaccatggtaacgctacagagaggacctgcaatcctcacccaagaagtcatcactgcaacccagcttcctgaggcagtgtctaaatgtaagtcaacagctcgtaatcttaccctctgcagccagagggaacctagttctaacatcaagagttggaaccccggacatcaaaaaggtactacccctggtctagcctcttctttgtctcaggatctgaccactgacgtttccatcttgcagtgtgactgcttcccctaacatattttcaccctaatcttaacatgtgtttaaaaataccaacaccccctcaccctgctccttcctcttttcttcttctctccactcactgttttttgctctcagggaaaggagcaagaaaaagaaatgggacagtgttttgcctggtggttggctgattagactctgaatctcagctctgtagattgccataccaaatttgccaatttagtaactgtgcctctgttttccaagctgcaaattggctgcaatcatcatacaaaccctgctcattgaattgtaagactgaaatgaattcatatgtgatagtcagcactcaataaatgttaggtcatcattatttttctaactaaaccttaatgctttccaatattctagtaaggaggaatttatagataatgcctgagatgcaccataaagaacaaaactcttacatatgattagacttatataggtctctttacattttactaaggaggacttacttaggtggctcaacagcactgtagtcactatgtggagacctcattgggcagaaatggtaacgagagctttctgaattgttgcccccatttgaatcagccaagttagcaactccagggtgccagtttgagtgagtcagcccttaaaagacccttgagcaatacatggagtcaagtgtctcagacaggcagtcagctgtggggcttccagtcatcccaaaatgaaaatgttcttattacgaagacttggaaaatggcaaacaaaagaaatcacaattttgattcatttaccctgtatcaaagcattcacgtttgaaaagtcttcgctgggcattctgggacagcacccagaaatgcagtgaggtggcattctgaatatttgtccctctgtgaccgcatctgtaggtgactttatctttgatagatggatctttaaaacaacatttattgtggttgcttcttgatcatatgcagtaacttgggcattttcagaaagggtgaccaagaagcatccaacacaatattagaaggttattatgactggcagaaaatatgtctcaaattaggagcacacagaatgtgtgcctcttttagcaatctcatctataggcacaatctattatccctaatcattttccaatgtttttgttggcagtttatctatcttctattttaatggataattacataaaaagcatgttaagcttcagcagaatttattcattcattcaacaccaactataaaaagagaccctagaagtgttatagactcacaaaaaataaaaccttctgggccaggaatggtggctcttgcctgtaatcccagcactttgggagactgagatgagaggatcaccggaggtcaggagtttgagaccagcctggccaacatggcaaaaccctgtctctactaaaaatacagaaattagccgggtatgctggcacatttctgtgatcccagctactcaggaggctgaggcaggagaattgcttgaacccggaaggcagaggttgcagtgagccgagatggtgtcactgcaccccagcctgggcgacagagtgagagactccatctcaaaataataataataataataataataataataataataataataaaatcttctggcagatgtttaaaatatgtctcatttacccatggcacagggatcgcaagctaatatatatatttggacagaggctttttattgacagcatctcattttcttttttaaaagaaaaatcaactttttagattcagagggtacatgtgcaggtttgttacaaggacatatgcgatgctgaggtttggggtatgattgatcccatcacccaggtagtgagcatagtatccactaggtcatttttcaacccttgccccccttcctgcctccccactcttgtagtccccaatgtctatttttacatctttatgtccactgtacccagtatttagctcccacttataagtgagaacatgtggcatttggttttttgttcctgtgtcaattcacttaagataatggcctccagctgcatccatgttgctggaaaggacatgatttcattcttttttatggctgtgtagtattccatggtgtatgtgtaccatattttctttatccaatccaccactgatgggcacctgggttgattgcatgtctttgctatcacgaatagcactgtgacaaacatgagtatatgtgtctttttggtagaataatttattttcctttgggtatacacccagtaatgggcttgctgagtcaaatggtagttccacttttagggaaagcaccttattttattttcatacctgcagggaaaaaaaaaacatttaaagacattggctggcctggaaaagaccagctaacttacgcatggggcttgccccaggtgcaatgtttgtggctacaagtgtttcctgatcattttcctgtaccccagtgatttcttggagcagaggtttctttgaaagccatcatagagtccctagaagaactctcttctactctgagctcccctccagcttcttcttaaaatatagaaagaagatgtctggaggaagacacttcacattgctgatggagctttcttggggagtagaattagatcagaagaaagaaaatggaagacttcttactttatgtactcctgcatactgagcattattattttcataatttaaaaaatatatattttaaggattactgaaactttcagggctctgattttctcacctgaaaagtgacaaccccagaccatgaactaaatgatatgaagataacacttccagttcttaaattctgcaccagaaatgcctgctgcacagccagtcaccagtgcttccatctccacatcttcacgaaagagcaaaagaaaagacatggaagtaacttaattgctcagtgcctcagtttcctcatctgcaaaatggaaatcataacagcatctgcctcatagggttgtcttaagaattaaacgagctaacaaaagtaactggcacacggagctcaaatgtcagcgagaattatttccattatggtcactcttattactaattctatatcaaccaataaaatattcctgccagtatttttcctaacccaataaactctgcactacagaacttttagagctaatataaagtactcttgtcaaaatatagcgctgtgaatgtctctttaattaaaacttcagcagcaaaggcagtgccattgaacagaagataccacttttagctgataaggatgagaagtcaaacattgtatcacttcaataccagccaaaatattattaaagaaagcattccaatatcctaaggattctggaaacactgcttctaagaagcctgcaaattcaaagttactcatgtttttaattaacatattacaaaacattgagtaggagactctgacacattcaatctaaagctaaataaacactaactataatatagcgcttgcatactaagaaactcagcagctcacaaagcacatctttgtgactaaatggagcatcttaagaactcaatttcacaaacatttactaaggcttgtctccttaataaagcactaactggtacacaaatatctatgcttccaaaatcaagatgcagatttcattcatttacaatcaaagttcaggcaggaatttttgtgcaggatgggaggctggagcaactcaccaaataattataaatgtcatgtaccaaggagaggataagaacataaagaaagttctgaaagaattacaaagcagtactatttagactgcagtgttaacataggtagtccagatcacaaaaatataaatatcagcccagagatgatattaattagtaaacaaactagtatttgccacaaagtgttaacatttttctcaactaaaacaataagaaaatattaggcccaaatcttcaaaggatctaaaaagataattcacaaaataaaagctctagagtgagcaaacatggggaaaagctcaagtttaccagtaactaaaaatgcaaactgaaaaaagatagccgctttccctactaaattagcaagaataaattaatgaataattattattgtatcaaatgtcagcaactgttctgtaaaactgatctcaacattacctatgatgttgtaaattggtacccttctttaggaaacctatgagacaataagtaaataagtgacataagtaatctttaatttcataagagaaaatctataagttcaaagctgaatgtcaaaaaatgtcttaatggtaaatttcaggacaactgaatgtatgacactagataatggttgagccagttctggtacaatgaccacgtggagtatggcaactgttaaaaaacagaagccccctctaaaacaatacagaaaatgtaaataatggtgtgttaaggaaagaagcaggatataaaatcattcacctatcacacttacaactttgttaaatattttgaatatctctagggaataaacaaaaattattggagttatatttgggtcatggatatttttctctttcttgctaaacataatggtgttatgccaccttatttttaaaaataaaaaatacattgtgggaactaaacaactaagatagtagaatttctttagaaaatctaaaatgaatccaaagtaatataaacaatgatttaagattttagcagacaaaaaattaaatcccaagtatgaaaggtgaaacaaagccacaatgtgaaatctagtcaggcaggctggaacagaaagcatagctccttgcaagcctgggtgagcatgcctgtccagcagcagcccgttcagggcctgttcccaagagctgggacatagtggacagcaggcgcccaaaccaccctgtttcccggcaccactgggtaagagcatccacatccaagagaggtgcgctccagccagaagtacatagagcagcgtctctgggcaaggcgtcctccctctagactccttctctgaaggttcttaacgcaggtcacagaagcactattttattcatgcaccttacagacagcctgaagccaagcacataggcaactggcttagaaaataggataccagaatatttatccaagtaaaaacactgtgaagactgagtttaagtagtaaattatgtaggctggcacccagcaggctgtgactttgtcctctcctaagggacaatgacacccatgcacagcctatggaaatgagaaagaaggcagcttaaggaggcagaagatgaaattaaatgtagaccatggttgtaactttcgttaaaaatattgaacaaatatgcatatagaataagcaaaaaaattataatagctatgtctgagttatggactttttccttctttccttccttccttccttccttccttctttccttcattcctttctccaagctttctctgaaatattatctcattctgtgaggaggaaattgagaggcagtgggtgaaatatcccaataaattccactgtactctcgccacactactgcagcatttctcacttaacaaatttgaggaaatgatttttctcatgcagttacattgtattgggaataattctgaaaatggtataattttacttctgaattctagaaacatatactcaaaaaagagaaaaacaaaagcattacattttgtaaggatgtaattacatccggaatttgcttttggagctattttgaacttataatgtaaggctcaaggagaaaccactttttcttaaaaaaaatagattggcatttagtgccatttcacagtctgggcagaattgggaactggggaattgcccgtcttttctgctctggtggctttacaaggctgccggcccaaaggagtctgtcatcaccatggcaacctggctcagcatcctctgcgagcgggaaggaggggctgcctcccttgtcaggttcacagcacccggccacttgtccccttctggcacctgaaatgccctttccccccaccaatggaaacccttcagggcccaacccaaatccttcttccgcgaggtcttttccttaacttttgagaacagcagtgaccctcttctttgaaccacatctaatgacagcttgactgtcagtttttcatctcaagctccagtgaggctggtagcagtgtctgtgttgacacaattccatgcaaggttgatattcagtccatttgttcaaggcaaccattccaattgttaacacagtgaaatacttccattcttccatgctgccctgagcacccctcccttcccctctccccatgcctgttccctggatgctctggctttttcctgggaactccttctgtctcctcggcagcaaccaaggggttcatgcctagtacagcaggagacctccagccctctggccagggtcagctctgactggtcaaacaataccacatgttaaatgttctgaccacggccctttctatggatgcactaaggtcccacaggaaaaaaaaaaaaaaaaaaaaaaaactcccatattgattagcaatgtctaccaagggtacaaagaggaagaggggccggcacactgtatgatactgatctgattagatgtctgcagcatttaggctggcacttcagtattgacacaagtctcaatgtctttattcctcacatgcaggaaaggcaactgaaggagggaagaggagcataaagggaagaggaagttagcccatagcataattggaatggttttgtattttttgtgagcagcctgcactgcacaatcaattgaatcaactgtcagttcagaaggagcctgatagtgatcattttacttcctattcacaatgtccataggagcaccatttcctaaatatgctgggaaataatcattatattaataacaacagcaaaaatagtattttgtacaacatttaccatgtactggtaacaaaagcaaaacaaatattttgtgtagtgtttgccatgtactgggcactgttctgtgcatgttataggtattaacttacttaatcctcaaaaaaactctgagggttattttatagaaaatatttttatattatatatattttttatattgttattttagttgacgttttacagagtaagaaactgaggtacaaaaaagttaagtaatttggccatggttacaaactcagaaaagacagaaccaggatttgaacccaggccatcttcttcagaggccacattctcccgtggcacaccgtaactcctccaaggcattgtttgctggtgcaaaccgtttgtaccagcatatcgtactcagcgttttcctgactgaagcaaaatgagaacagcttcccaacaaactcctgagctgcccaatgcacagttctcctcacatccaacagctgggctcagtccctcagaatccctgagtcagaagcacccctgtgctccctgccctggttgcaagccaagccagtggcacagaggtgccaagtcatagggaagatagtgttcaactggcacaaaaagtcctatctggaccaaggggtgaacagaaggcaccctcgagaagacaggatagatggggaaacaggaaatgctgaggagggaaagacagagtgcatgagagagtcccaaatctaggaaggacctggtgcaagtcctgcgtcttactgactaggtccagagagaggatggggcttgtccaaaagcgtagctcactaacaataagacttaactaaatttcaagttccttgaaatcatgagacttgaatcacaagacttgaaatgtccctaagtcatgttgcatcagtacagctaacaaggtatgaacttgttcccccaaaccagttttccccctctacttaggcacagctatagactacatttaccagactcctttgcagttgggtgtggtcacatgaatgagctaatcaatggaatgtaagaggaaggcacaggtaccagatccaggcctggccatacaaacctccctgactggctccttcttggtcattctccttcccactgaccagaatgaaacccctgtgtgatcttgaataaagttgcagagctttctttaatttgatccctgaaatgactgagtggaactgacactctccaaaaaataaaaataaaacaaaaatcagccatgatcacctggaactgccctggactaccactattcaagtgagaaacttctgtgaggaaccattacaggtttgggtccatctgttttctcacccatcccactctaactaaggaaaagttccagctgatcttccccaacccactcccatcccctcaacacacacacacatacttacatctgtcatcaatcatttaattcataaaatggtaatacaatatctacccaaccccatcagtttagaattgttgaatggggtatttaaagttacaaaacataacaagcttccattcattccattttgtttgacaattaactattagtttagtttgatattaaatatgctttagtctttactcttggtccatagtggtgtgctgaagttggttcattgccaattgcgaggcaattttcaggaattttgtgagctgttgttaagagcaaacattataaatgttaaagtaagcacttacattaaattatactaaaagcaaaggtaatgcatactcaaaacccatctcttcctaaatattttactgcagtttatcatccacactcttgaaattattggcatctattgtagccataggatggaaattctatgtaatggtgctctagcgtgtatctcttcccaactctgcattcagagacatcaccttggtagcttgaaatcagctgtatggggcatatttgcaatgtagaaattggcaaagactacaaatcaagtgcgttttttttctttttgctggagagtcagctgttaaatatttaccactgctctaaggaaaaagcagccttgaacatcatcctcttaattattttctacagacatggaggcatttggccatttgttaatatggaaataccatcatgttttatttgtaccttttacttaacttggtttatttcaaaaattaccaagttgctttaagaaaattatttaatattcctattaccatggaaataattggaatagatgccacataaaacatattagtggaaacttgaattcattatctgtgttctattcagagctaatgaggatttttcttccttaaattatgaacaatcctttaaaaccaaagctaatacgagagagggaaaaaattacagtggtttatatatcaattcttccccaactgatttatagatttcacgcaatcctagtcacaatcctagcaggcttttttatagagattgaaaaaatattttatagacagtctaaaatttatgtggaacctcataaagaacttaaaagaaccaaccattttttaaaagaatgagttaagaggacttaaactatctaatttcataattgcagtctagtacagattacctatagtaatcaaagcagtatagtattcacctaaaggcagacaaaatagatcagtagggaagagtccagaaatagacacaaatgcatgattttcagcaaaggtgccaaagcaatttatggggaaagaatactcttttcaacaaatggtgcgggacaactgaatacccgtatgaaaaacattcgcttggtgcacaaatctccttttcaacctgcacattttgacatgcagtgtgcctgagtggaagggcagaaagagagacctaaaaagggtatcttccctcactatatgaatttaattccaactagaagacacagggatattttctgttctaattatttaaataaattgatcaagtgcaggactcatttatctactgggacctgcaaaacctatagccaaaagtccaaaataaaaatattacttagaattatatcctttcactactaagacatatagtcatttatttgggacaaactacaaagcaatctacaaaactatatcggtaaaacccacctcacagattaagaaaataaattccaaagaaattaggttcctaatccaaaaacaccaaaagcctcaaggccaggtctccaggcttctgctctgctgcttgaatccaatgggtttctcaatgtctatgaccacctggactcacctgacgcagagcccctggggaattcctataaatgtgactccccagttttctgaatggcagtgtctgggagtgaggttaggtttataccctgaacactcccttcaggtgataccaacacacatctctatgaccataccatgtggactcaaagaaaagcatttagaaaccagacaaagctatgggaaaccagcttttagaaatgagaaaatagggttttttctcataagcaccaattattttagactgttttccctccaaccattttatttgtttgtttgtttttgagatggagtctcactctgtcacccaggttggagtgcagtggtgagatctcggctcactgcaaactccacctcccgggttcaagcgattctcctgcctcagcctcctgagtagctgggattacaggtgtccatcaccacgcctggctaacttttgtatttttagtaggacagggttttggcatgttggccaggctggtcttgaactcctgacttcaagtgatctgcccacctcggcctcccaaagtgctgggattacaggcatgagccaccactcccggcttcctccaaccattttaaatattttgaaatctcttcttgaaacactcaaggacattccacaaagaataaaaataatgattcctaaatgcattataaaactaagcttttgagggtttatatttgcatctggaaaaatagctaagagcaatgctcagataagactggggcttcagacccaatcctcacagacatcaagcagctggccaccaaaggactgggccaggaagtcaagataggagcaaaaatcggccaggatgcagcgaagaacccaagggcaggcccttgaatgatgatccagtgtcggactcaggagctcataggacttgcacattttcactgataaaataacccagaatgcaagctctggctttgtcctccaagggacaaccctccatttgaacttggatcttaattacaagcatatatttatgaaggagcccttgaagaaaaactgtactgagaaagggaaacatcagcagaagtccttctcccatagccccaaatactgatttcttttcacagcttacaggagtacttgtccttgctactgcaccactgaaattatagcaccttgaggaggctaatttaaagggttacaagacaaaacaaaaacaactataaaaggctaatatcagcccaagtgtgctttcgtgaagtaaagtcaacacaatttcagctctatcgtggcaggccttcgcctcctctgttctcagctctgatttgcatgtttcaggattacattacaatgcaatacttcccactcacgaagtcatagctttgttgaaaggattagtatagaaatgtgccaaattatttaaagatatctgaatagtgagcaaaacattatcatcagatgatacaggaggagaaaagtagctcagtacaacctgtaaaaaagctgtcacagaaatacctttctctctactcatgtggtatgaggagtttgcctatgtgagactattcaaaatatctgtgataattcctggaatcaaaaaatatttcaaatcagtttagctttactcaacttcttctcaatcatggtacaccaggaaagaaagagaaggatatcaaaacatgttctacgcgtctgaggttgacagtttctcagaacaatgtgtgcacaataaaattgaggcaacatcaggaagtaaatggcagagggttcactggagccatgaatggattgctggacagtgtgctgaggacctagcggaagttggagaccatgaatatacagcagcatcagtgtcatggatgggcagttttctctggcagaactccagggttttggatagaaaaggtcaacacctgaacaacactgagttgcggttcggctgagtaggtgcagcagaatgtccaaaggggtgagggagctgagagtatgggcaagagattggctcaatggagcacatggcttccactagcaagcaggaagagaaggtggaaaagagttgtcttgggtctggaaggggctaggtgggagaaaataaagccttaaaggccctagaggtcttgttgaagttgaaggacagatgcaggaggaataaatgagccaggagctggaggatgcatggtaatggtatggacaggacactgcaaacagaaatatcggaagtcaacagttctagggatcactttgtccaacacgcagtcgtgagcaaggctgactgaactggagtgggggtgaggttagaggcagctgaggggacacagccacagtgaggctggagagttggatggatctttaatagtatgttgcattgaaaccagtgtcaccaggacttagaggtggagaagaaaacaaaatcagacatgacagattttgaggaatgtggggatatgacagagtagagtttacggcaggaaaagctcccaaagagtacaattttttacacagatgcaaatgcaaaagaacaatagtttcaagttatattgggaatctagaagaattttccctccccccgccccacacacacacacttgctcacctagttaatttcataccccagatctgtgaccccagagactttttaaaacaaatgacctttctagacagggaagtagagaactacaatgttggtcctctgatccattagcaatattgcaaccttcatactgggaaaaatgaagcaggtagatatatgctaatgaatagacttccaagaaaagaaataaaaatcaaaaaggaaaaacatgaagacaaccctctgggacatttaaatttttcttttaaaggaagttgagaaataatataaaatcctgcatttcagtgaagaaagcaggttggtctcctctttacttctcagctccctctggtggaatactgatttttatggtatgccccgtgaaatcaaaagaccctagaggtctggccaaccttccacattccgagatataacattagggtgtcaggattggaaagagagagaaagtaatcagagaagggagaaacaaggaacacacctgtggaagaagcagcgagaaatagtgaagaaatatgattataaaagtctcacttgtatcacttttaatatttttattgcattaaacatagtctattaccttatattgaaatactgctaaattattaacttgtctttaaattgattttcctagtattgggaataaggtttcattcaaagggggaaagtacctaagacattttactgtagcttttagagaaatcactaatatttctctaaattctgctttttcaatcccaacaattattttcatttttacccgagaaacaattcacctgaggaaatgcactccttctctaataatgagaaagccactttgacagagtttgtacaaagttttgcaaagaggcatcaattccccctgcagtgacagacgcccgctgaaaatactatgggaaaaaaagcaaagtgaaatggtttagattggcctgttgggcataaacatcaaggtctgacaaggtcagtgactccagaagctacaacacatggcagaaaaacatgaccagggcagtctggctgacctctggctcctgaccagagaggaacaagagaagcccttccctgaagccaggtgagtcacggaagtggcagggccttgagtgagccactgcccttcctgtaaggagattgtgtaaaaagtgcccatatggctcctctgcagacagaacttttggacttcctcaacagatatttgcaataaaatccagcttctctctacatcacaccaaatcttctctagggtataaacatcccctataaatgcagagaaccaacaattgaacaaaatattccagtagtggcctgagtaggatccaatgtagtgagagcattactttcatattacttgaggccatggagggccagggaagcacatagaatatggaagcttaaaaaataatactaaggggtcaggcacagtggctcatgactgcaggcccagcactttgggaggcgggtggatcacttgttcgagaccaggctgggtggtctcgagagatggtgaaaccccatctctacaaaagcatacagaaattacccaggcatcatagcattcacctttactcccacctactcaggaggctgaggtgggaggatcccttgagcccgggaaatggaggttgcagtgaaccaagatcatgccactgcactccagcctgggtgagagagtgagcccctgtctcaaaaataataataataataaggaatttgaatagtgtagtggtctcaggaggtactacctatgtggtcttaggcaagttatatcctttatgggcctcagtttcccagtgaatactgtgatgacacctatcttaagctgtctgcctgaatcaaaggagatgtttgtgaaagaagtcttgtagtttggaaagcattacacacttagaattagcgcatggatttcattgattagcaggataatccctgcccagtcttgaactgggagaggaagctgcatagcagataggagcacaggccctgaaacaggtctgcctggtcttccatcccagctctgcaactttctagctgtcaaaccttgggtaggttacttaggctacctgtacctcagtttcctcactggtatcatggagatgatgatcatgatagtaacaatgcctacctggtagagttgccaggattaagtttaaatccgtggaaagtgcctaacagcccggaaaagaattgggcatcagtaaatgttgacttatgttatcacaatgcatggagcatcatttttgccatacttagccattttcttacattttatctctgtatcattttctttccttgtttatgctccaaagcagtcccttcattttgtgattttctttttaatttctcagagtcaattatcttcttaccttcccagatgatggttgcctaacgttgtctcaaagaaccttgaagggtaagaaccacgcaaatgcccctcatcaccacttcagtgctttgcaccaagcagacactcagcaaatgcctcattggcttgcacagctgtgactgttcatgatgcagactagtgaacacccagacaatgccagcccagggatcagccctgcacctgcccccaaatttcccaaatgtcatggatcactacacttttattaatttttaatttttaatttttgtgggtacctagtagttgtatatatttatgaggtacatgagatgttttgatacaggcatgcaatgtgtgataatcatatcgtggaaaatggggtatccatcccctcaagcatggtcactatactttgcttaaataccctccatccatcaagtatgatgactgtcttgctttctctttttttttttttttttttttttttttgagctggagtctcactgtgtctcccaggctggagtgcagtggtgtgatctcagctcactgcaacctccacctcccgggttcaagcaattctcctacctcagcctcctgtaatcccagctacgcggaaggcacctaccaccacgccaagctaattttcatatttttagtagagatggggttttgccatgttggccaagctggtctctacctcctgacctcaggtgatctgcccgcctcagcctcccaaagtgctgggatttttgaagagagtttatttttcagtattgtgttaagtatagatgctcccaaactcaagggtcacctgagagttacagctgcaggtttctaaggctctttcatcctgacaattaagagaagatgaatgcaccattccttagatcatcaggagtgactacagagatgtttatgctgaatttatggctctaatttttaaactgtaatgggtatttcaatcacaacactgcacaacccatcagctgtaaatattgctttatgaagtaaagatgagtaatcggtaactgttgacatctgcagggtgtttgttgacacaaatagagctaaatccagacccttaggatggcactagtccattgaatccaagttgaagaagccatggcattagtgcctttagtagaaaaaaaaaaatttaagagacaggatctcactccttcacccaggctggagtacagtggcatgatcaatctcctgggcccaagcaatcatcctgcctaagcttcctgagtagctaggactataggcacacaccaccacacccggttaaattttttttatttgtatttttttctaagaaattgggtcttgctatgttgctcaggctagtctcaaactcctagcctcaaaggatcctcctgcttcagccttccaaagtgctgggattgtagacatgcatctggcccaggaaaatttttaaagcattttgtattggatattgaacaagcaagaagtccagaatatttgctactaacgtagcaagtcatagttaataggtgaacaggatcaaacttatgctaaacaacattgtagatccctctcaatctgttcttctgggacaactgaagttcttatgagccctagaaataggccatgcattttgcccaaactgagttgcacgttcttttagctactgcaaatatgttcaccaatctgtcaatagtacctgaaatgtaggacgactgtaatttatccttcaaatcaggtcacctttagagcaaaaggggtgctattaataattacaaggagatgaaccaggaacatggtcaccctgtataaaagctggtggagaattaacgtcatctggcctgatggaacagttttactttgagcttctttcattcatccactcagtaaaatatttcctgaccttgtgccaagtcctgtgcaaggcactgaggagaaccgtgatgaaggagctgtcagtcctcactctgcagaggaagccatcaggagcattcctgagcccaggtgtcaagtgtaagcagagcagacacaaacaactatatgcacacagtcctgagagccacagttgggaaaagaggtctagttctccccaaggaaatcaaccagaaataagttgtctgggggaatctattccttcagccactttgccgggagaccaaggggtggatgaattccctgacaatgtggattctaatcttttttctgttgctgcctgaatctaacttttggcagctccctctctgtatttctctcctttccatgccttctatgaaagctgcaccaagtaaataaaaccagaggttatgcatccggtaatcctgtcccgagtgtgattattttccacttctaattttaaggcgtcattataagaagtggcaatgactaaacaagtcccaacaagcacagactagcatattgcttggattgccaagaaaaaaatgtgtaataaataataaaatcgccaaaaaacgatttggaaaagcattgtaaacacagatggcttgcaatgcaaaaatatataatgttgtatctgtttaatgcagaatcccaaacatcaaaactgataagtcaaacaaccataaatttgcatttgtattttgctgatgctgaccaagtacattatgcttgtgtatgcagttgtgcagttgacagaacttatggaggaaaaggcttgagccagccatctctgagttactaataggatgaactaaacttctgacagatgctcgttacacaacattacactcaggctctccacaggaataaaaatcaacaatataaaagcaaaagcaaccaaactctacaagtatttttgaccttgtgttattggcacaaccttctgacatccacttactgaatgcacactctgtgccaggcctaggccaggtcctcagggtccacggtgaaccagacaaggtccctgcctcatggaacttacatgcaggaggccagagacaatagaaaagcaaataataaatatttaatatcaagcaatgctagtagtaaaaagaaaaataaaacagagtggccaggcatggtggctcacacctgtaatcccagcactttgggaggccaaggtgggtggatcacaaggtcaagagatcgcgaccatcctggccaacatggtgaaaacccgtctctactaaaaatgcaaaacttagctgggcatggtggcacacgcccgtagtcccagctacttgggaggctgaggcaggagaatcgcttgaacccaggaggaggaggttgcagtgagccaagattgcaccactgcactccagcctgggcgacagagcaagactctgtctcaaaataaataaatacatacatacatacatacagggtaagaagaggtcagagggttccgggatggcctaaggaggtgacgtgggaggagagagccaaatgtaaccagggagcagcaatctaggaaaagaacaagtcaggcccgaggggacagcaagggcaaattatttcacctgggtgaaaactaatcagttgacatgattttcagaactcaacttccccacttgaattcattacactaatattagaacacacgttttgagaatattcacatcattgcaggtgggaacataaacccggaaatgcttatagactgcaatctggaaatagatatcaaaaactattacaaatatcataattgttcaattcagtaattattttcctgaaaatatatggtaaagatgtattcagaaatgtgcacaaaggtttttatataaagacagttgtggatatccacatccaagatatctataacttatattagcaataaattggaaacaatttcgaagtgacaacacaataaatgttcaatgaattacaatatatctggatgacgaactgtcagtcaatgattgaaaagcaatttttgtatgatatgtgatgacatgcagagatcctcataagaattttaagggaaaaggcagagtataaaattgtatatgtaaatatacttgaaatctatgacatatttgcatatacatgtgaataatattatgagggaaatggttaaagataatcatctgtgattcgggaggttacaagtgacttactttctttttatttctctaaaggttctaaccgttccacaaaggtcatgatgcacatttataaggagaaaacaactaaagaaataggaatatacacttttatatcattagcctatcattagcctttttatactgaaaaaaaataaaggagccagccacagttagaaatgtattaagtgctccataaaatttagtgttgtcattttagtgtactggggaggcactgagttcttcattcttatgtttgtctttttctctttctgtttattgatgctgttgctttcccattaacctagatacgggactgtaccaggatcatgtttgcaacccaggagtctagcgcagtatgtggtacctagtagatgctcaataaaagcaactacattatgtaagttacaagttcaaagtaattagctccatgattttgaatcatctatccattgtgcaaattaattgtcttgtatttaactcaaagcatatactatccctggagtaacacttaagctgttctgcattctgactatttagagctttctctttgcagagcttttgggtgcttgaaataactgttcgctttttgtaccacttggaagtgccgaattgaagctgtctaaagtcgctgtagctactgcatttctccttttcctttgtattacttcaccccagagatgtcaaatgacttcgatattttagaatatctagttttccaaagaattctttttaaaaataatctttagttttgcactggaacttctcagcatatgcataagtcattatgataacaaaagcaagttattacagatattatacggtaaacttcctctacatatgtgctctgattatctatgacctgacacattgtttctctctgattcaaatgcaaaaagctaatagacatttctctgaatagtacactttgccccagaataactcatcacctctatattcactgttccaaaccttttttgttaatttgcaaactcttcctctattgaaaatgtgcttgcaattacagtaggttttttcctaccgagtgataacgtgcctcagctaacctgtgtagtgaggccaaaatccatgaatgaagcatatgctgtcctgaagtcactacatttaacaggtcactgacccttgtagttctttccagtaacagagacgaggagagaggaggaggcaagaaaaggctggacaacagcagcagcttcaaaaggccttggcgagtactctcggctcttctaattcaccatcattcaggatttatttctattgcaatcagaaaactgcactttcctttctattccttttctttttctttcccctttctttaaggtaaataagctaataccaaagattgactgcaaagatgctttggaaattttaactatacatttatacgctcatcagtactgcatattaaaatatgttgtcctccatagaaaggaaagcattagctatgtaaccctgttactttgaaatgaattacatccagtgatatgcagataaatgtttaacaaccaactctagggggaaaaaaatcctgatttatagggtttccaatttctatattataaatagtcccaccagttctcagctaccaatacgatgtcactgaacgccaagatgcgcacaactcttgcaagccagtatgagttggctccatcacacctgatgctagctaagaacattgaaattatatgaggactatagcaattgagatacaaggagggttttgtatttataacctacaacatgatgaaaatttccaacacctggggtcattagactttatatacagtggatgagaattattcttaactcctctcctgctatctcttctcacatcttctcttaagaaatggcatccccgggtgcggtggctcacgcctgtaatcccagcactttgggaggctgaggcgggcggatcacgaggtcaggagatcgagaccatcctggctaatatggtgaaaccccatctctactgaaaatacaaaaaaattagccgggcgtggtggcagccacctgtagtcccagctactcaggaggctgaggcaggagaatggcgtgaacccaggaggcagagcttgcagtgagccgagatcatgccactgcactccagcctgggtgacagagcaagactccgtcaaaaaaaaaaaaaaaaaaaagaaatggtatcagaatcattagctgaactcccaggtgtaacttacatcccatgaaataaacgcaagaaacctactgtcccgtacattctgactaaggaaatttcatcagctggagattcaacccttcacttgggctgtactcccagtggaaaaaaatgtgcatattccctcactaaactattctcctttactcacaccacagtgtgaaggaagtatcagagcccaggttttgaaggcatattagaggagggagaacaaaaaacgtatcctgtactgtactctacactttaaggagacacccatcaccaaggacagggaaaaggttttgcaaatgaaaacacatttccgtaatttggcaaacttgcctagggctactcctgaaaagcaggtttcatcccacaaattcagtagagtcagaccctcttgagagaacaccggacttccaataccaaattttcacttgcatgatgggcatttggatgctaaatctcagcccctcacacctgctgccacccctccatgaacgaccaccaccccaagggcccctacacacggttttctttcagggttccttttcgtagtattttcattatctggtaccactcacctgccagaacgggctctacttacctgcccaaagtcacccagtcactgtgcattgtcatttccaagctggtgcttgcctcacctgatggtgtctggtctctgaatctcttcctctccaggggccactttatggctggttctgaagggccctgggacgcatcgggtgggcagctgtgaagtgctttctatagagtggatggggcctgggatcaacccattgtgtagaggacacatgtcagttttgcttgcctctccatcatttgccctttatctgggatgagcaccaacatttctctttgggaggcttagtggaactatcaatcaaggcatgcctaaaggtggcccctgacacagccaggccattcagcctcgctctaattcgagttgagtcaagtgatgagaggacaaaggctgaagtgtcccaagggcatcccaggaaaggaccattcactggttactgcttcccagagcctccctgatcccctctttgagcagctggttgctcagtttcatcttcatttcagcaagctgccctgccgcttccaattaattcctttcttgcttcaattaatgagagtccatttctgttgctaataactgatgaactctaattgacataaacacacttatagatgactggtggacagatatggtagacaggaggaaagtcttctgagtcgtcgatgttttcctatggttctcagaggacacttgcgtgtcctctcccaagctctggccatgggcaagccctggaatcactctcttttttgccctctgcaggttctcaagacatcacctgggtctcagagaaagcagaattgcaggacagatgctctttgggagctgagggtgccgaaggacccagccaggtctctatccattctcaagctgagtccctccctgggctgctccctagggtctgttttagataactcagcctggagcaagtgaggataaaagacagcacattggaacagaatacagatggaggattctttttttcccaaacaatgaatttagccaaggggacctttggtaggtgacatctcagaataagtccctggatttcaaaaaggaacatgaggaagcaactagcaatcaaacagagtctagacaaaggagcaacatgcaagttagcatgatccgtcagaacaaccctagggccaacaaccacaactcttttaagattcagtagcatagccttaaagcaaccatgggggcaattaaacaaggcactccggtggtagagagaaagtcagtggggaacatagtggatttgtctcaattagaaaaggaaaaatggcaggcatttgacatcctagctattactggtcattactgtagcatttcaaaaaaaggaaaactgtactcaaagcagatttacttaatgatagaatcaaagagctagaggaaacatcaaaagaaaaaaggagccctgccccctgcagtcaagaacagtttgaaatgaaatcactaagaaaggtagcaggaagagtgaggtcttgaatgagaagctgagttcagattcatgttctgctggggctagctaggttggccacgcagactcctcaactctccgagacctcattctcgttctcattcttcctttgtaaagtgaatgagatccccacctgacagatttattctgcaaaataaatgagataatgtgtaagaccaactaacacttaagttgtcagtaagatagggtaagcacactaggtgcatctatcagagcatcatagaaaggacatgaaccatggaccacgtgcacatcaaaatacataagcaaatggtcccaatcccatcaatatgatgttaaagagagaggtggaagaaaagaagagcagtaactgttataaaatgccatcaggtgagctgaaagagataccacaaagggaggcaacctgactgctctcccccagtgtccaccctagagacagaagaaagtgtcaggcaggaagcagcaatgtggaagacagtagatattgatgagctcagaagcaggcaaaaaatcaatttttttcagcctcgtatcttgggtgttttaggtgtggaaatacaggaatcaacattaagctttcagcatgcctaaaaatagttcttcacctgctgctgtttttcccattggttacaaaggctattgtttatttcagcagatggaaaagaagctgtgaaaagctgttcacatcctgcaaaagggagcatggagaggcggcggcatgggtagtatgttaatgagtggggtcggggatgattagctcaattgctcacacaaaatctttcttctccccggaatttgctgttagtactctgagctatggactctgatgccagcatgctaatttggacctgcatctcagtgggcacagcagtgagtatttccatgaggctcagtttccacttgcttctgtactcttccccattgcactctgaaaatccaagctttcttttcatgtgtcacacagtatcttagaagctcctgggttacagattcggggagaaaatcaccagccatttctggctttgggaggcagccgcctctgctgctgacagctgctgcccagtcctgctggagatggagagtcgaggctgacacctctgctgggcagagcagtaggaaaggcattgtctctcccagctcccagagttggccatgaaagcaaattccggtttttgtttttgtagtgttgagaaccatcagtcccaagcccagcagaagatcattgcctttcacccccaagccacttgtcataaaaattaaaagcatataaattcttcactctacagtttttcttctcagtggatggccagcatcttcagctctgtgagttctttttataaacacatatgcaccaagcctcagctagcaccccctgcccaacaccaatttttttttctcctttcctgcctgagcagttcaaattgatgagaaaatattaactggggctcattttacattaactagtaaatgctccatcaccaagctaaaggcaatggagtaaaaccagctcccattaagtttccgtgaatccatctcctacagctgtgacttctttccctgctgtggcctcacattcatgtaacacatgtgctttgtaagccttaggccatctgattaccctaaaaggaaatacccaacataggggaaaatatggggcttagtacaggctaatggttgaaattccttggtgtaagattaaccatgctgcaaaatgccaaagaaaaatacaaaagtcatgaggacgttcagcaaggttgtctttttcattattattattattattatactttaagttctgtggtacatatgcacaacgtgcaggtttgttacatatgtgtacatgtgccatgttggtgtgctgcacccattaacttatcatttacattaggtatatctccctaatgctatcccccactccccccaccccaccacatgccccggtgtgtgatgttccccaccctgtgtccaagtgttctcattgttcagttcccacctatgagtgagaacatatggtgtttgattttctgtccttgcgatagtttgctcagaataggatctagaactagaaataccatttgacccagccatcccattactgggtatatactgaaaggattataaatcatgctgctataaagacacatgcacaggtatgtttattgcggcactattcacaatagcaaagacttggaaccaacccaaatgtccagcaaagttgtcttaaatccatattttagggagagattcagggaaagtatgtggtaaagattttgtcttatttcaatatgaatttattacaaagataataataatacctaaagggaaaaatagtaatgtttgaaatcccatcccagaggttatgttttgtctgccttgttatctatgcttgtggcagccaagccctttccagagaaggtcccgaattccaactctctggccttcgggcactgcctatgcttatgtgtcacacaagtctcaatttggggtcagagccctgaaacaacaagatgaagaggttcttagctacagacgctataatcagattcacacatttcaaattttcctggccaaatcagaatgtcctcacaagccacctgaaattcagcccatacacttttattgagcacattaatgatatgctcattaatgagcacactgacatgttacttttcatcagtcaaaaggtcaatggtgacccaactagaagtgttggttttatagtcttaaactctacaagaaaaaaactacataaagaaataccagaagcatcattaaaatagcttctgacaattgttaaaacatctttcagatgttttaaaaaaaattcatcggtactgagatgaatctaatagaatgaacaatttactaacctagtttttaaaacattcccaaatcccagtacatttccacataaggccgtggtactcagtgaaatgtatggtgggcccatcatcaccaccaccaacacccctcaaagctgcatgatatctttacatattaggccaggtgcaatcaagaacgaccaccaaaagaaatgaaataaaatatacaaatatataacaaaaataatttttaagttaaaaaataaagaaagcagaaggaatgaattcaaaagagggactggtaaaaaaagaaaacaaaatgtaagaaatgataactaagaccagaaaagcatcttttaaaaacctcctggagtgttaggggtgagagaggatgcgatttaaataccatcagactcaggaaaagagaggagatttcaccaggttttcacaagcctaagatccaggagtgcagaggcaaatacgacagttcagaaggtctaaattcactaaatcgatcatttagtgaatggcttttggtccttcatttaaaaagaacttggttgaatttggaatacataaaagaaactaagagatgtattaagagtagactgaacggtgaccacccccacaaaatgtcatgtccatgtcctaacccccaaaacccatgcattgtgaccctgttgggaaaagggggtctttgcagatgtgactaaattaaggatttgcagaggaaatcatcctggattgggtgggtcctaaatgcaatggcaagtcctaagaagggaagaagagaaaggaagggaaaggaagagaagagaaggggtgggtgggaaacagacacagcaacacaggaaagaaggccgtgtaaagacccacatgaagatgaaggcaggcattcacgttaagctgccacaacccaaggaataccagaaaccactagaaactggaaacagcaaagaagaatcctcctctagaccctagagtgtctggaggaagcctggccccacccacaccttgatgcctgactatggcctcaagaactgtaagagaatacacttccattgtcttaagccacccagcgtgtgataatgtattactgcagccctaggaaattaatacaggcacctgagccattaatgaagtaattgtgaaaagccatcctttgcctgtggttaccacatgtgacctgcagtctcatgggaaacaggtatcatccacatggccagaagcagaagctttcagattgaagagacctaggctgaatccagattctgacaattactcacagtgtggccttggacatgtttcttgacctctctgtacctcaaggtcatctctaaaaaggtgagcagcaaaaaacagtccctacctcatactgttgttgggaatgaatgggatcacctctggaaaagtgcaaggtgaggggcagacacatggtgagattcattccctaccactaagcgtgggctgagctccagctcagccaaccacaatgtgagcctggggattggaggacgaggaagggaaaagctcactgcaagggaaccagcatctagcccctcgaacctgttattctcggtacatttcttgtcaataattaaaataactccactgccttgatagccacacttctatttataacacttaaaattatcagcttcattccactctcacacctagacacttactcattcattctcacaggaggagtttaatttcagcaaatgtgtttttgagagattttgatgtcctggagctatgaaactataatgtaattcatttactttctgaaaaacatgaaggcaatgatttttctctttttttctggccttgttgaggcatacttaagaaattaaaattgtatatatttgaagtatacgacataatgacttaatacacatatatattgtaaagtgattaccaagtcaaggtaattaacaagaccatcacatcacagttaccacgtgtgtgtgtgtgtgtgtgtgtgtgtggtgagaacatgccaagatctaccctcttagcacatttcaagtaaacaatacagtattactaatggtggtccccatgttgtaccttcaatcccagaacttattcatcttaaaactgaaaatttgatccacgtctccacctttccccacccctcagaaccactgttctgctttctgcttctgtgagtttgatttttttagactctacctataagtgagaatgcaatatttgtctttctgtttctggcttatttcatttagcataatgtcctccaggttcatccatgtggtcacaaaggggaggatttcctcatttttttgtggttgaaaaatattccaatgtatatagataccacattttctttatccattcacctgtcaatgagcatttaggttggttctataccttgtctactgtaaataatgccgcagtgaacacagggatacagataagcaacatggaagttcctcaaaaaacaattttaggaccgtgatttttcaatttcaacactacatgacataagtaacaaaaggagagttgttagggtcctaaagatacctacctccagatgttttatcttcattagctaagtaatagtcaacatgcattcaaatgtttgcttagtgccatacgatgtgacaagaagatgatacgtaaggcctaagcaactcgttatttttggaaacatgacctctttcaacctagttcttgtatccagactctcacaacagcttctccatctctgagagctaaaatacctgccgggtggataagcagtcatacccaggccagccagcagctctcctaaatttggagggagaaatccattcaggagtgcgatgatagagtcaggcttgcaacttcctaaatttcagggatacctgcatttcaagggaatttcatgatcattaatttaaaaaaaaaactggttcttccttataggccttaaaaacatgtaaaatgtccctaagtcaatgatttgagaacaagaagattaaaaatgaaacagtgaattgaattggaattgaacagaatgctgctgaagtcaaacacaagcagctcgtcagtctaagataaaaatgctagaaagacctctatctttatgatcagggagtcggggtcatattaccttaattgcctggtaaacctagcctgcacaagcatgcacactgaagatatggtgatatctgactttattcattctctcagctgactctctgaccttaacatatgcaaattttattcaagcatcttctgaagcactttttattttgcctgaagatgtcagagaaatcagtacttccaactggcattgctggtcctatttaccgtggttgacgatgcaagttgcccaagtgttaatgaacatgtccttcctgctcaaaagccttcaggtacactgttgcaaaagcagcatccttaaatagctaagtgggacccaagtgagacttctctctggcaatattttgtttgaatcttggaatgatgcttccaaagattcacacaaattaaaaatgaagacttgccaattccttcaacatgaattcattcattcagtaagactttattaagcactcacaatgtgcctgttatttaagggtacttggggagggagttgtttttattttccaactgcccatctgaaagactttgaataaaagatgtattttactcctttatctgaatgacaaccaattcaaagagtcagtgcccagacaccaaaaatctaatctaatcttgccttgatgccctattcttctagatttcgacatgattttaaaaattctggccaatttctaaggctgtcgatgctgaaaaaagtagacttaacttttgcagttgaaattgtacaacactcatcatataaaaataaattataatagaaggtttgaaaagtagaccttaaaaatagaggttacaaaattagccaggtttctactgaaagaaatgtgatactattttttttaacgtatcacgtctctacatctgcattttgtcctgaaggatgtggtgacctaaataaaactgacactctctggtcagaattctgcagcacccagaactggcagtcattgatgaagaaaactacagctgcaagggtacccggcagtttcatatctaaacaagagtgtttctttgtcctaagacacggatggggcatcctttcaaagtctctgaagatattggaaaacattagacttcagtaaacattggaaatggggctacacagaggaactcagttttttagctattaaacctttctttaaacagatttcaatacttaaccatagacacatctacaaattactaaaagaagtgcaaaaagaatgactccccactccattcactagcaagcaagtccccaactctgcatattcataaacatttaatatttatataggacaaaaccatttgacctaatttaaccttactatgatataaatatttttggtctcaagatctgaactgtaggacctggacccgggcagacaaaaacagtatgaccttgaataaatcgggtaccgctcttagcctccattttgctacctctgagatctggtctccatgagcctttcttaaactcaccatcttgagagtctgatggaagttatgaaggctctccacctaaactctgacgtttatgtccaatttgatgatgttcaaaagcagtcacagattccaggtgaaaaacaactgacctaaagaatctctgtgatccctccaagagccaaaattttactattgtttaataggataacctgtactctataccttacattatatattatgtatgcataatgttacttgtttagctttgaaactgcagagcacgctggcggctgcagttttcttcatcaatgactgccatgtatgtatataggcacagatattttagatactattattatattatgttaatagaatataactgctatattttgtctacatcttactgtatttattatacctgtgcttgtaagttaggtatacacatacctcatatgtgtatagacagaactcaaagtagttggactgtgctctggcccatcttttagtagaggtgacattcttcattgacttcttttaaggaaatgtaaatgtgctccttaagtgactgagaatttttttaagttcaggaggacacgtgcaggtttgttacataggtaaacttgggtcacggtgtttttttgtacagattatttcatcatgcaggtattaagactagcacccattagttatttttcctgatcctctccctcctcccaccctctaccctccaaaaggccccaatgtgtgtctttcccctttacgtgtccatgtgttctcatcatttgctccacacataagtgagaacacgtggtatttgattttctgttcctgtgttagtttgctaaggatagtgacctccagctccatccatgtccctgcaaggacatgatctcattcttttttgtggctgcagagtattccatagtgtatatgtgccacattctctttacccagtgactgagaattttctctctctcatttatataagctagtctaagtttctgttccccagcctggtggagaaatggtcccattatagatgtggttgggcagaaagggaagttaacaaaaacaataccatcaagtcaccctaatttgcaatgcaactgttacatgtgatactaacaaattcatgaatatatctgaagctataccctggtatcattagcataaagttaaaatgcagtgatcagtctatctcttagttttggggtgagcaggaatgtaactctagtgaccttaaccttgacttaggaaaattatacctacattcagaaatttgtagaacacaactccaaagaaaaagatatgtcttaaaactgtggagtttgttgaatgattgcagcccatcagaagaaagataattacattaaatgaaaataatataaattaaaggaaaattaagaatgagctagagtaagaatgctgctggcaaacctaattacattgtttattgtttttcttcatgccccaacctctttgccatcccaatccctacctgctgctcaaatgtaagcttcctcaggaaagggttttatcctttgtttttactgatgactcataagcataaagagcattgcctcatgcaataaatatttgaaaaaatggcactaagtgtctttgccaaagacatcatggtgattatgagtagtaatccataattgtgtgtgtgtgtgttacttaaatgctataatcaagcacaaactgaaaaactgcttccccaaatctcctgtacaccagtcccccacacctccccaaaaaaaacttgttactcagtacatgattcattgcagctgagaggtatgttccggggctttccatggaacaccagaccaattggatattgaaccctaaagttccaagatcataaactaccaagaccaggaaatagagatctgattttaactcaccattaggaattaacctccttatggactgctcaaagaaagatgacctagatcattgtccttagtcagacatcaaatgtcaacaagactaaaaagaaaacttagtaagaaggataaccaagttcaaactcatgttgttcaaagttaacaaaaaagaaaaagataatcaaggagagaagccaaatgttaataaaacaaacttgtgattcataatgcagcataaagtcaaccctacctaaagtaaaccttaaaatcagagcaactaatatgaactcgcgggagtggaaactttttcaattaaacgttgacatgaagcattcagacaccatcatttcatagtgacccctttgaaaaaactggaagaaatgctttgccacttcatggtttactggcattaggattcatgattcatgattaagacaaaaatgaagctccatggctgcattctcttgatgccaatatcaagagctaggaatagaaaaactccagcaggcagccacaagaaggattttcttgtccataacatcaaacaatttgattttttaagtcaattaatatttggttgagcatcctatagtcatagccaaaggcttataataatctggagcactcaatttagtcatatttgtgtcaattttgcaagggtatgctaccttcaaaagtgctaggctgacaaagaaaatcaataatcccattggttagaaaagaacacaatgtcgtcaggcgaactgggacagaactttcagagtcagcacagcaaaggcatccaaggccacttcacccattgcagatgcaggctatacttagttcattgattctgtgtcttggagcagcctcatccaaaagggtacactgttgacagacaaaagtagacctaaggaaaaagataactcatcccaagggagtactcattatttgttaggtactattctaagggttttacatgtaacaaattactaataatgttgctcccattttacagatgaggagacagaagtacaaaaaggcaaaataacttgttcaaggtcacccagagagtaagtggcagagccaaggtgcagaaccaggggttctgggtccaagggccacgctttcaaccactgcaagcatggactctgaggaaggaaacaaccaccctctcctccctcatggccttcaggctaaggtttccatataatctagagcctacccagcctcctgaaaccagagataaaagcaaaactctctggcctctgctgaccagaacagacacaccaggctcatcaggtcaacaaagccaccagtatttgagcaaccaagctccccaaatctgcaaagtgggatgcaaaagtgaattcacctatgaaatcaggtagacctgtcagaagtgggaaagccataaggaagaccagttctcacattggactaaacaaaaataagaaactgtgctgacaacctctgtgacctaaatccagtctgttctgcccattcacaacttggtttatgtagcatgagacagctggacagttgctaagatctcctcctattctaagattgggtgctcctcgtgctcctctaagaaaaaccacactgggcctttccagtgctttgccccaagtagatgcttgatcagttgaactgaatttagagcacccttcaattactcttttccctatccagagtgtttagctttgatctaggaaaaatgcaaaaagaaaaattcacatcaattttaattattagctcttctttgatccaccaaaaacatgaagttcagtagagaatgtaacagaatagaaaatgcaggcttcctcccaataaaaccactatgttatgctgcaagtcaatcagaaaagagtttttccatgatgctgaaacaaaatgtactgacatcactccaaagccaatttttttccatgacttgactcaatcccagaacctgccctggcactcacttccttagcacgtgaacaaaccaaagacatcatttatccaacgaagtgatttccgtgtcgcatttctgggagaattataatttgacatacttgtatgctgcacagacactctaaaagagtacaaaatcaggcatccctttctcaaagagagatttcaattttcagtctcattttcatgtaaaatttttaaagtaacaccaataggaagaagtctcaattgtatcgtgcaaagcagaagttccatctggttccatccttacattgttatccagcatcttcactaatgcatccagcagattaactggaaatatggcatgaatccttcattgtgaagaggtaaaatttaaagagggtactgtcacaccagtggatactagtttttaattttttcctgagagttacaggaagtagaggataggggtgcaatttttttgttgttgttccaagctggagtctcactctgtcccccaggctggagtgcaatggcacaatctccactctctgcagcctccacctcctcggctcaagcgattctcccacctcaaccttctgtatgtgtgcaatttttgatctctgtattcaggatgaatctgacattccaaaaaggccttgaaattaactaacctggtccaatatgataatttcttcattatccttgctcacatttcagttcttgacttgaattggttttgaggggattttgtgaatcctgtaattcacaaaatatttgtatatttgtatatttgccttttttcagttacaaagatttctgttcaatgctgatttataccaaactaaataggaattttctcccagtctacactgtaagtaagcaatttgcccaacctcattggtcaaagaagaatcactaaaataaagacagtttgtactttgggccattttgcatccaccagtggtaagatgcaagcaccatccagggcatcaagaatggtaaggccagctgggcacggtggctcacacctgtaatcccagcactgcgggaggccaagattggaggattgcttgagctgaggagtttgagatcagcctgggcaacatagcaagtccccatctctgtatttaaaaataataataataataacgaaaacaaaaatttaaaaagaatagtaaggccaagaactgatgttggcagataagacttctggataaggccccacactagaagcaatgcagataactgaccaaagagatcaggtagttatgctcatccccattccctggataagtaaactgaagcacaaagaagcttcataattagaccttaagctggtaatcagggagctaagacttgactccaaaattcatgacatgtctatttcacattgctttccttcaaaaaagaatagcacccaaagtgaaaacaaggcattctccaaagattactgcattcttttacctggacagaggaataggcacattcagaacactggcctgaggccactgtgctatgaaaaggaaaaaatttggaccctgttggaaaaaaaaaaagttacatataatacttattccagagatcaaacttcagcattctttatcatgagaagtagaatagtctcccttttgtcgaattactcaagcaagcttcaggtcaggtcctttaatttgcggaatagttactaagaaccagtttatcaggtcacacattactgagcaatataaacttcattagggctaattttcttttgcaggaaatataacagctgaggagaatgcccacctagatcagattttaaaggcctaaggacaccaaaaagccatcacaagaagactgaagtccagatcctcaggaaagtcattaaggtaagaaaatgaattcaagacaacaaatcttgccagattgaagaaactaattaaaggacccagcagaaagaaagccatagtgccaagggattccaagaaagccagtgtttgttccaagggttggtcaccaggtccaccaatgtccaagccagatgacagcctgagctggccaacactctagctccacagagagccgaggaaatgggcaagcaaccaaaaacagggatttaaaacagtctaataactctaacaattaacattttaagtaattatctaaagcatctattagaaaatgtaacattatgaggagatagagtcaacagtgtcataaaaaaactaaaaatatgaataatgttgacctcaaatagttttaaggcaatattagagcaataataaaaaatgccaaattgtcagtatttaatgtttttaccctactcaatgttagatatagtctaccaaagcaatgcatagctggattcaaagtcaaactaaaatggggcctaatatagattccaacaccatgaacacttgggaccatctttgcatagggaagaaggtgagtcggaagtgatctgggtctcctttccatcatagctcagagtcatctttccctctccatctctgtgagtctaggcctttatctggcatgcctgcatctctgcaacctcctctgcactgatttttcaattctaatctcaactcaattccaatcactgtgcatgccagataaatattctacatcatacttgcatcttatcccacctctatccaaaaatctcaattttcagagctaaatgggcttggtatccaaatccagactccaagactctgtcctgtcttctcttagcagagatttcctatcgtatttcccattgtatcctgcaatggcctaactgtttgcctcactatccgctacacaagtcctgcctccccacattcattcattatgctctttaattatgtcatatcctctttccttccatgcttaacacccctcctgctttactttcccttcccttgcaacctacgggtggtcaccatcacacgagaaatggaggacactctagaacaaatcattggcatctctcccacacccatttccaaaaacaatctgatatggctcattataaaaagcacaggtgcagtaaaacaagcacccaaaaatattttatcagtaaccgaaaggcaaaataataaaggtgaggaagaatgggaatcatattttaagaagctaaacttagaactgagttctgagtacaaaaattagctctgagcttcacagcaacctaggcaagagataaaacatgatatattaagtagtttttatctgacttttatcacatgaattcatccgtagagattcaatttcctcagctctgaactcaaaggaaatttccacatgtattattatattaaggacatgtaacaacatgatggaggatatccttaacagctgttttacagaaagtgctaacccatatcatgatttctgaccatgaccctcaataaaaactgagggcataatattagcctcattcaattaataccattctgttgggagccagaaagacagagttcagctgtatagcattatggttctgtgactgggctcagggataactccctctaacaccagttcttctgcctggacttctggctggagtgatgcatcagatggttccaaatgggagccaccagaaagcacctgatggaaactaaccaaatcctgtccctctgcagatgaagccaacaaaggtcacatttgggcaggaaaataaaagagtcaccccggcagagggccacctggcatcgctggggagaagtgactgtccctgaaatcactctgtattgtgtcaagtgctcaaacaaggacttttcttttgcatcacagacctggaaaagactcagtgggcaggattatccaaacatccgcctctgtcccatatggcctggataatggctcctgtctgatatttcttttcagcaggtctgtggcagcgagaggggcccaccaggcttcaatggcaacaacatgcccatggggtaactaatgggttgaaaggattgcacagcactatctagacaacaaaatgcatctgcccaaaatagcattttgatttaccactctgcaaagtggcacacagaaaagtgaaaaaaggaagcgatgtatgaggctgcaaagagtttctgacaaacaaatgcctttgggaaggccaagcagagtatttcaatcaagaagttattgggagcaaatagacatccttaatgactattacataaattgcccagggtcacgtgtaccagggtgatggtgttcaccactagtctttttgttcttgatgtttctttggttttttgtttccagagtttgggacctgtttatcccatagcatttgccccaaataaatgacagccatttgggagttgtgggtcccctatgtttgtcactacccccaatgcattttctgacaagggtagtgtcctaaaatgaaagctgagatactttcatatagcttaatggtttcaacaataaaaccatgttaagtttatgattaaaaagataaaattttaataaggaagaaaacaaggaaggatagtggtaggtttggacaacagcaaggagtgataatttgctttcagatagtcatggtatcaacaggctccacccttcaccagggaatgtgaacaaatccattcgttaatttggccatggagggactcattggagatttcggggcagtgaccatgtcagagaatttatgctatgttgtagctaacaaaatagatgtgttgtagcattcagagcttttgaagcccaaatcttgccaaatagtgtctcttacttcagtgatacttaaagcattatagagattgagaaaatgttgagatcacactgtcatgactgcatacaccaccattcagacaggaagcgctgaccaccagtaggattcacctaggggagatgttaccatttcaactgtctcaaccttctaattggaggtcttcatgaaaggttcactgtggggtgatgtaggctcatgactctgtcacatgaccctaacttaatttgccttttatacctgctcaaaggaacgattattgtcagagaaactgtgtgtatcacttcgcgtcccagaaattcaagcagcagctcctaatattttgatccagaaagaatacacataaaatattcttttatatatatatatatatatatatacacttatatatatatataaaagaagacatatatataggtaagtatatatatacttacctatatataggtaagtatgtgtgtgtgtgtgtgtgtgtatatatatatatatatatatatatatatatatatatatatataaaagaagacatttatgtggccaacaaacatatgaaaaaaagctcatcatcactgatcattagagaaatgcaaatcaaaaccacaatgagataccatctcatgccagttagaatggagatcattaaaaagtcaggaaacaacagatgctggagaggatgtggaaaaataggaatgcttttacactgttggtaggagtgtaaattagttcaaccattgtggaagacagtgtggcgattcctcaaagatctagaaccagaaataccatttgacccagcaattccattactgggtatatatccaaagaattataaattattctactataaagacatatgcacacctatgtttattacagcagtattcacaatagcaaagacttggaaccagaccaaatgctcatcaatgatagactggataaagaaaatgttgcacatatacaccatggaatactatgcagtcataaaaaaggatgagttcatgtcctttgcagggacatgaagctggaaaccatcattctcagcaaactaacacaagaacagaaaaccaaataccacatgttctcactcacaagtgggagttgaacaatgagaatacatggacacagggaggggaacatcacataccggggcctgttgtggggttgggggcaagggcagggagagcattaggacaaatacctaatgtagatgacaggttgatgggtgtagcaaaccaccatgtcatgtgtatacctatgtagcaaacctgcacgttccgcacatgtatcccagaacttttatgtatacatacatatatatatatatatataaaagaatgtctatgtatatataaaattgaaatgtaaagtagtttttttccaattctgtgaaaaaagttaatggtagcttgatggggacagcattgaatctgtaagttactttgggcatacggccatttgcaggatattgattcttcctaaccatgagcatggaatgttttcccatttgtttgtttcctctcttatttccttgagcagtggtctgtagttctccttgaaggggtccttcacatcccttaaaagttgtattcctaggtattttattctttttgtagcaattgtgaatgggagttcactcatgatttggctctctgtctattactggtgtataggaatgcttgtgatttttgcacattgattttgagaatacacattcttactacaacacaagaatataccttagaagtagctgagacatagaaagaagaaatgggaaaaagatcataacattttttctaaaataaatgtcgtccataacacacaggttgagggttcttgctcaatgagtatgagaacacaggaattgtccattccagagtggttataatcagctcaagcacaccaatccctgtgcaagctgcagagagtcgcatcagcatcctgccttcagatcaaagctgctgagccagactctggtggaggaagggccccagaacaccctgcatcactcagaaaccattcaagttctggaactgctgttgcagcaatcctcaccagacatcaggaaatcatggttatttgtggacagaaaaaactgaggtcattcaaaggatccaggccagattcccgagcatgatgtggggtttgaatggccctgcaaagagccacacattcatagtgggagctgattccagttgggttctatcagggagaccccctcactgtgtctcctcccaggccgaggcaaacgagtccctgccttctcacaattgcacctgtgtgctcacaaggctgcgtgtgatgctgctgtgaaagcactcccagctaagtctattcatcattgcacacggtgggtaatgaagacctcggaggaaactggtttccacccctggggaaatacatcaggagcattcaaaacaacagactagctggactgtaggaatgatacagattttccttggggttctccatgaaactggaaacttataaagggaagatgatgttattgcattagccactcacatctaaataaacaggaggcaacactagttctggggtaagtcaaaactttgtctataaatgcatgaagagaaaagtgcttacacttaaaaatgcaggaatgggattgtatccaacactgtgctgtccaacagtaccttctgtgatgatggaaatgttgtatcccactccgtccatagagtagccaccagccaatgcagctacagagctccgtaaatgtggctactttgagtaaggaactgaattttttattttacttatttgcaactaatttaatattagtctaaatagccacaatgggctagcagctaccaaattgacagtataggtctagtgtataatttcagtgatgaaaaaagacacaataagacctggaaaaatgtgtgaaatgtcagtagtggtgactgcagggagggggaatttttttctgctttttaaatactttttctctatttccaaagtttttttattaataagcacatataaattttataatcagaaaaagataaaaataaatgtatgctgaaaatattaaaagaaggacaagataggacaacttcagcggttcctgtatctggcaccaacctgcttgctcaagctgatcaataaccaataaatgatgaaaacattgctgttgcccaaacagccatcactcatcaggaggctccaattcaaacctgtccaaagtctactaggcgccagccatactcggctttcccttggacacctgaatatgccaagcttgtcctcactcagggctacctaagctgttcctcctgctgttcctccaaatctcctctagctgcttaaaattcccttaaatgctgcctcctatccaatgtaaccagccagtcatcttctatgtcatcacttcctttaattgtccgcacagcacttctcactacctgctattttcttgtttatttatttgtgtattatctgtctccctccacccccaaactagaatataggctccaagaaagcaggagtcttgtctgttttgttcactgtcctatgcccaccacaaagcacagtgtccacaacatattggtgctccataaatatgggctgaattaattgctagagtccccagtatttcccaaggctgctcagagactctgctttttaagatttcacttgcaggaaagggacgggctctgggaccaagctgtcgggtttgatctgggcagataacaactaccctcttctctacatatgcttcatggtctattattcgtgggggcagtaaacggatgcttcatggagctgtgagaattcaaatgagataacagagggaaggcactgagtgtagtgcctggtgcgtagaaatgttcaaacaatattagctgttatactttgcagatctctggtttgtgtgaggagggtaggacaagtttgccaaaatgtatcattgagataaaagaaagggagaattaaacttcaactaccagcttcttaggctggtctttctgttattttgctgtgtaacaaactgcgtcaaaactcaagaggtttaagacaaggacaacaatgatttgcccgtgaatctgtaatctggggtcaggggctcggcaggaatagctcatctctcctccacctggcagcacggcggccaaggctggggctggaatcagacgcaggctcacctggtgtcctgtctggggtagctgaggtagggagattccaacagctatggccaagacagccgggcactcagcatctctgtaactctctgtgtggtctccagcctggcagcctcagagcagccggacttttgagatggaagctcagggctccaaaggtgcatggagagagaggaggtgaaggagggaggggggagagagagaaagagaggaaaggagggtggtgaggataactgagaaagaaagggagggatggagaggggaaaggagggatggaggcaggaaaggggagagagggaaagacagaaagagaggaagaagcaggaggaggactaggaggaggaggaagaggagagaagaaaggagagagagaggaaaaaggatgagggagggagagaagaagagaaagagagaaagatagagaaaggacttgagagagaggaattaagggagagatatgagatagagagagaggtgaaagctacatcacctcttccaacctagcctctgaagtcatgtcacagcactgtcaccacattctcctattctcttcacagtagtcacaagtctgcctgcccatgtttaagggaagaggaaatagattcagtctcttgatggaagagtggtaagtttctagaagggtctacaggatcaaaaatattgtttcagccacttttggaaaggagcatctcacaggactaccaactaatagttctaggcatgtcttcacccaatgaccactgtcgttttgagagccgccctgtgcactgctctcaggaagcacatgttccaggaagacccacgcacactgttccacataacacaggaagacataagaaaccaggaaagcctgcatctgccagggatccacttttcctgtcctttgtgctttgtgctaccttaagtctggctttctgctggatggtaacgtgatgtgaaagtggcagctcagataagattcctgtccataaattctttgaactgaatcaaaataaatgcaagcccaggatcagaactgacagtgcctggcaattggtaggtattgagattggaagagcgtggaaactgctgagaagaaggcacgagatgcagttaggtccactacagctcatcctgacatcatccgcagcagttcagaagttctccctttaatgagtcctgtgaaaccaacgtggccccttccacaggcttttggacttgccctcctggggaggaaggtgtcttcggaggtttctgtcatatggcatataccttgttcttcagagtattttcaaacttagaatcattagctcccttctccccaaccagtatagacatgaacatgtgtcaacagtccccagatacactgcctgtgctttgaacagtgtaacagtgtaaggtttcttatgtgttccagtgcacactgttccaggaagacccatggccgatcattccttagctcagaatgccaggacagtgcttagctatgtagcaccaaagaaaaccgaggcaccaatgccagctgttcaaatgcatcatcgacaaaagaaaggtgtacacaaactcacagacagactgaactggtttcatttgctcctccagagtcagtctcctcccttccccatggctctttgctctgaggctgacgcatacggacaaacacaaagactcatacccagctcctttgactctggctgctagatgggtttggccaacagagtgcactggccaggggccagggagggaggagagagaggacaggtatttgtcatccccgctgctccttgcaggtcactgcacactggctgcatctccccagtgaaggtctccattcttgtccttgaacacaacccctattggtctccaggttccaagaatagctggtctcctccccttgctccttcaggactatggcagtaaaggagctgttggtagccctggggtacttcagggtccctggttggtttctctataccctgcacactcctgtgtaaatagttcctttgtttagctcttctcgaattatgctaatttgaaagtgtcacccatttctggatgtgacccagacagacccaggacccttcttcttttttggtgggggatggagtcttgctctatcacccaggctggagtgcagtgatgcgatctcggcttactgcaacctccgcctcctgggtttaagcgattctcctgcatcagcctcccaagtagctaggattacaggcatgtgccaccacacctggctgatttttgtatttttactagagatggggtttcaccatgttgaccaggctggcctcgaactcctgacctcaagtgatcctcccctcttggcctcccaaagtgctagggttacaggtgtgagccactgcgcctggccccttgttcttattaatggcacaaatctctctcccagccaccttcacactctgcttttcctgagcactgttccctagggtcatctcttatcatgtcaccattcattcacttatccacaaataactttgagctctaacagagaagacactggctggattcaggggtgaggataacccctgctttcacagaacttactctccaccctctctgttgaactccatttggccaaatatttctcaggaaacctgaaggagagcctgtttccaatgccctgagacgtaaggtcatacagattgcaaatggtgacttctgtcttcactcatcaccttgtgcttaccagggagctggaagatgtccctcatgaggagaagctacctaagcaaggacattcgcaagccatcagcattagtcatcttttatataaaaatcacattgttctggaaggtggccatcctgttacactgttcaaagcacaggcagtgtatctggggactgtcgacacatgtgcatgtctatactggtcagggagaaggaagctaatgattctaagtttgaaaatactctgaagaacaaggtatatgccatatgacagaagcctccaaagacaccttcctccccaggagggcaagtccaaaagcctgtggaaggggccgcgttggtttcacaggactcattagagggagaacttctgaactgctgccgatgatgtcaggatgaactgtggtggacctaactccatctcatgcctccttctcagcaatttccactctctgccaacctcaacacctaccaactgccaggcactgtcagttctgatcctgggcttgcatttattttgattcagttcaaagaatttatggacaggaatcttatctgagctgtcactttcacatcatgttaccatccagcaggaagctggacttaaggtagcacaaagcacaaaggacaggaaaagtggatccctggcagacacaggctttcctggtttctcactgatcagtgtgtccctggaggctaatcatccagaagaaatcttgttatcctaccagaaggatggtactccaggcctgccccagccacttggctcacatttcaaagaggaaatgacccacaggctcccgttctggccagtgctctgtctgcatctactcattactcttttatagcatcgatcagtctttgctggggggtggaaaccagacccagctcttcaggctggcaagttcccaaggctcgtgctcagcaggcaaatgggccagtgagaaccatgcactggtgaataatgaagtccacctcccaggagtggccaatactgcacacctccaggaagtaccactgccagggctgctccactggtgcatcggggacatctcaggagggtttccaggagaaggaagctgcagttctctctggctgtgctgctgctcatgtgaaatccccatttcccactctcacaagttctggaaggtggccatcctgttacactgttccaagcacaggcagtgtacctagggactgtcgacaagtgtgcatgtctatattggtggggtagaagggagctaatgattctaagtttgaaaatactctaaagaacaaggcatatgccttacaagaggagcatcacagctgcagaaaccactgctcttgactttgcagaaggaatacactggttgagcggcagatggtgaagagctctgagcctgaacccgatagggccaggcttcgaccttgtcactaaaattacctactgtgagatcccaggcaagttactcaccagagagcatactcacctgctccaaaagtcagttgtgaagattcaacgtttctgaaaatacatctggcaagtgctaaatcatagttgaataaggttaaatgagcattaagaaataatcgcctggttatagatgctgaatggcccgatcctaagacttttcttagatttaggttcacctgctgctgtggttttggggtgctatttgctctagtaaaggactgttcttgcaggtcttcccatccatccctgttttctgccacttcaacaaggtcctcctctctgagcagcacaattagatgggagatctttttgcacagtacctacagacatgtctcccaaggagaactctggaaatggctaggggcaggaaacagggctgggtttttattttgtattttattttattttgcagaagtcacggtaagggtggacttgaaattctcatgtagacctgcttccctctccatttcatgaactcatagagctgtcacccagtgtagggtttggataccatgctcacagtaatatacagcctgcagatacatctgttctttgattctggtgggtggataggaacgagtctcacttccctgttctggaacatgatttcctacaaaacctcgatgccggctcacttagtatgtgatgttacctacagaattcttgctcttcccactctgcttcttccatgcctcgtgacactggggtttcttctttttcatcttcctcttaaagactattactatcttctcctcacagcttcactatcctatccatctgaccttgtctttgacacatcagcctcatttttgctgatcttctgccctcagggatgatgtctttggttggcactgctttcctcctggggtctctgtcacatttgagccatttccttctagctctccaggtcaaggagagcgtctgttgtggtagacagtgccatctccacccaacatcagacacttcacttctgtcttcccaccatatcatgagctcgatcactctggacaaggaaacctgagatggggatgccaattcaagctctcccatcatcatagatttcaagggtgtttttaaggttccaaatccctgttttgactctcattttatgcacgacactaaaaactcagaagtgaaagagggaaggagtagaagccaggtgtaaattcccacctctcacaactctgggcagctataactttgaagacccactctcttcttttcataaatataccacctttcaccaccaccccagggtggaagggtgattacaatgaattttttttaatctacattggttgtaatattcaaagaaaaggttctatgaagcatgatgtaagtttcaaagtgttactgtctctaatacgcaggtgaaagacaaaaatttactttttagggtttagaagcaataccattatcacattcatcttatcaatatgtttaagttttttgaaagattaaatggatagctaggtgcccatgagctcatgattgttctcttacagatggaagataaacctgaactctgactttcatattatataggctggaggacttactctcatgttctgtctaaagctttatttaactgatggtcattgtactcctttgcagctctcagtacatggggaaagaagtttgttgatcctaacaaagcataaattgcactcatatttgctcttgttctaaggccaatttgggacttctaaacatttttaatgagctttgtacacaaaatcacatatgtcaaaactcatgcatgccagaatttctcatccgaaaccatgcatggcagcaagcaagttgaagcacgtgtcttccagggcagtacacagtggcagccacttgctaccccctaatttactaaaaaaccctgggttagtgtccccttcgtatttcccaacagctttcccagtcgcttctcgattccttccatcacttagtgaagacactacaaatacctccttcatgagattctgatgggattctacatgccagggttgccagagaacccatgcatcatgaattcttcaggaaggcaaattgcatctagagtccctcaagttgttgtatattctgattcttccccataaaaaatattttaatgcagaaattagctacatatgaagttattaaaaaggtgtcctgtgactgagggaaacttggagaagtcaggtaagtatagtcaaaaaggtttggcagatgaggttgaggaagccaacatgcagtaataaccaatttgtgtgttgcaaaagctagaccagtatttttccaccattagcatcaaattctcagaacccgccctatatgatctcatgcataattcacaccttagcaccactaaatcctgtttcctctggattttagagccttagaagaaaagtacatcaactcatttcagcacctatgggcagtataccgtcacatgactttcctgtatttacagggtataaggaagtcataataaaagggggaagtgattgacagaaagatacctacagacagttaggacataaaatgtatcagataataaatacatctacgatcttccaagacagatccacaaagcaggagatctcactacatgctgttgaacagatgtgaggggcttccccaatgctccccacagaaacactgatgattttggtctgacacacgtgtatggcatgagaaagatcccgctatatgtgagaacaacccctttttaatactcacttacccacactcctcccagaggccctgtagacagagttataccattgttcacacaccagggactaggaccagcaccacagcattcccctaaatgctgcctcagacctgcctgaagtttattcttaaacaagaatattagaagagaaaagagataaaataattactatagtatttaaagatccaaatcacctttaatgataatttctattatagttaaataattaattttcaccttttgcctaagcaaaaaggtatgtaaggaaagaaggagctcagcaagtagttataatattactcttaacattttttaaacatttatttaataggaaaatgttattgcaaatgaactgtaatgtgaactttcaacttcacttgtacaaacattatctttggaacatatttttctactaccctgtcctattccttttttttagattgaaacagaatgattatagtcatttgccataatacctaacgtcgtctgacagtttaaaacagtggtctcaaaaggtatgtcataactggcacgtcctcaacagtaccttatcgttctgtagctcatctcagtagaaatatcaagacctatcaagccactaatgccttattctgcctgtctgatggcccatttggtatttgacaatgccaattcctctgtcctcacatttactgttgacttttctgcatttgctcactgggattgtcattcactctaacctgggcttcctcacatagcacacaaaatgttaaccacatgtcctaacatctttcacaccaaaactgaggccaattccaccactcttcaggagcacagtcagcccaagctttctcacatgagaaagtggagtgactcacttctaatcaagagggacatggtgtgtaagtgcatataattacatgcagtaaaagcaacctgactcatttgaaaaaggctataaaagttgggtctctcccaactgcaaagtaccagaaggtatctaattcaagcccacacaatcatgaagtagtaattctgaattcatttaccaaatcctaaaatactggaataaggcacaccctctacaactcaaagtataagacaaataaaaggaaggcaatcatccacagaggaataatggtacaaaactcattcatctcaacatatggtcccgggtatggaataaaaggtgacgcagaaggagtatggacacatcaatatgccactgagtcacggatggcttctcagaaagacctaacctgtaaagctgcatcagggaaaaaggtttccctccaaggtgtattctttggggctcccattggccaactcttaattggaccatggatctcattcttattggtgattcttatgttcctaccagtagactggaagtacctggtaattaataataaccagagaagaaccactgccccccagatgcctgtggagtcactaattttatcattccttgaagtgcaggtatcacacaagtgcagaatctgatgggccagcaatttggtctcaacactggaatgtccaatggcaggctagagcctggaatttccctcacaaaagcaggcaagcaagctcttcatgcccttttaagcagtgctatgtgttggtcatgcaaaatcaaagaatcagaacatccacttactttgtaagctgtttgacaaaactaatgattgccttttcatacaggttacctttctcagcaatgtaatttctcctaaaagtaatgatcacataattctctttcaacaagtatctaaatttgaaaaccatatagagaacagttccaaaagacaggtatatattcaatcaactgatacttttttaagtcctactatgttctaggcactgctatagtaattatggatactgatgaagtctgctttcatgaagaggctagctttggcaggagatgggagtggagaggaagttaatcaaggaattgcaaacaacgtaaaaccacaacagatggggtctccaaaggagaggcatatatggggtatgctgataaaagtttaacaaccagctctctgaggaagctctgatttgtagactctgccaattttcattgtgtaaacactcccagtatggccaataccaacatgatatcatatggcctgcaaaattcctggaaatttcacaaccagcaggtacaagactagtataatctggctccagaacaccacttatataagaagaagctgagctagaaaaggacatggaatgcttgagaaacaatagaccaccccaaggttctaacacttaagtcctggatctcaaacattccatccctggcaccaaaatagcataatggtggactggatgcacctggaaattaataataaccagaaaagaaccattggctcccaggtaaccatctacttgtcagacatggtgttactcctttaagccaattatgctcaaaataaggagtttgtccctcctagaaaacacatccaaactcacaaaatagtttcatttaataataaattccccccttgtcacccacaccaccaaaaaacaccaacattttttcagtcattcttcaagtaaattccatatcctttgctatagtcacccacctcagtccctgagtcgtgggcagccacacaacaccgctcaagggggcactcgaggagaatgaaaacaacttaacaatagtatttctctaggaaatactattctttcaaagtttgtgaatcctcaccccaaaatctcattcaaattcagtggagttcatttaataggttaaggaattgtatacctctgcctaaaacacacacacacacacacacacacacacacacacacacaaatgtatcgtataacatgtttataaatttataaaaacataattatgtattttttaatttagtaaatgtcatctcaagaactagaagcaggcacaacagattgccagatcctctgcacgtatttcagagaaaaccatattaaaggtttgaatcaaatgaatagaaatcatttgaaatgtaagcaagagggcatatggggagatggcacccaagaaggcaggagagaattccaacaattttgagcctgaaggccaccgctgaaggctgcactccatttagaagcataatgacatttgaacaggtgaggacacatgtgaaaactagttcacaaatttagcccacaatctctcccaaactccagtataaaattcagcagacgataggctgaaacttcctaagaaaccttgtacatagaatgttttaattaaaatttgatgaatatgtattcagctcctaagaacttcagaagactcaatattttctgattagtataactaagggtaactttcatttgcctagtaagtttgcttctcaaactgtagctaaatatttcactgaggttttcaaaatactcacaaagagcccactgatcctgcttcttatttcttcttactgatataatcagctaagcaaatggcatcttaaaagttaaactggttacttcatctcataatcacataccaggatagaaaagataaagggccaggtgcagtggctcatgtctgtaatcccagcactttgggaggtcgaggccggcagatcacctgaggtcaggagtttgaaaccagcctggccaacatggtgaaaccccttttctactaaaaatacaaaaattagccgggcgtggtggtgggggcctgttatttgagctactcaggaggctgaggcaggagaatcacttgaacccaggaggcagaggttgcagtgagccaagatcgtgccattgcactccagcctgggggacagagcaagagtctgtctcaaagagaaaaaaaagaaaagataaaggaatgagagagtgacagtgagaaccacagcaagaagtcaagactggttatcagcaagggttattgctttcaacaagattgaactatacaactgtaaagatggacaaaaatttccaggaaaactaggaaaacaaatttattttgtaagatagttaattatttaacatattaattataatttaatagcataaagtttgacttttgccacaggtaaacaaattaataaaaatccacactgatgacaataactccatcaactgaataccttctatgcagtaggcagtccagttggtggtttttacacataacttatgtaagtctcatgcccctacccccctcttagatatatattgttaccccattttatggatgaggaaaccaaggctcagcagatttcgtaatttgtcgaagatcatgacactgcaagtcgttctgaagtctgaattccaaagaggatattcttaaccttgacacgttgctgcctccccaccaactagagctcttatcaatagttattcagcattcaccaagaaatcatgaagtccataaattgtgaatgtcaaagaaaatgcacagtaaagaagtccacatttttcccagtttacaaataggctggttttaaaatttgtttagaaatcaaagcacattttcctgaagaaaaaaaggaaagaacaagaaaggaaagaaaacaaaataattgggttatcaggtcagttcagaaaagcctaattcctgatgatgatgacaatgatgatggtgacgatgatgatgatggtggtgatgatgatgatggtgacaataatgatcatgatggcgatgataccagcacatgtggccaggcactcatactaagtactttacacatatttaataacatacctcaatggccatagggtgccagaaatgcatctcttgactttgtgcagagattttccccaggagccaaagtagggatgggggctgggggctgggggctagggcatcatgggggctgtacagcagggacaagggcaacatttacaagtgggaggaggttgccttcatgggcaaacatttgccttcctcctctcctgtgcagagcactgtgttaggggctggggagagatgaataagacacctaaggctggtcttgtgggagagctgatactgaaaccctttcaacagtctgaaaagtgcaatggtaaccattttccagatgctgctgagaacaggagatagtacctaccagagtgtgtgtgtgtgtgtgtgtgtttgtgtgtgtgtctgtgtatgtgagagagagagagagagagagagagtgtgtgtgtgtgtgtgtgtgtgtgtgtgtgtgtgtgtgtgttggggctaaggaaaggcacagtgtcaggcagggcttccaataggaggtgatggctgagctgaactttaaaggatgagcatgaaattgatgataggaggagctaggggaacagatttaaatgtctgaattctctcccgagcacccaccattccaccccatccccctcttcatcggctcttcctcctctacccggatttcaaatatttgtttttccttctcttctcactatacatgctcaccctggacaattgcacccactcccatcctttctctttccatttccctctggagatgtctctgctgagctccagaggaacacctccaactaagtgccaaacatctcatcgaaatgtctgctgggcccctcagactttacgtacctcaaactgagctcctgtcttcccctctagagctggaaatttaccttgaatttaccgctcatccagtgagtgacagaagtattatgagtgagtggaatttaccactcatccagtgagggggcagttttcttggaggtggacagacctggctgtactttctaccataatctgcggtataaattcctatcaaatctggtcttcatgattagcacctatttatgccccacagtttacagcaaaaattagaaagcagtatgggctgttttccaaatgaaactaatttaaaataatttacttttttgaagaattataatgagaatcagtagttacagataatttcgatgaaagctaatctcatgacctagtaaaaataaagagactgagcatatggtttggaataaatgcgattctctaaaatgcaatctggataatcactgaattattataatcattctcaggcatgtttttatctttgttgatttttttccatccaccaggactgtggtcgtataataataacacaacaagtttagaggactctgatctttggttgcttagcaacttgcagctttgacgagaataaaggataaagggtccatagcaaaataatgctgtttgcaattcaacagttatttaaaagttttagaattattaaaactgttctgttttaaataaaactatgcaaatgaataaatacttcacaggatcagtcatcgtttttatttctatcatactctgaatttgtggttggagtcaatcactgaatggatgacccagatttactaatttgaataaaaatatgatgagaacactgtttaacatggcagagtcattgttccttccatagcagagctcataatgttgctgggaaaactaaatggaaaatgcatttaaattacgaaaggtaaaaggtggtgcccatcctatagtccctgctcagtaaacgctagctgtcatcatcactatcactattatcgtcattaaagagaaatggataaacgggcctgtgtagagaattcagcaaatggcatgcatcctacaatgagcattcttccatttcagtggttgcaaatgtcagttagcatgttcctcattccttcatttattttttattcattcaacaatggtcattgagcaactatagatgccaggtgccataccaggcacagagcaaacaactgggaacatactagacaaagtgcctgtcacggtgtggacagatagcaaacgagtaaacacatcaatgtaagtcactacaagaactgagaagggctcaagcaaggggctaaggtcagtgtgaggcatcggaggagggctccttcaggaggggaggcttagtgggcacctgaaggatgagggtgacccatgcatgggtagagctgaaagaagagggagtttttcgtgacaggatgtgcaaagggcctgaggcagaaaagagcccatatgtttgtgctgggtgcccctctgagaatgggatggacaaagtgggctggggtaaaggagagattggagagggagctggatttgtgttcttatgaaaatattattttcatactttgccagggcctctcaaagtcacatttagtcaggcaaatacacccacatttgcactccccacagaatggaggccatgtctatgggatggtgccactgactgttcatctggcacagctacagccttgcccccactcccagcccgcactaccaccgtcaccaccgctgtcaccactgccacccagtcaacctgcacccaggttctgagtcagctttcaccatcattaccatggctgtcctgggatgctgcagcatggtggactctggaatggtccaggaaagacacagctctggccaacctgacttagcctgggggctagagcaggcagaaattctagaaattcaaacaagccaacagaggcaaaccccagagactttatgggctcacacctcatcctgactccagccctccctcagggtggctcagagaccaccgcaccccatctctgacctatctagcaagaagccctacccaggcctgtcttctgctgctcctccatgagctgactccagcctgactccagcactcactcagctcacaaacaaatcctgctgatagaggagtgactgttggctgaatgccatattgccatcccaacagtccagacacgaacctcctgactgtccttaaaaccgtaagccaaacaggtggctttaattgtagaaattcccatcaaaccaacatgctagggaagaggagtcttttgtggacttacaatcaattcccttcacatcataacacaatgtgtacagaaaaactgcaaatgaagccaaaatcccaaaatctttacataacttaaaggtacaagacttgacttttcaatgtcactctgtcaaagattagggtatctttctttccaattttattttatgcaccttaacataattttgattatagcactgatcaattttgtgtcttcttttttcttttcatataatttcatagatgcaagattgtctttaaaaacatcttttgcagtggctaagctctgtcatagagctatgccattatttaaacattctcctattaacttgaaaacatttaggtgttttcccattttggactattacaaataatgttttgatgaatatctctgtttatacaaatttccaacttcttttttttttttttttttgagacagagtctcgctctgtcacccaggctgcagtgtagtggcacgatctcggttcactgcaacctccacctccagggttcaagcaattcttctgcctcagcctcctgagtagctgggactacaggcgtctaccaccacacccagctaatttttgtatttttagtagacatagggtttcatcatgttggccaggctggtctcgaactcctgacctcaaatgatccacctacctcggcctcccaaagtgctgggggattacagacgtgagcaaccacacctggcccaaatttccaacttctttctaaggacaagctccaaaaagggatattatgaaatcaaaagatttaaggttcttaattcatgttgtctaattgctttccagaaaaatgaacaaatttccatacccccaattgatagaggtgcccatttcacttcaagaagtatatttttaatgaaatttgacactacttatctgtcacaacattttaatatctgtagctgccaaatttagacataaggctaatagagtaatttcacacaatatttacataactggcactgctttgggtcatactgatgtccagatggattcccagtcaactctaccttaactgtcaccatttcattcctttcttcctgtccccttgatctggctggtaattaaagttggccagcaagtgtttggcaagtttccgttgtggcatagaatctatgccaatccactgccattgcaaacccacatcagcaaacaggttggctggaaacctttcatctctcatcaaacgggattaagtaatagttttccctaacctacttcaccagagaagtacaatcggggtgttaagagctcctcccatgacaggatacaccaaacggaccttcctggaaaggactggtccgcccacagggacacagtcagtgctaagtcaccttgaaactcaaacttcccacaagtaacacatggatgtctactctggcactcaatcctgcctatcccagacttctctgtagcaatcaacagacggacgcatggatttgtgcagctttgaatttttgcagcctcagcaacattgagcaagccacactcctccaatttaattacggaaatttatggagaggaagaggggtttcccagcatcaacttgaagactgaaatgcagaaaagtctgggtttgcattggccagatacatcctcttggaaccatctttgggttcctgggatcccacatccgtagtttgtggaagatgccgctagataatgggcttgattttttcaagatcttggccctctaggcagcagggtgaacccttcatgaaataccacgtttctaacactaggacctttaaaagcacatatgaagatttaatgtataagactgcttcctgggagacacaggaaagtgtatgtcacttgagcacatatttaaaataaacctattcatggtagcaaagacatggaatcagcccaaatgcccatcaacgatagactggataatgtggcacatacacaccatggaatactatgcagccataaaaaggaatgagatcatgtcatttacagggacatggagctggaagccgtcatcctgagcaaactaacacaggaacagaaaatcaaacacggcatgttctcgcttattagtgggagctgagaaataagaacatatggaaccagggaggggaacaacacacaatggggcctgtcatggagtggagttgggggagggagagcctcaggaaaaatagctaacgcatactgggcttaatacctaggggattggctgataggtgcagcaaaccaccatggcacatgtttacctatgtaacaaacctgcacactgcacatgtaccccagaacttaaaattaaaattaaatgaactccataatccaagtttatgcctatacgtttagcctatggtacctatagtcctgtttttccaccctgatggccactcccctccttggtcctgggttaaaggtgtcttcttgaacacagggagttagctgatttctcccaaagctgctgagcaggtggctttggtagagccatgacttcctaatgatgcaaaagtttagacatatttctcttgttaaaattcatttaaacatgcaaagtttaaaaccattttaaaatgtgtttctgcacacaatttattttagccaagagaaaagaagtgagatgagagcattcacatcagcatactagaaagcactggagatgtaacctggcaggacatcaagtcagaaaaaaaaatatgtttaactcagattggatgaaagggaaataccaccacctaccagtgtgaaaatcccttggcacttcctgcattctgaaagtgtatccacacacaggcacattccctttaatcacggggtgctggggagtggggaggggcagataccaccaatggctctccctggctgcaaggaaaaaacataagcactcccaccattatgataatcatagtcttcaaagcaacctcagagaatgtgaaagccagccttccatcatagagctgacataattaagtttcgaaaaaggtggtttgcccagggttttgctgtgagctattatagagtctgacttctggatgccccatctagaactctctctagcataacaacctagcacccaaggctggtaccactccaaagttcattcttctgttcaaacacaggattcctacatgcatcaacctttggcaagtgtaatttgagtaattatattggaaagctgcaattatttcctttctgtgggtcactgtagtctcagaatattcatgagtaaatcttccaaatgatcaacccctagtagtccgcaggcgtagctgccctttagaaccacttgggggtttccttttgttaatattctgctgagacaccaatcccaaagattctgatgtaatatatgtgagtagggcccagggatttgcattttaaagctcacctagaggtctaatatgtggcctgggttgagaaccactcatggagagaggcagactgttttttcttcttttgcctataaagcaaaatatgtcttgcagggatcaactttagagtctcaaagaatgacaagatctttgctcttctacaatctggatagctttggaaaagtcacttaaccttcttgagcatgttttcccgtctagttagtaacaacagtgcacagagaaaacatctaattcaccttgctatgcccaatgccaggatctgaatggaactagcatttgataaaacgttattgttgaattgagtgaagttgctacaccgaatgcacccaatctcccttccagctccatcactctgggactactcattcattcactcaacaaacactaatattaagttatcaactacattcaggcactagttcaagggcttatatctgtgggaaaaaaaaatctctgcccttgtggagattaagttccagcaagagacagacagactgtaaatgatggacccaatgaaaaagtaagttacaaaggaggtagaaagtgacaaacattatggaaaaacagagcagagtaatggggtttgtgtttgtgtgtatacatgtttgtagatcttggaactaatattttattgctgactgcaatttttgcttattacattgcaatattaaacattatgcaatggccaagttcatccttatcactgcccacttattaagaataaatacattattcatttttaatgctgtgtcagtaaagctacaagacttttttatcatcagtttgagtcttttgtttcctctaaagttggacctggtcattcagaccaaccatcctgctgagaataactaaaaagctggataagtgttgtttaaagtactttgaagggtgtccagcatttgggaaagctttttctcaaggagtatctgaattttccagaagaagttgctaaaatcctgagaaattgagaagagacaacagtggcttcactgaactctaagctctaaccctctatagttagattttgtattttatgcagtttgatgatctttgtattttaaggagaagatttagttcatttatatttacttgccaatataacagagtttatttctaccacatcgcagctctggttcactcttaatggaaaactactatcctttgagtttctagtcctaaatgaggggagattaatcaggctcctgtgttctgagacgtgagatttatcagagcttcccgttcaaagattggagcctaataaatctctccatatttagggttggaaactcaaaggataatagttttccattaagagtgaaccagggctgtgatgtgatagaaacaaacttaattatattggcaagcaaatataaaggaaccaaatcttctcattaaaagacaaatattatgaaactgcataaaatacaaaatctataggctatttgctaaagagacactttaaatataagtatacaaaaagtcagaaagcaaaacaattggttaaaaaaaaaaagatgcattatgcaaacactaactttaaaaacttccagtggtggacacatgactgaggcctgaccaatcagcagaatctaacccctcagccacaatgactggttcagagatgcacacgtgacccaagtcagtccaaccagaactaatctcaggactttcctgatcaactgaaaataggtgctctctgtttccctagggttgctggcaatatgaatagtgtgaacctggagctgtcagaagtcactattcagaatctgagaatgaagcctataaaacggaaagtggacccaagaaatgaagagactcatggcccaggtgatataagttgagctcccagacactgctgtgcctacacttttcagccacatgaacctacagactgcctttgatgcttaagttatttgaattgagtcttctgttgcttgcaacccagagggtcctgactaatacatacaatgtagaagaaccctgatctgacctggtcttcaaacctctctggcttccatttttttcaactctaagatgacaaaattagatatcacttgattgctaaagttcttgcaggagtgcttagtgcatgcatatttaagatactgtatatctacttaataaaaacccaaacacatcattgcatttctggtttattcatactcactcaaacacagatattacactcatcttaaaatcagtacttctattggctttcagctatggttaaccaaatgactgaatcttatatcacaagtgattatgcaagttgattaccattttcagaaactcattttatctttagagattttctgtaagttaaactataaaactgtacttttaatgagcagttacttctgaatatattgggcaaaagcattaagccatgcataaaaattgcttctgatgtaaataaaaatggttttggggttcatcttaaaacaatggcctgcacatctaagatgtcttacttgccaaaaaataaaatgatgcaatgattacagttaatattccactgtttcaattcattccacatagttttaaactgaatggaatgtatttgagaactttgatcagcatcttttataaagtatttttcttatataaggatgagcagatagctgttataagaaataactatatgtaatataatacatataatttatattttataatataaaaaatctaagaaagccctgcatttgtagacaaaggattccaatctcaatgcactgctatatgtcttgggcaagccaccaagaacctctgtgcattccagtctgatatggtttggttgtgtccccacccaaatcttatcttgaactgtagttcccataatccccacatgtcatgggagggacccagtgggaggtaactgaatcatgggggcagttatccccatgctgctgttctcatgatagtgagtgacttctcacaagatctgatggttttatacgggacttttcccccttctgcttgacatttctccttgatgccaccatgtgaagaaggacgcatttgcttccccttccatcatgattgtaagtttcctgagccctccccagccctgcaaaactgagttaattaaacctctttcctttataaattactcagtctcaggtatgtctttattagcagtgtgagaacagactaatagagtaaactggtaccacagagagtgggacgctgctgtaaagatacccaaaaatgtgaaagcaactttggatccggaaccatttggagggctcagaagaagaaagaaaaatgtgggtaagtttggaactccctagggacttgttaagtggctttgactaaaatgataatagtgatatggacaatgaagtccaggctgaggtggtctcagaaggagatggggaacttgttggaaaccagagtaaaggtcactcttgctatgcaaagagactggcagcattttgcccctggaccagagatctgtggaactttgaacctgagagagatgatttagggtatctggagaaagaaatttctaagcagcaaagggttcaagatgaagcagagcataagagtttacaaaatttgcagcctgatgatgcaatagaaaagaaaaacccattttctagggagacattcaagcctgctgcagaaatttgcataagtaacaaagagccaaatgttaatcatgaaaacaatgggaaaaatgtctccagggcatgtcagagaccttcacagcagcccctcctatcacaggcctggaggcctaggagggaaaatggttttgtgggccagatccagggccaccccactctttgcagccttgggacatggtgccttgtgtcccacctgcttcagctccagccatggctaaaaggggcaaatgtacagcccaggccattgctttagagggtgcaagccccaagccttggtggcttacatgtggtgttgagcctgtgggtgcacagaagtcaagaactgaggtttgggaacctccacctacatttcagagggtgcatggaaacgcctggatgtccaggcagaggtttgctgcaggggcagagcccccatggagaacctctgctagggcagtgcagaagggaaatgtggggtcagagaccctgcacagagtccccactggggagctgcctagtggagctgtgagaagagagccactgtcctccagaccccagaatggtagacccactaacagcttgtaccacgtgcctggaaaaaccacagagactcaatgacttccgcctgtgaaagcagacagaagagggggctataccctgcaaagtcacagggtcagagtggcccaaggccatggaagcccacctcttgcatcagcatgacctggatgtgagacctggagtcaaaggagatcattttggaactttaaggtttaatgattgccctattggattttagacttggatgggacttgtagcccctttgttttggccaatttctctcatttggaacaggtgtatttacccaatgcctgtacccccattgtatctaagaagtaactaacttgcttttgattttacaggctcataggcagaaggaacttgccttgtctcagatgagactttggacttggacttttgggttaaagctggaattagttaagattttgggggactgttgggaaggcatgattgtgttttgaatgtgaggacatgagatttgggaagggctaggggtagaatgatatggtttggctgggcccccacccaaatctcatcttgcattgtagttcccataatccccatatgttacgggagggccccccctgctgctcttttcatgacagtgaatgggttcccatgagatctgatggttttataaggggcttttcccccttttgctcagtacttctccttgatgccaccatgtgaatgaggacatgtttgcttcccctttcaccatgattgtaaatttcctgaggcctccccagccatgctgaactgtgtgtcaattaaacatctttcctttataaatcagccagtctcaggtatgtctttattagcagcatgagaatggactaatacacagtctcatcatctatcaagtaggggaaatgcctcctccaaagaaatgtgaggattaaaacacataatatagggaaaggaacctagcatgtaacccttcatgtaagtaactgaacacttaacttgaatctgaatgtccataagaatatatttattataaatccccacccatgcctcccccacaggatggtcttcagtgtttgcaatgtctgggcattaatgctctggtggagacagccctgggtggagagtcagcaaagtctaatcctgacttggacattcatctctttcaccttcattttcttctgcagaattagtgaactgaccaatacaatttctagaatcccttcccactctaaacatctataaaatgcattgctgttgtaatcagtactcagaaatgaccagtggtagagtgagttccccaaattgcattgaaaaacaaagaactctacctctttcccagtattccataaagccgaactcgttagtgtcagactgggagtagggcaggcctggaagaccccaagttctgggaacggaggatgaatagtaagctgagggtcatgctgagcccttgacctgaggatgaaattgtttatgagcttctctgggcctcaaactgtccagagttgccagaactgctccctgatggagatttgtttctttgtttgtttgtttgctgggggtgggagagatctgtgcattaggagacaaactgagccaaaaaaacacccagtttgcactcctttctaaacctcattactaaacctcactgcccaaatcctaatccctgggaaattaacaaggcttgggttatgaaaaccaagtctcctggcagtggttgctaagcaacaagtgatctacagtcttttagccctgctttggctcatcaagcacagggggtcccacccccagcccactcagatttctcatttatactgagctcattaaaaaaccagcaatataagtgctctaggtcaacccacatgagctagtttcttaacaaacaagttgactgggatagtattacaacccacgatgattgacggggaggctgtatttctctgcatgatgtattaaatgtgcctgaggggtgccaggtcctaggaggaggaaactgaccaaataccaaagacctttctcaaaccctgtgctgttgcttataatctggacggccttgcataattattttttcaactttctggcctcagtttcctcttcagtggagtgaggcaattggaccaatgacatctagggccacttattcccagtggctcaagtgccccagcaagctctctgcttctcccaaaggagctcagcagaccacaggagttagcataaggcataacttactggagtggaggggcagcattcatggcctaggctgagccagagaacaaagcttcccaattcacaggctttcttgggagggaggtacaggaggctgggccttacatgaagagacaagggatttgagccagcagagtgtcctggggagctgagacctcagatcacggctggaatggagcttctgggatgctatcacccaggtaacgacagtagcaagacattagtctggaatgcaaggagaggctgcaagtaaccatccaggggggatcctggggctcaggttgtgtaagaagataacacagatggaaagccatctggtagttcctcaaaaatttaaatatggaattaccatataacccagtcattccactctgaagtatataaccaaaagaattaaaaactgagactcaaacacacacttgtacgagcacattcatagcagcactattcacaatagctaaagggtgggaacaattcaaatgtccatcaacagatgactggataaacaaaatgtgatatatatgaacaatggaatagtattcagccataaaaaagcaatgaagtatggataaatactgcaacgtggatgaatctcaaaaacattatactaagtgaaagatgccagacacaaacagtcacataatggattactccatttctatgaaatatcgagaataagtaaatccatggagacagaatgcagattggtggttgccagtgactgggaggagggaggaaaggggagcaactgcttcatggatacagtgtttccttttgggatggcaaacatgttttggaactagattatgaacatacaaaatgccactaaaaggttccctttaaaatggttactttcatattatgtgacttttacttcaataaaatgttttaagacaacacagattccacagatatacctgggatggtttatgatacagagaattggagatatgggatgatgagacaccacaggacgtttcaagactctttattaactgtctacttcaatatgaacaaacttcattgatgttcctttctagtctaatggactgtggtcagaggcctaagaatagaatacaagaactctccaaggaagcatgcttcttcccaggtttctcattaggagtttacaccaggagacaagcagcccttcatcaggagaacccatgaaggaagcaggtgtacaggtgagccctaacaggaaataaagactcccttttctaggaaagaagacctgcctccaactgaggaaggagttttcaaggcatgcatgtagaagtagaagagcagggctgggcacattggttcacgcctgtaatcctaacactttgggaggccaaggcagggggactgcttgggaccaggagttcaagaccagcaacatagaggcctgggcaacctagaaggacccccgtatctacaaaaataaaaaataaattagccaagtatggtggcatgtgcctgtagtcccagttactcgggagactgaggtgggaggaacacttgagcccaggagttcaaggctgcggtgggctgtgattgcactcccaccacttgcactccagcctgggtgacagagcgagactctgtgtctctaaaagaaaacaataaaagaaaaaaaatgtggaagggcaaagtgaggcaaggagatcaactgaatggcctctgtcaacagccttgtaccctgctggtctccatttcctgcacaacatttgcaagtcaatcatttttccaaatatacaggagaaagaagaaaacaatcaagcatactcacatactaccgggaaagatctatgttaggagaaaaagctcttgacttcgcctaaattcccacaggctctacttgcatttatgtgctcttctaagcatataaaacatctgtagggtccggggaaagcaagggaagcaagaaaaaccttgcataaaatcgacttgtgatttttaaaaaggtgtcagcatcggtttttggcatcacgctgttaagtttgaacgtaatgataacaatttattttccttaggagacaaaaagaaaggtgacttcccctttagtcagtgtgcagctccaaaatttccaccctcccacatcctactctcccttggtaaaataaaaaaataataataatatggaatttacttctctccagctaaaggtttatttggggcctcatagaaatgctaatattagttctcatttctctgtttttcctattatctctctcattatgaggcttttctacagaaataaaagaattcccttttgcacaaccaaaaaaaccaatggccaattttaaagagtaaaaatgaagatagagggtcacaaaaacccctcgtcaggagaaataaggctgttctcaaggggaaaggagctaaaaatacaatatggagagtaaagcataagggaaatttgcattttgctgaatattagtgcaagcctttctgcccaagcctggttgaagaacattgtttgaaatcagaccattacaccatcaaaaacttttaagaaatactctattatccaataatgccattaaaattaacttggtgattgtaacaaaatactaaggaacacacgacaattattaaaagtgtgctgagtagttcttaaaaaaaagaatcttgataaaatggttgcagtgttccagcctcaataaaaagtcaagacaaattaaaaatatttaaatatgacttagaaaatctatgccaacccttcttaaaataggcataaattgaagttaaatttaattgtactttttttgttgtttttttgagacaagctcttgctctgccgcctaggctgcagtgcaatggctggatttcagctcactgcaaactcctcctcctgggttcaagcgattctcccacctcagcctcccaagtagctgggactatacgcatgcactgccataccggctaatttttgtatttttagtagagatagggttttgccttgttgcccaggctggtctcgaactcctaggctcaagcgatccacccaccccaccttcccaaagtgcttgggattacaagcatgagtcaccacgtccagctttaattgtacattctaaagaaataatagaatcaaccttatcaatacaaatcttggacaaaatagaatttttcaaaagcaaattcttggcttgaatctgctcattctcaacatattatacagtatggtaacagtataaagcatagacttctaattaaaattgatcagcttccccattaatgaatctggctaaataagaaccaagaattataagcttctaaagagcaaaacaatgagcataagcgaagtcaaatgaaaaatgatacatagggaaaaagagatttacaacacaaaggacaaagggcgaatttaatttccctcattaacaacaagccattacgaatcaatgtggggaaaatgtacaacccaaaagaaaattagacaaaaataggaacaggcaatttcattaaaaaaaaaaaatcttccctcattcataattttttaaatgcaattaaaccaattaaatatcatgttttacctatcagttaacacaaaaaaaatgggggctagtaggcattctcatatgctgtcagtaaatttgcaaaattctccaacctttttggatggcaacttagcagtatttattagaatgcttaatgtatatacatttatgtcaatatatgtgtgtgtgtgtgtgtgtgtgtgtgtgtgtgtgtataggggtcagtgcaacattttttttttttttttgagacagcatctcactctgtcatccaggctggagtgcagtggtgtgatctcggctcactgcaacctctgcctcccaggttcaagcaattctcccgcctcagcttcccaagtagctgggtttataggtgtgtgctaccacactcagctaattttttgtgacattatttaaaaactggaaataatgtgctttagtaaggactgaatatgtaaacagtcacacaatggcatactagtcaaccatcgaaaataatgggtttgctttctgttttaagatatggtggccaggcacggtggctcatgcctgtaatcccagcactttgggaggccgaggtgggcagatcatgaggtcaggagatcgagactatcctggctaacacggtgaaaccccatctctactaaaaatacaaaaaaaaaaaaattagccgggtatggtggcacacacctgtagtcccagctactcgggaggctgagacaggagaatcgcctgaacccaggagccactgcactccagcctgggcgacagagcgagactccgtctcaaaaaaaaaaaaaaaagatatggtaagatgctcaaaatagattaaggaaaacattgcagaacattacgtataggttgagttagcttttatataaaatagtttgcatgcatataaaagtatttacataggcttcacatatgcttatacataccaagaagaaaatgtaaaactacacagcaaaatggaaacagtgattagtgcagagggatgatattggcaggagaggccgaagaaagggaagggaaggttaccaacaggtcttttacacatttccatgcgtttataatgccttagcagttggatggctacccttaaaaggacccatgaagatgcaaaactatgagctgatttcatattttaaatgcaagttagcaaaatttaccttctacaattatttgacaagaatttaaagtgcaattgacaaacctttcagaaaaaagctgggaattgggcctttggggtaaggttgccatatttagctaattaaacatacaagtttcccagttaaatttgaatttcagataaatgatgtacaatatttgggacacacttatacaaaaaatgctcattgtttatctgaaattccaatttaactgtgcatctgtattttgcctgggcatcctactttggggtacttcgaggtccctggctagctcctggtctatgtcttagtccatgctcagaagtcccatgtattcaaccagctgcttcttcctccattccagtggttcttttacaggtaggtgaggtcttaaagaatcttttgaaacttttgagccattccccaggagaatatctacatacaaaatttggcatctccagggtatgtgggtcccacgtgagccccaccccacaatggtcggacccaaggactcctcccacagtccatggcactgtgcagatggccagctacgaggaagtgagcatgttggactttgaggagttcaaccagactatgaaacagcaaaatcacaagaccttttttgccttctttgccagttccaaggacattggaggtaacagatatagccccaatggcatgcgggccaaaccagttgtagagacgggctgaagcatgttcgggaagaatgtgcattcatctactgccaagtaggagaaaagccttattggaaagatccaaataatgtcttcaggaaaaatttgaaaggagctgcagtgcttaaccatggaacccaggaaaaactgatagaatctgagtgtcttcaggccagcataatggaaatgttctctgaagattaagatttgatgatggcagtcatgccttgatttcctgctctgttctggtaaactgcatacttggtttgaattcttgttagcaataaataaataaatgatgatgggctgggcacagtggctcccgcctgtaatcccagcactttgggaggtcaaggcgggaggatcacttgagcccaggaggtcgagaacagcctgggcaatgtggtgaaaccttgcctctacaaaaatatttaaaaattagccaagcgtggtggtgcatgcctatagtcccagctactcgagaggctgaggcaggaggatcacttgagccatagaggttaaggctgcagtaagccatgatcacattactgcacttcagcctgggcaacagagtaagaccctgtcaccgaaaataataatgatgatgatgattttaaaaaaagagtatgtgagtgtccacgcactcttgaaaccatccacagatcccaggttaagaatcctggttctggccgggcacggtggctcacgcctgtaatcccagcactttgggaggccgaggcaggcggatcacgaggtcaggagatcgagaccaccctggctaacacggtgaaaccccatctctattaaaaacacaaaaaattagccgggcgtggtggcgggcgcctgtagtcccagctactcgggaggctgaggcaggagaacggtgtgaacacgggaggtagagcttgcagtgagctgagaccgtgccactgcactccagcctgggggacacagcgagactccgcctcaaaaaaaaaaaaaaaaaaaagaatcctggttctacctcagtgtaaaattctaccctgttttggaggattcttgtcatctcaatatgtgcctgggagaactgcatttctctagctcctcacctgtggtattctaaaaagcaagttctaaaggctctagagtaaccaaaataattttgcaggtggtggggagaaggggggagaacatatttacaggactcaacctgattttaggacttactataactacagtagtctcaagatagtgtagaattggcaaaaagagacataaatgtaataaaataaagagtccagaaatagacccacacatgcttggtcaaatgattttaaacaaaggtaccaaaataattcagtggagatagacagtcttttcaacaaatgtttctgaaactattagacatttgtaagcaaaaaaaaagaacgaaaactacccatacattgcaccacatagaaagagacgatcttaaaatgggtcaaagaccttcatgtcaaaccttaaatgatacatgagaaaacaagaggggatttttgtggccttgggttaggcaaagatctctcagataggacacaaaaagtacaaaccataaaagaaaaaatggaccaatcagacttcattggtctctaaaacctgtcctttgaaagaccttgttaagaaaaggaagggctgggcacggtggctgatgcatgtagtcctagcactttgagaggccaaggtgggcagatttcttgagcccaggaatttgagaccagcctgggcaacatggtgaaaccccacctctattaaaaataagaattacttcagtgtggtggcacatgcctgtagtcccagctactcaggaggctgaggtgggaggattgcttgagcctgggaggcggaggttgcaaggagccgagatcacaagtttgcaccactgcattccagcctaggtgacagagtgagaccctgtctcaaaaaaaatgaagaaagaaaagagaaagagagaaaaagaaaaaaaaaaaaagaaagggaaaggagaagccacagattgggagaaaatatttgcaaatcgcatatcaagtaagggatttgaatttgaatcagaaatatggaaaaacaacctcagaactcatttgaatagacatttcatcaaagaagaggcatggatagcaaatagcatatgaaaagatgttcaacaccattaatcattataaaaatgcaaattaaaaccaaaatgtgataccactgcacgcttattagaatagctaaaacctaaatcaccaatgatataccaagaactgacaaggatgcaagcaactggaagcctcatttattgctgatgggaatgcaatggtacacctcttctggaaaacactttggcagcatcttctaaagtttaacacgcacttaccacatgacccagcaatcccaggaaatcctagttatttactcaagagaaatgaaaacatgtccacttaaagacctgtatgtgaacacttacagaagctttattcataatcaccagacactggaaacaaaccaaatgtcatcagttagtgaaaggacaaattgtcatctagccatacaatggatactattcagcaataataagaaacaaacaattgatacatgaaacgacatggatgtatctcaaaagcattatgttcagtggaaaatgcacatgtatgacgttctagaaaaaatgcaaaactatagtgatggaaatcagaccagtggctgccagggactggggccggggagaggtttactacaacggggcatgaggaaatgtatagggatgattgcggtggtgttacacacctatgtgtcaaaatgcatagaaatgaatgccaagaagagtgaattttactgtatgtaaattatatcttaattttaaaaatagttatgaaatgaaaagggtctgggaatcctttgtagaagaagcaatacagctagtcaattggaagctaaagattttcgtgttcttttcattgttcccgtattgcattttccctttctaaagtaatatacctcggacatatttgactttttgtcctattctaatacattctattgtgcttgaaaattaaccacaaggttttgctccaaatgacatagtgcagaaatctgacttcaacgcggtgggatactaggagtaatggtaattcagccatcctccactcagcccccatcagcccattgctacagactcttcgcttcagtcgtctcatggaaaagaaggactagatacttttcttctcttgtgatttcttccaccacagaatgtcttccataaaggagttttaatctgcctccgaaacccaaaatgtaattacaaatgctcctttatattaactacaaggaccagataagtaccagtgttgaaattctaaaggacctgcttgctttcaggaactgtgagcaaaagatagcagacacgtttctatttccaagcgcctttctttcaagtacagtgatttcatttctcaaatcctgtttttcaaaagccccgtgccttttcttttctctttaagaaagaaataccttaacattacacaaacccaaagcctccatacagaaactaaaacttccagaatggaaccgcaaccctctggttcccttttccctctggtgctcactttgaaagtcacaaaccatggagcagtctgaggcacagcagtacagtaagagtaatgaccccatactcaaagccaccatgcctgggctcagatccccaactctgtcaccaagctataggaccccaggtaggtttccttagccataagatggggactcatattcacttttatcaaaatagcagtttgtgtttatagagggccagttctgtgccagagaccttattattcactttcatctttccaaccatcctgtcaatgattgaggaaacggggtttaggaaagctgataagcctgtagtaactcagttaagatgctcacccacaccccaaacccctccagttagcatttcttttccctgcctcacatacttccctggaaataaactctaactatggtgtccagacatgttggccaagggctgatataaaagaaaaagttcagatctatccaggaagactctagagatttaagcaatttgaagacaatgactgtactctttctgtcagtcccagggccctacctggagcctaggtagaggtagccatcaagagggatggaagagaacaagaggaaaagggaaaagggagaggagccttgggccaagtccaataaataaaaatgaaaaaataaactctttccaccaatgtttacggaaatatttaggagagggtcagccaacttcttcctttatcaagggccatataataagtatttttgggccggacacagtggctcatgcctgtaattccaacacactgggaggctgagatgggtggatcacttgagcacaggagttcaagactagcctgaccaacatagcaaaacctcatctctagtaaaaatacaaaaaaaaaaaaaaaaattagccgaatgtggtggcacacacctataacttcagctactcaggtggctgaggcacaagaatcgcttgaatatgagaggtggaggcagcagtgagccgagatcacaccactgcactacagcctgggtgacagagcaagactccatctcaacaaataaagaaatattttcagctttgtgagccatgctgtctcttgcaactcctcccctctgccactggaacatgtaagcagccacagacaacacttacgcaaacgtatgtggctgtgctcaaaacaaccttatccttggacactgaaatctggatttcatataactttcatgcaatgtgagttttttttaatgtagaggcaaggtttcagtatgttgcccaggctattcttgaattcctgggctcaagcgatcctcccaccttggcctcccaaagggctgggattacaggtgtaagccgccacacccggcccagatattagtttggttttgatttttttttgaccacttaaaaatgttaaaaccattcttagttggtagaaagaatggggatgagaactgtgctttggccacccttgatttagttcatcagaaaaggtgattttttttgttttgtgttttttttcccccgagacagagtctcgcttcagcccaggctggagtgcagtgatgcgatctcggctcactgcaacctctgccttcaggattcaagtgattctcctgcctcagcctcctgagtagctgagactacaggcatgtgccaccacggctggctaattttttttttttttttttttttttttgtattttcagtagggatgcggtttcaccatgttggccaggctggcctcgaactcttgacctcaggtgatccatctgcctcagtctcctaaagtgctgggattataggcgtgaaccacagcacctggccacagaaaagtattgttaaaagaaagctttattagaaatattaaaagctagagctactgcaaagcatttattgaaaaatattctgcacttcccagaacagacctggcacaagggaaatgattaaacagattaaatgtcttcatgtgctttccttctcctaaacacaatccctcctcatatgccctggatctactccacaaggcccagtgccctcctggtgcccacagctgcaccccactaaacctgtcatttattcaacagtattacgtagagcctactgtatgtagccccagtgctgggttcccatgcaactgggggagaagagagcagagattctgagagctcttcctctcaaagacaactgctctaagatgcacatggtgattattgactgaaggtaggttagtgtgttcaaataaaacatgaggagtgattccctaatagtctagactgccagctcatgctctcttcactgttttcttattgttctttgcactcactgggtgagaaggacagaggaggaattaacagaagtgagcaccttttatctggtgtctctctgatgggccaggcactgggctagacacttctaagccatagcaactttcaaggttggcatcaggatcccattttcacagatgataaaaccaagcctcagagaaaggagtcacttacccaaggacacccagagccagattctaacccaggcctgactcccacatttggactctttccattctaagttcactttgagatgcaaaatctataccatttgaggagggtgtggaccaggagtttccaggctgtgagcctggctgcccttcaggcaggagtgaccaaagcaggtgcaactgtcgtttttctctgccacatgctatacactgaacaggctatgaaggaagatgataagagtctagcaggagcttctcaaccctagtcatacagtagaatcacctggggagcacttaaaaagtaccagtgccaggccccaccctaggccaattaaatcagaatctgggggacaggggaaccgtaggacccactcatttttgttcaagctgccaggtcagtctaatacactgccagggctgagcactaatgtggggaagcagaggaaggggtaaatataaagaaattctgtctgcaaacctttgccacattgtcgggttttctgtttggtgggggcaggattctgcagtcactgcctctgggttaagcagctctgaccacagctgcctactgaattgataaggatatctaaaaatacaaccctggcattcagctttctgactcaaatacccttcaaattcagactaggttttctttcttgtttgatgcttatcaaatgagagcataaacaaaaccatttttgatggtaccatgtcacatgagaagcttaagcaaagaagctaaagacaggaacacgtttttgtgaggtggccaagctgagaagagtgatgcctcctaagaatgcagcaagaatgcagtgcacgaaacaggcaaatcattctgctttaataacaccaagaaaacatcaagtttcctgcttttcttaacattcttacaaaaatttcgacaagtttttgttctttcatttcaaaagaaaacttcaagtcactgagaattttctaagaaatcatttatttcagaataaaaagtacacatttataaaaagtttaatacaattaaattttcattttcaaaacatgtcataacataattcatcctagtagagagaaaaagctgtgtctgttcattgaaggaagacaatcaaacacactgaataaactaatataatcattttatatggggaaaactacaatccttttcttagtatatcttttatttttgcaacgtgttaccttttttcaaaatgttttaaacttcattcttgcatacttctttacacttttaaaaagaactttactatgttcttatttgtgagttacatcatttctataaagaaaacaagataagcattgttagtccatgttagagatatgaacattgaggttcaaggatgttcaataattatcccaaagtcacaagaagttcatagaaaagccagagaaagaagcaatgtctctttacatctcagctactattcaacattttgtacatactacaatgtgagtttgtgtgtgtctgtgtgtgtgtgtgtgtttgtgtgtaaagtccagtaacaaagactgatgtagtacaaagaactagaattctttgttagcaaacctcagtcaaaaataggttcctctgaagcagaccactgtttcaagttagcatggttaatcagaagaaaggattataaaatcagtttaataagtaaatttaacttgcatgaaaagcagccacacatgtcccctttttactccaagtgcagaaattaacacattgttattataatcctgaaggataggatccttagggaacatgtaacgaaaaaacaaacaggtatctgactgcttaaatattaggcaaataattattttatgaaaataaaataagctttacaaacaaagtaatacaaatgtaaatagccccttctttgacggacagcccaatagaaggagtttctgtatcactcaccacaaaagaaaaattggcccagccactgccacctctgatacctgcctgcttccccaaatgaaccagaacaagcaagagcggcctcaatttctaatcagttgaagttttttcaaacctatcagaaacattttttttatgtagtgtccatttgcttgccatcatggtaaaaataacttcagctaggacccagaattctaactctaaggtgaaggttcctggttagcatgtggcataaggagaatctgtgtctttgtcacctctgtgcctttttattccagctgagcacactcatacaagctcatttagagcaagactggactcagaaatttctttatcccctttttaatgataaaactcaaggaggttatagctcttgctccctattgtaactatgacaggtccagggctggattttcatctaggcactctttagattctatagccctgtatcaagccagcctggctggctcaaattccagttccagttctcacacttactagcagtgtgacattgggacagtcacttcacttttctgtacttcatctataaaatgggagtagggacagcacccagctcataggacattgcaaggatcagcaagttatgtctgcaaagtccttggaacagtgcaggcacgtggcaagtgcttaaaaggagggtaagctaccatcatcatcatcattacatatctacaaattagattttcatatacagttttaaaatcagctgaatttctcatgatttaagatgtttgcatgtgttagaggactttcagggcagtatcaaaatgtgaccttggattagtcactcaatcaaaatgagcttcattttctgcatttgactaaaagagatgatgattagctcgatctagttaaggtaatgagcatttgaaatatgtgcagaaagtttacaaagaaagaaatgtcacaggtgctcagtgatttacagcacttaattaatttaatccttcccagaaccttagtgtgaacatcccacagagacaggatggacacccactcaaaatttggtttggaccctgagactgaaaatggcatgcatacacgcgcacacacacacacacacacacacacacacacacacacaggatacaaaaaggtttactgctgacataatggggctctctggggagagcaggcagctcccaaatgggtttaaatggcttctgagaacagggaaaggagactggcttgtgggttttgctgcattttggggttggggctggagtagcacagggcaggagtttgcatggtttgaacctcccaccagcaccaaaggagggaacccctgggctttcttatcagcttgttttgatgtggaggaaaagaggaaggggagaggtgaggctttaaagctgtcagcagcaatcagacatcaaggaatggaatcactatcttcatgaggtaggtcccatagatcccatcgttgaagatgaggaaataagacccagtagttttaacttcagcttgacttcaaacccacacgacctacaattcccaaatcctaggagtttccatgactcaggtgacaaaagaagcatgtcctagaccccattgacttacgcaaactcaatcagccaaccacagaaaagctaaagacatccttttttaaaaaagcctaaagacagccattttaatcctaattcgtagtttatgattttctcaaaatttccccacacacagaaagaaacttcaaggttaggttctaatgttaccattgctaacactattgtctttggagaaggaggagtgacgctctgttaaaagatcctctttacatccaggtaaaattccatttccaatttatccagtgagcacaaggttctatttcagcaaccacatagtctgcagtggctaagatccaatttccttatctgtaattgagtatgtgtagtttctctctccctctctcccctcccctccccaccaccccaggtttaacttctcttctgaaattgtcttttgtgttctttgctgttcccatgaaaaatgagtctcaagtcttactgcgagatcatgaacgattaaattaaaatcatcaggaatccatttttatggattgtaaggccctgaatcatctcagtaagtttttctgggtaaccaagtccaatcaagttccaagttcactaagctttcctatgaggattacagtaacttcaccgctctctccaactcacacaccagggcatgcagtattgcttctgctcaggtggatggtgttcacacagctaagcctacctccaatgggagctacaaaagaaatctgaatctgttttgatccagttggtcctgcaatgttatgtattagttcctgactcttcggaatgaattatattatacatcaagtcactacttaggacaaatcaaaatatttatgtttcgctgttagtcatctttaggtggcactaaagagctctttttcttgaagatgtcttatatctgtttttagagtcaccaaaaaccatctcagagttgtgttaaattcccagtgagtctttcttctcatgtaaatcgatgggcactctaacctaccttctcccatccattcccactaaaccctaggtccaaatcaactatttctttgaaggataaaattcagacgtgtgaatataacagcagtttgatggacacactcagacaattcatttcttcaggaaaagtcatataaatcatcaatccacagggaaaattagcgtgagtgcattccttggtttttgatttgcagttattttgacttttgcaaaagcaagattttgttctaatggttagaatggctccaacaggcatttcccccaagaagctatcatgtcccaaatctactcctgaggctcacatcacacaaattcttcctcctcctcatcacctcccttcaagtaactaaagcttattgtaaccagtaaacaaagaggaagagcacagtgttgaaaagatagattcagtttgctaatttgctattaaatgaaataaaaagattctagataaatgcaaaaaaatctggctgtcaaggtcaagtttctcaatcccatttacctctaaaaaatgtaaaacctgtcataatgaaagggcagcctttttccccattgaaagaacctatttgagcattctcaaagtaactctccaatcattgttatcaaatttatatgaaacaaactcctccaccctaaatgtaaggaagatagtatctgatcccaaatatcgtccatattcatgtggtttaatgtaatcatttcagataacttcattatttgccctaccctgcaatacaggtttggggattttctacccgtacacacagtcctaccaaattgcctactggaaatgttgatgttaataggtttcacagagctttaacggacttgtaaaagccccagatattattttctgccaaattctcctgaaaaccccaaattcacgggcggctgctggctacatcccatcgtcccatccctcgcaccgcccccacgctttctggcggcttcccggtgccctgctcacgccccggctgccagccccaagcgtgcgccccgtggagcgtccggcaggaagggcggccctgccagcgccacgtacaatgccccctcgaatgcctccgactgttccaacactgctcctaagcttagagagggctggtcgcaggccgaggggaggcagctgccctcctcgtcctctggctgctttgtcacagccctcaagggcgtaggaagagaaggagaaagtgccccaccacctggcacggggcccaccatcacctgcctcccacaccgcacaccctttacacacacagggtccagccggacgtggagcgtggaccacctggacattgaacacctcgccggggacgctcggagccggctcctccgcgctgccaaggcgggcaccgctcaagtggttcttggctcggcccggcctggaggggcgcgccactcagtggccaaccggagcgtctagagccccgcgcgagaagtgccgagccccggagcggcacaccccgagagcccggctggccccgcccgggaaccagggcgggtaagggaatcagggtcggcccgggggtccgcgtccacgcgggccaagagactggatccatcttcttcccaaagtgggaaagcctgtgtcaggcgtgcccattgtcgggcagcagcagcagggccggcgggaagaggctgctggtcccggaccagcgccccgcaccgcgcccgccgcttccactcacctggcagttggcgccggagatcccggcggggcaggtgcagctgtagccaggctcgccggcgggggccgggtgctgcgggtccggctcagggcgcgaggtgcacacacccccattccggcagggctgcgcggcgcacggcccgggcgcagacaggggcgcggcgggcaccgggttggccagggagctgcctcggggccccgctccgagcagcagcagcagcagggccagcgcgggcagcagctgcgcaccgggcgcctgggcgcggcggggctgcatggccggccgggagggcgcgggagccggagccaggacgcagtgacggcggcggcggtggcagtggcgacgagagctgcgagagcgacggtggcggctagggctgctccgccgggccgggcgcctcctgcagctgcgggatccgcggtt

SEQ ID NO: 2585 - DNA, 80358 bp, Homo sapiens
gcgcgtcctggcaggaccgggcggcggcggcggcggggccggcggcggccagggacccgggcttaggctcggccaggccggctgaggggcgcgggcggccagcgggcggcggacgccgtcatgaacgcggcggtggtgaggcggacgcaggaggcgctggggaaagtgattcggaggccgccgctgaccgagaagctgctgagcaagcccccgttccgctacctgcacgacatcatcacggaggtgggcgccggggaccgggcccggccaggtgcgggtcgggattccggtgggcgccgaggtcagggcccgggccgggtggcgccgggtgcgagccgggctcgggctcaggtgcgggtcgggggccggggctgggccggagtcggggcccgggccgggtgtgaaccgggtgtgggccgggctcggggtgcaggtcggggacctgttcagggccgggtgtgggccgggcacagggtgcgggtcgggggccggggtcagttccggggtcggggcgagagttctgtgcggcccctgcctgggagcccggcctgtaggcccaattccgcggcgccctccgtgaggaggtcctgcccctcccccggctccgggccgccgcttacaaggaggctccgggccctcaggagcattcttacttcttccctgcctgcccttgtatttccttagagtgcatcttccattattgctggcagagctgcttctgtgactcctgcctcgtctaaccttgcagaacccctctcgcttgccctgaagtatgtagcacgtggaaggcactccctaaatcctgggagaatggaaataatattttttatacaacccttctgccccaaagtttccctccataccacattttgggtgcttaataaatgcctgcgggtggatttagtggaggcggctgtagggggacttggcaggaaagactgtaacagagctgcacagcctgccctacgttgagattggtggtctctgtagctttttccacttgcggatggtgtgctcctccgtgacggagaccctggcttgcttattagcatggctctggtgatctgcactgggtaaggtacatagaaattgcacaacaaacatcccctgttgagtgggacctgtcaaggctcgtggtaactccctggtaactctcaggagcgtcactgcagcgggcgcagcacccatttccatggtggacccaagggcacgtgggaactcagaggtgtgttttgggatttaggattcaggttggacttgcagacttccagggcctcatgacctcacctggtgatggtcctcaagctctgtttctcactcttttcaacaggttgggtgccttattcttgcacagactttgctttactggttctgccctcctaccttagcttataacgtgtggtctcctggagcgtgtgcctctgtgttaaaacagtgcctaaaaatgctctcgaatccacccacatcccagggcctcgccagccctggtcatgtcctcccagctggtgcagcacttacagcctgtcctggacagtgtgtggggagaggacctgctgtgtggatagcccggtgggagggggacaatgtgccgcatcaccaccgtcccgtgaagtaggcgggtacccgtcctctgacccagagggaacaagagccagtgtgagcccagcccactctagctgtggctgccaaaacctttattctcccaggcctgtctgtcccactgaaatgcagagccccaggagggaggtgcagggagtgtgccttatccttgtggggcagtgatggcgctcagctcacggtggctgtccagtcactaccgcatagttggtcagaggaatcctaatgggagaggaggaggaacatgggctgggtgctgtggctcacgcctgtaatcccagcactctgggaggccaaggcgggcagatcacttgagcccagatgttcaagaccagcctggccaacatggttaaaactccatctctactgaaaatacaaaaattagctgagtgtggtggtgcacctgtaatcccagctactcaggaggctgagtagggaagattgcttgagccgggaaggttgaggatgcagtgagctgtgattgtaacactgcactctagcctgggtgacagagtaagaccctgtctcaaaaaaaaaaaaaaaaaaaaaaaaaaagaattgccttcttggccaggtagatagggtgtgtggaacgagttgcatgttcccaattaggaacgactggtctgctcttctcccatagacttcctcatctaatgccaaagttgatttctctccctgtgtaaagataaataaattatgacctacttgataaagttgttagaatgactgacatattggaaaggattttcagataataggtggagagcctcttatgaaaatgctttactgtactgaatattatacacacattgctatattagtattttagctatagctacactaaccaccccgtttcattaagctaagtgtggatactgtgacgttaatgtctcttgtcacttacagttattgttcacaattttttttttttttttagagggattcttgctctgtcgcccaggctggagtgcagtgacacagtctccactcactgcaacttacgcctcccaggttcaagcaattctcctgtttcagccttctgagtagctgggactgcaggcacatgccaccatgtccagctaatttttctatttttagtagagatggggtttcgccatgttgtccggcctgatctcgaactcctgacctcaggtgatccgcctgcctcggcctcccaaagtgccgagattacaggtgtgagctactgtacccagcctattgctcacaattttaactgccagcatcctgggaaaacctcaacagggacaaaatgaaaatgttccaggaatgttaaatgcaggatgctcttaatattctacctgtcatctcaagaaaaacagtagcatagctcttacatagtgtggtgtggaatgaaaactcctagattcattaatacctaacttgatgcaaattaaggagttgtggcttgattccagaggaggctctcattagggtgggactgtcttgtttttaaaacatgtcttcccgtaataaatatgctttattagctgacctaggatatgtggctatgagcatacctgtccttaccacataccatgcagcctgctggtaagggtcccagctattcaaaatgcttgttgctacaaattgtattgattttacagtaacctaccacatttcaaaaaactgcagtctgagacaacccaggaccctggctgggtgtggtggttgagaggaacaggaaaaataattgccctaaaagctggttttagggctaattaggaggtacaggttacctgagggaagggatgattagggagagaaccaaagcagtgaggtgtggagcctgccaccatcttaagaagtgagtagtgacacgtggtgaggagaaagacccttgcagaacttctagtcttagcaaactaggttgagaaattccttttcttttctttctttttttttgaggcagagtctcactgcgttgcccaggctggagtcctgtggcatgattctgactcactccaacctccacctcccgggttcaaacaattctgttgcctcagcctcctgagtagctgggattacagacgcccaccaccatgcctggctaatttttgtatttttagtagagacggggtttcaccttgttggccaggctggtcttgaactgctgacctcaagtgatccacccacctcggcctcccaaagtgctgggattacaggtgtaagccactgtgcccagccaaagttccttttctttttggaatctgttccctccattgcacctgaaggactcttgtaaaatgccgttccaggtcctcctcgtggtccttcagctcagttcatgtccctgagtggcttcacagggcctctgcaccaggccccgagtgtctctctggcctcaggctcctgctgtcctacatttcttttgatcccttgcaggggactctgtgggtcctggaccttgtgtggactttcattttctttttttcttttttttgagacggagtctggctctgtcgccaggctggagtgcagtggtacgatctcggctcactgcaatctctgtttcctgcttcaagtgattctcctgcctcagcctccccagtagttgggactataggcgagcaccaccacacccagctaatttttgtatttttagtggagacagggtttcaccatgttggccaggatggtctcgatcttctgaccttgtgatttgtccgcctcagcctcccaaagtgctgggattacaggtgtgagccaccacacccagccgtgtggactttcttatgtttggcatgtgcatccgaaatgtccccttgcccaactcttctgtaagcctggtccccatctaggtatgattcctccaggaagggttccctgccactcctgctccctcccggattgtggattaggtaccaagcctgagtgcttccttagtacctgcatggtgtcatctttacctgtctgtccacacagccagactaagttctgagaggatctggctggcttctgccctgcacagcacgtgtagtagacatcaaatatttcttaagtggatgattcaaatctgggctgctagtcaattctgacatctcccaagtgtggagttgagtggatgaggctgatgaggaggctgtctgtgaggtgacatggtggcctttctttctctcttgaaggtgattagaatgactggtttcatgaagggcctctacacagacgccgagatgaagtctgataatgtgaaggtgggtttgagtcgggcttctcctattgactcctcgccttaacggatgggattttttgtaggcctggtagtgtggcttgtgtcatttctctgctgcatgtggttggaatacaaggtcagtgaattcgtaaattgatatatataccctttctcatttcattttctcattgtggcaactggatgtcatgctagttttattcactgaaaaatgggattagtatttcaaaggttaatgctagcccatcaactaaattaaaggctttaatgaattgtttttgttttgtcagtaaaaggtcagtatttctagatttgttatatatctaaaaacagctttgtatgtaaacagaaactatcctatgcctggtaaacatacagaagataatgcacactcttcaaagtattgtaatatttgtattttcaatggaaatgtttcaggataaagatgcaaaaattagcttcctacaaaaggccatagacgtggttgtaatggtgtcgggagagccactgttggccaaaccagcccgaatcgtggcggggcatgagcctgaaagaacaaacgagctgctccagataattggaaaatgctgtctcaacaaggtactactgctgtcctggcattttgaacttacttagtacttgagtaaaaagtagtcgggggtgagggactcacatgtgcgggcggtttagggaaggagtttcagtggtgtctgtcaaacactgtgctttgaatctgatcccaccccttctggagccccagagatacagaaggagtaatttaatactgaatgataaaacaaataagggtatgtaatacgcaagttctgcaagctttcagtagaaagtcgggaaccctgcaggcacactgtgcctggctggaggctggaggctgcaggcccaggcttccatgccctctggctttctcctttctgaggctcccttgaggacaggtggctgcttccagccagggctgcagtggctgcaggagctgcttttcttcttccctgggtcttatgggagtctctgttctcttcctccatctccagcctctggtgtctgcttgcctgttgcccttcctctctctcttccaccttttctctctctctcggttgctgtttcagttgtacggggagtagattttttctttcttgagcttttcactgtgggctagaaacttgggtgtcaaggcctcaggcttctctagttaggtccagcctgggccatgtttgcccaaatgttggagaaggtctttccccagggtcttccttcttttgagggccgagtagtgccctgtggaggagcaggttggacttgtattgagagtgtaattaatacagtttttcacatacctagtgggtggttggctgggggctaaccttaaatgtgacccaaatgggaacaggtaggtttcagccccctcaacagcagtgggtagtggaggtgcatagtggtatcaggccgactcctaggaggcccccccagtgcaggtccagcatgcaaacttagagacttggaagcagatcttgccagtacactggcctctgtccctaggctccccagctccccttcccgggtcctttatgtttctcatctttctaaaaagcacatctggctcctgtctcctctgctgaatcatctccggcttccagtagcctcgggtctgggccagctccatggcacagcttgtgaggctcctagagacctgctgctacttctctcccttcagatccttctctcgtttcccatatctgagccctccattccagtcgccacgcacccctgcattcggccctggccggctgtctcccgtcggcctcttgccctggtgcctgctggcttcttggtacctgagctgccttcctcctccagcctcacccagcaacaatgtggcgtctgtgagtgcttccttgagcctgggcctctcctccctcccaggctgacttaggtgcccctgtaggcttcctataggctgttgtttaattgttgtgtttatctgtgtccccagtacacggtgtgtctttggcctaaatggagcctggcacgcggcaatcacgcagcatgtgcttgtggaatgagtgcgtgagtcagtgggactcctgactgaggtgtcctgcactctggatggctgtcggggatgctggagaaggaatttttgcgtttgatggggcttgaatcagatcagtggttttttacccataattttattattgtgttaaagtccataaaacataaaatttgccatcttaaccatgttgaagtgtacacttcagtgctggtaaattcattcatctgcagccatcaccaccttccatctccaggactcttctccttgcaaaacagactctgtccccatgaaacactaacttcctcttctcccgtaccccagcccctggcaccctccattctactttctgtctctatgaatctgactactctagggacctcggataagtggggtcatagagtgtttgtcatttttttgactggcttatttcacttaatataatgttctcaaggtttatccatgttgtggcatgtatcagaatttcatcgctttttagggctgaataatattccattgtaatggatataccatattttgtttatccactcaactgtcaatggtacagtttgctcccacattttagctattatgaataatactgctatgaacatgggtatacaaatatctcttcaagaccccgttttctatttttttggataaatacccagaaggggaattattgggtcatatggtaaatctgtgcctaattttttgaggagctgttatactattttccataatggctgcatcattttacatttccaccaacagtgcatgagagcttcaatttctccttatccttgccaatgcttgtggttttgtgtgtttttttttaggagcagccatcctaatgggtgtgaggtggttagataaaatcttaaggcacttatggctgggattctatgatcccattagaagtttaaggtatttgtagtagagttgcatgggtcagctttattaaccttgaacacacacattcacatttgacagcttgggtagacttgaaccaggattcatttagcttgggtggacgctactgttagtgaccaaagtgctgaaagtaatagttatcaagatatgctgtgctttgtatgtgataataacatgttcaaaaaatattttatcctttgaatttcattgtagacagagaatctgtctcatgagctatctttgaatggcgatgttctatttgttacgtgtgcggatctcatttcacctaacacctcatttccttccatttggacgacaagctctctagtgacgatgcggtgcggagggttttagctggagagaagggagaagtgaaaggccgggcctcactgacctcaagatctcaggaattggataataagaatgtgcgagaagaagagtccagagttcacaaaaatacagaggtgaattccaagtcgcacatctttgaaaatgaaatagtgagtctttttgtagtttaggtaaaaatattcataaatgattttatttttatttcgtaggatagaggagacgctgaaataaaagagagaagtacaagcagagatcgaaaacagaaggaagaattgaaagaagaccgcaagccaagagaaaaggacaaggacaaggagaaggccaaggagaatggcggaaacagacacagagaaggggagagagagagagccaaagcccgggccaggccagacaacgagcgacagaaagacagaggcaacagggagcgggacagagactccgagcgcaagaaggagacagagagaaagagtgagggggggaaagagaaggagagactgagagacagggaccgagagcgcgaccgggacaaagggaaggacagggacagacggagagtgaaaaacggggagcactcctgggacctggacagggagaagaacagagagcatgacaaacctgagaaaaaggtaaagtcttgctgagaacctcgccttttgcttagcaagagtttgtggtggtctcaaacatgatttttacctttcttacaatatgactaggaaactggttttcttttatgcctatttaaaatgatgacaatcttggattctcaatagaaacccaaagagatacttatttcttgtcagttgtgttttgggtttttttgttcatcccctaatagaagtttattgttcagccaatcatttattaaggcattattcagtgagtttttaaccatttcctacttcatgtccagggagaattctgctggattataagctccctaagagcaaaagctagagatttcactcatgttcactgttggatgcccagtctgatagagtgtctgacacatagcagctttgcagtaaatatttggtggtggaatggattgagcatccaggcaaggggtgatgggcttttcagatcatgaaacactggatggaattgatcaattgatggtggtttctgaggtctccctttatggaattttgatctgggagtggtagaagataatttgaagggggatgtcaggaaaatattaaatgcttgctctttttagggtttaatgattccccaccaggcatgtagagaaatcaacgtttttcagagtttgagctgatttgccaagttgctcttgtccttgtcttgcaggtgttttaagatgtgttgcttctcccgtgcgtgtcgtttgtgtcatttgtgtcactctcagtattgctctgaaggctttggagcagcctccaccttagcattgcaagcggtgtttatgcgcagtctgagttgtgcatgtggtgtctttaggagcatggacattgctcagttattaaggattagggctgctttcaagggcttttaggcatcagcagataagtacaataagacctgagtttactgtaattattgtttaattaaattttcaggtaaatttagggtttgccaggaagtcctgttggtttcaaactgttttctcaatgtgtgaattctttctggacccaccatgtgtgttggggacgttttcccagacacccagacacgcattctttgggggatgtcaaattgtaaagcatcccgcgaagatgttggaaatcatcttgtctccagctgctaggaaggaggacactgaggtcgggaagggatccagatctgcccagttgatccggccgggcagtgaggggcagggcctgagctggtgccatggcctcttcctcccgggacagccatcttgtcttgtggcactgcgtctcagggtgtgcctgcccaggggaggtgggtgggcgccacaggactgaccctgagggaatcctgtaaaccaggctttcctgtgggggtcagtataagcccattttgtgatctgtgggtcacagtgggatggggggtgcctactggcaagactgtggttttgttagtaattgaacgtagtgttctacaaggcactttggagttttactatttaaaatgtcactctttccccctccactgcacatcctggagtaatgtaccctatgatatgtgtcatacctggctttccttatgagtcttaggaattacaaagacattccccatcttttgctcctttttagaggtgtaagaaaaaatatttttcatggacctgatttttctgaggcactagtatattcgggtgtattttgctgtgcatgaggcatcctaggaaggggttaaccttcctcagctcacaaagccttcggattgagggtccccacgttatgttccctaaaactgctaatgaggtgactggctttttaagtagagagaaaccattccaaagaaattcttagaggctcggccgggcatggtggctcacgcttgtaatcccagcactttgggaggccgaggcaggtggatcatgaggtcaagagatcgagaccatcctggccaacacggtgatgaaaccccatctctactaaaaaaaaaaaaaaaaaaaatacaaaaattagctgggtgtggtggcacgtgcctgtagtcccagctactcaggaggctgaggcaggagaatcgtttgaactcgggaggcggaggttgcagtgagctgacatcacgccactgcactccagcctgggtgacagagcgagactccgtctcaaacaacaacaacaacaaaaagaaatttttagaggctgatatttgggaacatatcagagccaagtataatggtggttttgtttaaaagcgtctgagaccatggcgaagtgattttttcctactcgaggctgttgcttacttggctgccgtgagatttgcgtggatctcgcatggtggttgtgcttgccaggctcttctgtggacgatctgggggcttcttcattgagccgcgtaggtctgggaggcagctgcgtcctttcctctggtaaaaagcgccaggcaggtgtgagctgctgtgaggcgcctcccgaggaacccctgttcccagggaccttactcacatctacgctggggaggcaagagactcaagttctaaccccggttctgcctcagtcattctttgtcctcttccccattttatttctgtctagtagagaggctgatgagatcctaggctacctcatgggcttttgcgaagaagaggtgaaatagtagatatgaaaacacttggaaaattaagagtgcagttgagaggccaggtgctaagttagactggccatgtgggggtcccaggcccctgcttaactgcctcttttatgggtagcacgtgtgcagtgcccagcttgcagtcatgggtaattactgctgatacaatctgataccttcataattaacttatgaggacattgaattgttgaaatatcgaacaggcattctttgcttttcagtcttcctagaggaaaatctcaatgaagataatcattctactccttctactctgagatatgtcttctggaaaagtgatttaaggcgtgagataagatggtgtttacggttttcatgcagtttatgttatgagagtgctttcctcacttaaagtctgaagcctttgcgtaaaaagaattgccccattctattaataaagttagcctgtgatcagcagaggcggctaggagcagtttctccgtgggtgttggaggtttatattgttcattccctccctcacttccagatccctgggtttcattgcgatatgtttccaggaagttcggtgtggcgtagggattcgtgttctgtgtagcttcctgagagtcaggagtatttgaagtccttgcccacctactctgcccttatgggaagagatctccctgccattggctcggaagactcttggggaacgcaggcagcagtaacaattgtggcgatcagagctggactggcgatgtggtgttctcatgggaagaatgatttcactgttggtcagtgttatagaaaatatcttggcatatttttagatattatggattggaataattctaaagtttgaattttttttttttttaatagtcagcaagctcaggggagatgtctaaaaagttatcagatggaacttttaaagactccaaggctgaaacagaggtaaactttaaaaaataacttttaagagatgtcaacttgtagctgtgttgaaatagtgaatgctgtgcgctccccgggtccactgaggcatggaaggagcacatggtctgggcctatctgtaataggtccattttatttggttgtaaaagtaatcagttaaatgctttacctcctggtaaaatagatgggtgtgtgtattctctgattttctgtggggcactcctgggtttacttatgcctttatatgacaagtgtgatatgtggtgtgatagggctgtcattttggggagaagggggaggtggcactcaggatgagtctggaagaggcaggcgtaagtcaccagacagacggggccagtgggagggacccctccaacctctggttggcctgttcaggactccgcgatgcatttcctggggctgggtatggtagaagctcatcatctccacgtgggccgtcttgtggaggttacactcatcccaagcagtaggggccactgagaggttgaagccaactttcgtaatccaatttgcatttcaggaggtcttcaggaggttgcagggagatgggttaggcatagagtagaggctgggaggccagttaggggagagaggtggtgagactggaactgtgccagtggagggaggaataggatgtgctgtttcctttgatttgtgttctgtttaaatatatgtaaatttttaccttctgagttgcttacaagtgcatttaagtaattaagtatatagcaacagaagtggagtcctcataagcacatccaataagacagtgtttctcaaagtgtggggagcagattgttgacctttttagggctgtacagaatgatggaattctaaatatagtgtgaaaagggttttggcctccgtgtaattcacagtctcaggtcttgagtccttagtagtattgagtttttaaagcatatgggcactattgctggatttcatacttgttcttcctcaagaagagcttgaaaaataaacctgcttatgatactgctgtgtaatacatcaattaatttcttttcattcttttttctttaagactgagatttccactagagcttccaagtcattgacaacaaaaacatcaaaacggcgatccaaaaattcagtggaaggtactgcaaaacttatatatgtagctgaaaatatggatattagttttttttttttttgtcttaatctcaatgtctagtaggaaagaactcctatggctggaaaacagacttgctgtgtctgggaatgaacagcgtgtggaaataatgaagatttgtggctgttacatacacatgcgtgtgtgcacaagtgtgtgaactgatgacatcagggcagagtagcccctctttgctggagatctgtgttgaaatctaaaagttgtgatcaaattttcattttccagaaatacttatcagccatcttcatttcagtagttctgtcctttgcgttggcagtctgcatttaatcctgatgcaggttggatatagagcatgtaggcagataatgtttatgtgtttaaaaactgcagaaattatgattggaagccatgctaaaagccgaatgtacaggcctggcctgcggtccgctgaaggatagtaccttatcatcttgcctaacataagagtgtcaggcaaatgcagggaagccctgttggaggccactggcattggaggcttatttttcattgaagtatgaagttactttgaatgagcagtgctagtttctgaaaaatcatccttttcctaaagtgtgtaagttaaagaagggtggcaagatgtagtagtgggaattttcgccttagaaaggaggcttagatggtaggttccacatgtgcacaataattagtaatgcgtttgtgaccagcttagtgccagaagcctttgctgtcttttggttgaccgctgtggggtaggtttccagaagcgcagtggctggcacaaagggtgtggcattatggctactgcgtgcccttaatgacccttcaccccacaccttctccagtgttgttaaggcatgctgattttgatggacgaaaaacaaaaacgttgatgaccagtgaaatggtccttgtcatcgcgtgtgagtgttttgggcgtctctgacctgcctgttctttggtttctctgggttcttactgatttgcttgcacgtgctgtatgttaaggacatctgccaatttgccagtttttgcatgagtgtttctttttcagtttgtttctactaattatatttggtttggtttctgatttgcctaagtgttaaactgttatgtgcttgaggcctctaatcttttttttggtaatctgtccagagatttgagaggtgaagatttgtgctttatcatacatttttttttacttaatttcttatgttatctcttactttaattcatggtataaggtgaggctctgaatctattttgtcagaataatccatccgtggttccaggatcacttattcattgaatgcttctctcctgctctgtgaagccttttgtagtctgggttacgggcttttttgtgtgtggtgttttttacttccacttttttatttttactattagttttctatcattgttcttttccaaaaagttttaagccatcttatttgcttattcttccggatgaattttaaaaactcttcatgactcaagaattccactcttgcaaaataaactaacgtctcagaatttaactggacttgtgttaaatatatgctttcattagtttaggaagtttaggcacctctaacttcagcttagtgaaggtgtccccctcttctgagaacacgttgcgtgtacttggttgcgtatgttggtcacagtggttgctcgctggtttattttattttattttatttatttatttatttatttatttatttatttatttatttatttattttgagacggagtctcactctgttgccagactggagtgcagtggcgcaatcatggctcactgcaacctcactgcaagtgattcttctgcctcagcctcctgagtagctgggattacatgtgtatgccaccacgcccagctaattttttgtatttttagtagagacagggttttaccatgttggccaggctggtctcgaactcttgacctcaagtgatctgcccgcctcagcctcccaaagtgctgggattacagctgtaagccactgtgcctggcctgttgttgcctcttaatccagtagttcttctgttgattcttttggctttcctaagcagacagttgtatcatctgctcttcttttctaattgcttctgatatgtgcatctgtgtttactggtgagcttgtgctctagggttcttttgtatggtcttaagagattttattagcagacatttatgggctttttgacactgagcttccctgagctatcaacagctcagtggactcctgtcttcccctcctgctagccgggcactgacctccctgtgggttccccagcaaagctggcactctgcctgaacattctgcctcgcttaagtaggttctcatttgggcaaatgctcagtacccagaggtgtgtgacacactggacctctgtgtcttgctcaaggggatgaatgagactttactacagggtgtgagggtatcacattgttaaacatatttagactcttaaagtcattctggaatccctgcagaatccagaaagcattctgcctgagaatattataatttttgcttatttctaagtagtgcatacagagctgatcactttgacttaatgagtacattttaatttcatttgtttgttaactgctttacattacattacagattaagtttaatatatattttcattgtgcaattttatgtcaggaagaagggaccctaaaaccagtgaaaatagtctttcccctgaaaaggaacataacttttcctactgtaaagctaagaaggaacatagcatgaaacagcttggtaagctaagtgaaccatagtggaggctgtgagtgaatgttgagagttgaaagctttactgcctggtcctgtgcttctgcttggtcattgaacatgtggaagtctgtgggggtggttggcataggtgtggccctgcttgacctggggcctgcgctctagaacactgccttctggccagggtggagagggggcagagggacatgttggccccatgcagggctgcccctggccaggtgaggatttcctaccctgagtcaatcacaggcttaaattgtccatttgagccttccttcactgattctgcagacatttatgataataaagagaacacaggggtacatatgtgcatgttagtttgtgatgaatcttcaaggaaaatgaagccaagaggagcaggaatgaggggcgtgagcagggagggcctctctgagggaggacatctggacagagagctgacttgggtgaaggaggacatgcaggtgtgtgagtggtgaggtgggtggagagaggaacagtgataggggaaagggccgggccaggaagcagggcctggagctgctggtcccggagctgctgttcccggtccacagcagctgtgtggtttacagtgagtgcacacagaagtccttgaagagttttaagcagcaccgaggcaagatttgacttaggttgtagaaggcctccttttaaaactgtggagtggcaggagtaaaggctgcagcgcagcgaggagggggccatggcatctggatgagaggaggtgatggtttggaccagagtgccagtggtgacagcagagtgggtttactgtgctggcaggttggatgccacttgtttgaacggaaaggaatcaaagatgagattcattgtgggaggggtctgggctcctagggggtggcctttattgacatagacggttctgggagacactggttggtggaatgggtggcagtgttaggaattctgtgttggacaacaaatttgagatggctatggaccaaccaagtagaaacatctagtcgacagctggatatattgacttggagatcaggagagagctggagaaaccaaagggaaaaacaaaaaatggagagttctagcatacaagtgatgtttacggacatggacctttgcgcagtaattagtccaggggcgtgtgtaggtaggaaaggacgtggtgaactccagagcttgctgtggtcccccaggtcagaagaggaagaggaggaggaggaagaggaggagggaggatcatccttgcaaaggaaacagaaggccaacaagttggaggaaaacttggagaggaagaaagtgttagggaaggagagggggcttcttgtcaagctctaaggaggggaatcatgtggaggctgagaattgaccatttagttgacaagacagtttgctggtgaccttggtgtaatgtaacccttataaatcccagctaaaacaaccaaacacaaaatcttttataatattttaatctgttgttaactattttatgtcaggaaggaaggaggataatatttcagctaaaagtttagactccatagtgtctggaataaataatgagccaaatcaggaaacgacaacatcagaaataggtaagaaaaatatattctttagtttaaattcctcaccactttaatgtgaatggttatatctcaatgtagttatacattgttaaaaaattattctaactactttaatgttcatgagactttttcatgatgtattgaagactggacataacttgaggttttatttgctttaatatgctaagttatgtaactttattaactcagcttttagttaattatatgcctttttatacatagattatttttacatttcagtcaaaatgctttcttaatcttgctgtcgggatctcacagtggtgtggctgatgacatagagaaacggtttttatgtcttcgtcctgctctgctttattctactcagaaaatgctcgcagtagagatgtttaaagtgctagttaggcacgttggggaagttggcctgtcacagccaatcacattcagtccagccgtgtggtgggtgtgcccagccctcgtcctgctgcctcagagggggtggtccttggttcagtatcagtaaccactgtcatctgtgacttcagacggaattcttcaagatgctagaattcttcagtttcacttaaggtaaaaatagtgtaaaattagactttaggggaagaggaaatttttgctgggcccaacttgccttgtatctgtctgacttttacacgttctggagcgtagctggaataccgatcagcacatccttctctctctgtgtgcgttcccctgagagctggcatttccaggagtgggcgcacttggtacagcagccgcagtgtgaaagatgatctgtggttattttattccaagtagggtgactatatgggagttgtctgggtcttcagtagcatgggatggcggaggaaaaggtgactgagctggagcagggtgtttccactgaagagagcccctgccatacaggcatgcatgttaccattcaaccacatcttggtgatgtatgttttctttttgtgggagctttcctcatctccaggcgcctggggggaaacacccaggcacactgcaatcctgcactgcaggagagggcagcaggcagtggcgaaagcctgaggggtggactcctggtagcccccacccagctagctaggacctcatctctgaggccacagggatgactccccacttcctgcttacctgcctcatggccttgagccagccacgtgagtgggttctctgagccacagtttcctcgtcataaatgggcgtaaagatacctgccttgagggtgaacgaggtgtccattaagtggtggcttgccccaggcacgccgcggtctaacccgctttatcacggatcacctctgctgagctgccagccccagatcagggcgagacagcgctcatcctgagatgggcaatggatttagaacaaattgaaatcattctccagacacgtagtgaggactgtgtaggtaatatcaacaagtgtgaagataacacaaacccaggcagtaagaagcacaaactgcaaacgtggtttctgggttgaactttttgcagagattgggatggagcctgatgccacctgctggggagcagagtctcccgctgtccttgggtggcagtgtgcggtgggtggcggggcgggggggttgggaacagtggccaggagcagagtctgggctctggagagactcccggtcccttgtctttctcctccccccgaccctggccctgctcccctagggtcctgccacagcgcggacctggggtctctgtcctcgcagttgcaggtgttaccttgcactggtcatggtttaacatttggaattcagagtttgctggcagttgttacagttccttaatttcttcattgagggtgcactgctattgggtctggttaatgagctggtcctcacagtacctttccttcttagtgcttcgaagaaaagtccatgttgtcaaagccggcctttgttgcactgactgacccggccctcgtgagccctgtgcccatagcctgggtcatcatcagagaatttgtgggttttattgttaccattttgattttttgggtggattaaagagttcaacaaggaatttatccatttctttttcaaaacatgaacaatttcttcctgtactccagttgttatgcaagctgtaaggcatgctttgttcgctttacaattgtgtgacagttccaggtttttctggaacattaagtcaggtctttattttgcttagtttccctcatttcatttttgcttacttctctaactgtttctattgtgaaaaatatggaaaagtagaaagaatagtacaactagtgcccatatacctctcacccagattcactagttttacgtttgccattttgcttaatgtacagttatgcgtgtgtgtgtgtgtgtgtgtgtatatatatatatagagagagagagacagagagacagagacagagacagagtctcactctgttgctcaggctcgggtacagtggcatgatctcagctcactgcaacctccgcctcccgggttcaagcgattcttctgcctcagcctcctgagtagctgggactacaggtgtgtgccacgatacccggcttcttatgtgtatttttgagacagggctttgctctgtcactcagcctggagtgcagtggtatgatcatagctcactgcagtcttgaactccttggctcaagtgatcctcctgcctcagcctcttgactagctaggactacaggcatgtgtcaccatgcctagctaattttttttttttttttgtagagagagcatctcactttgttgcctaggctggtttgaactcctgggctcaagtgatcctttcacctcagactcccaaagtgctgggattacaggcataagccagcagacccagcatatagttacatattttaatgaactgtttcaaagtatgttaaaaaaacatcctaacactttatctctaaatacttcgacatgcagctttaaaaaaaagtacattttcctacatagccagaaaagtattgtctaactgaactcagttattgcttcctgatagcatctaaaacccaagctgtattctaattgtcccagaaatgtttttctattcttttttttttttttaaaaaaaaaacactggctatttgatgacatttaacttagtgtagctaaaatttgcgcagaacactggccgaatgatggacctctttcaattgtatttatgggccgtacgtctgattagtttcaataacagtgactgatagggactggcccctcccagccgggcacagtgctccttgctgtatgcacaagatctcatttgactcaggatggctctgtgaggcggggcaaactgggcaaactgcggctcaggaaggctgagggacctgaccaaagcatagcccatggagagaggaagcgccagtgttccaccctagggcgtcttgagccagggctcacattctcacctacaaggttcattggttaccaggtagctctagaaaacagattgtgcttatgctgtgactcttttttttttattttgccaattcatagtcatttttattttattttatttcttttttgagatggagtctcactctattgccaggttggagtgcagtagtgtgatcttggctcactgcaacctccacctcctaggttcaggggattctcatgtctcagcctcctgagtagctgggattacaggcgtgtgccactaggttcagctaatttttgtgttttcagtagagatggggtttcaccatgttggccagactggtctcaaactcctgagctcaggtgatccacctgtctgggcctctcaaagtgctgggattacaggtgtgagccaccgctcctggccgtcattttcattttataagtgcattatttatttgtttaaaactattatttgacaaattggttagtcccttctctgtgattatgaattgattctacagtgtggtataattagtgagctatagtctgttttcatgttctttctctcggtgtgaacttggggtttagtaaagcttacataagaataccactagaactttgaaaaggtaaaattgtgaaagtgtcattggtctctgaactacagaatgaagataatgcatttataatttgcttactgtgatggtgaatatggtagagtatggaaaacatttgacactttgaaatcaagtacacaacttaaaattattagagtgttttcttctaaagttgagcatctacaaccgccaaacttatgtttatttttagatttttttttgttaagaacttaatatttcatgtttattctctggttaccctgagtaaaatataaataactgtttgaatcagactatttaagtcagtatcattttcacagattgataaaaatgtctttgcaaaattatgtgtcatctattttatgtagttctattacattataaataaaacagttatatgatagttaatgtcaggttgattctgatgtaagctgttttgaatagttttaagaattataagattgtgtttcaggaaagggaacattttacaattttatttttgtctctcagtttctttttagagtggtaggtcctttgactgaagctagttttccagctctgggtcctgctgtaatatagaacctattcctctagcccctcatctgggccccctatttttttttttttgagacagagtctggctctgtcaccaggctggagtgcagtggcacgatctcgctcactgcaacctctgcttcccgggtccaagagattctcctgccttagcctcccgagtggctgggactacaggcatgtgccaccacacccggctaatttttctatttttagtagagatggggtttcaccatgttggccaggatggtctcgctctcttgagctcatgatccaccggcctcagcctcccaaagtgctgggattataggcgtgagccaccacacctggctcctaccctttttttttcagacatgatctcgctcttacatgcaggctggagagtggtggcatgatcatggctcactgcagcctcgacctcctgggctcacgtgattctcttgcctcagcctcctgggtagctgggactacaggcacctgccaccatgcctagctaatttttgtagatatgaggtttcgctatgttgcccaggctggtgcctgccttggcctcctaaagtgttgagacttcaggcatgagccactgtgcttggccttttttttttttttttttttccccgagatagggtcttactctttgccctgggctggagtgcagtggcgtgatcacagcttattgcagcctaaactcctggactcaagtgatcctaccatctcagcctcctgagtagctgggactacgggtgtgtgtaaccatgcttggctagctttttaaattttatatttttttgtgtagacgagttctctctgtgttacctaggttgtctttactcctgggttcaagtgatcctcccacctaggcctcccaaaatgcggggattataggtgtgagccactgtgcccagcctgttttttttttcacagcaaaaatattttctcaggtatttgatattttttctatcttcataaactttggaacatcagtcagtaattagtagacaatatgtggaagttttcaatatggccaggactgtgcactgtgtccaaaatatttttcttttcttcctgcattcctgaaacagccgcctacttgcagcctctcagctgctgggtctggctctactggggaggtgagtggagactggcagtgtcaggtagctccagaaatggggggcgggggcagtctgctcctcctggcctgagtagaccaaggatccactcatagtctggggtgtcctttccctttcaccccagagccgcccatgggggaggaacattctagatgcatgttttctaaaagctgcctttggtcagtcctttgtcagtcctaacttgcagtgtgggaaaacatagataagtaagtgtgctctatgttaatgaagccgctgatcaccggccctttggtgtacagtcttaatgactaattttaaactgttttatgtcaggaacaaaagaagctaatattaactcaactagtatttcagatgataattcagctagtctgcggtgtgagaatattcagcccaaccccacagagaagcagaaaggtaagaatggtccagtttcgccctttcctggcgagagcagagtgagccctccagaaccttcttctcaaagggccgcagcccagagcccgaggttttcctcttgggtctgaacgtggcaagtgattcacagtgattcacttctgcctttttgcataaactagaatcgaacatggtggtttcttgatagcatgggacccactcgtgtgctcccccgtgctctgtaagtgagaggaggtggcatgtttcatcacttggggggtgtcatgagtggtccctgaaaagtttcggggtcactacttggagagccccaccagtcaagaggtgtaccccccagacttcatggtcacagtgctgtggccaccatgatttttctgtctgtcattttctttgagtgttgaattatacctcagtgggattttactttcaccataaattttctcagcctttaaaaaaactttggtaaaatagccattcaatgtttgtgttttgaggccttggagctcctaacaggcctgcaagggtaccagtgcccaggtaaccaaggcttgtgcaggtggcagcggcagggtggggtgtggccaggggagggctgatgtttgttgatttgttcaaacagaaaattatctgttgaaggcctactgcatgtcagccctgaggctgggagcgcatgagccagtgaagtcaggctggcctcctgccttcctggtgcagatgaggctcgaagatcaaccgaaatcgtttgatggggtggcagtctgggacgggaggggccttggttggtgagggtggcccagaaagcctgcagggcagaaggggctgtataaaccaagatcccggctgggatgcgactgcagcagggctggctcagcccagaggaagggccagagccaggtccctgtgccagcttatggagtttagcctttattggaagagcagcgggaggctaattatatctttaggaggagcagtataatgatatttagattttaaagagtggccatgttaattagggagggttaaagattgtgcagagaagagagagaggcctggactgtggaggcgccctgggaggggagaagtggtaggattccagggctgctggcacgtgctgggggagctggcctggagcgtagagggaaggcccaggctagagaggagctgtgagagttgctggcgctgggtgatggcaggagcctgggtggggactgggtcacctaggacgagattgtgagtgcaggagctggcagagcactggcgctgtggaagcacaggcgtcggggaggatggtgtgggccatgtggcaggtgccttgggttctgggtaacggggactggaagtatccattgaaaggtagagagttcactgtgctgactttccttctgggtatcggccttgtggttgaataactgcacctctcaggcacctttttgagtgctgtgttaatccagggtctgttcctaacaccctggtgttttgaagaaagagccggggatttgaaactgtgtctgctgcctgcccccaggtcgcacgaggactctcagtgctggtttctgctaagcacacgctccaggccgcacagccatgaggaaaagatcttctgccacctgctcttggtccccagcagtcccatcccagggttgagctgagtcctctgcccccattggcccaaagtgctggggtctctgaaactgcccttgtagtggcactatctggaaccacattctccagccccctgctaaccactgtgccctccagtcccctaggccctggtgggtgccaggctaccccctgtgctgtggcactttgtggggtgtgacctctggaggttctcaggcccatactaatagagtcctctagagcctcccggttccccttgatccacaagcttggccccctctctccctgccagagccaccctcttaaggcagcatttatgagctcgtggctgttatgctcacagaaagtcctcctgtgaataaacgagctagaggtgtctgtagagtgctcctcactctgctcggtgtggaccctcacaataacccaggctgatttctcgaggctgcatgaactgttcctgtctgaggcggggccgtgttaaacgaggcgctgcatcaggccctgctgcctcctctctgccgtatagtgtgctgggctgtcatgtgaatccatgcgctttctgctcttctgcaaatgcgttcgtgcatcttaagagtgtgaaacagagatttcccacctgtggttttgaatcaccccacccctgtggtgccactgctcatttactttgaccgtttaggtcacatttgtcctcaagacaacacttgaagaaaaaggatcctgggtgaaggtgcagaggtgggcctctgttgagctggaagattttcttctgctttcaggagctgatggaaaaatgcttaccaatcatgtctataagatgggctgttgttgactgtctcccagtctttggaacggcccgggatttggttggccgggttcagactgttgcatcgttccctcacatttggatgcactttttctgtggctctggctttgtcgattcttgtctcatgaacttgttaacttcctctccgatgtgctttctccacatccctgtgtcctgtttctatttagtaccattttatgatgcacagtttgtttgctctttgtttttctatctttgaaaataaaacaaaatggcaatagggacattagaaaagcggctatgaggaaatgatctttttttcttagcagacatccaaaattatgtacagtgtgttttttctccaattctgttctcatcatttaatgtattgaggttgactacacgaaagctaattttctgatgtgctttttctttaggtgactccaccagtgatgcaggtgaggaatggccttagatacctgtgtgtcatatcaattgtatgcatgtgtgtgaatgtgaatgtggactctcagattcatgctttataaagtgcattagtgaaagtaacttattttatggaaaaagatcataactaccctaatgtatttatttatttatttattttttgagatggagtttcactcttgttgcccaggctggagtgcaatggcatgatctcggttcaccgcaacctctgcctcccgggttcaagcaattctcctgcctcagcctcctgagtagctgggattacaggcatgcaccaccacgcccggctaattttgtatttttagtagagacggggtttctccatgttggtcaagctggtctcgaactcctgacctcaggtgatccacctgcctcggcctcccaaagttctgggattacaggtgtgagttactgcgcctggccaactaccctaatttaatttgaaatttaatttatatgttttaagtttgaaaacaatacatttcaggatttttttccagaatataaagtatatttctaatattcaaattctgactattttctgaagtgttaattccttttactttaaatagtggagtaaacttgtcttaatagtttaggccttgttatttactgattaattctttttatcaaaatgaagaaaactttgttcagattataaacataatatggtataccaatgtagaaaaatttaaaaatgcaaaaaaaaaagaacaaaaattaaaagcactggtaattctactgcttataacttaaatgaatattcttctagaaccctgtatatatatatatgcatatgtatataattgttagatatattactgtactggattgtttcacacaaaagggagctgacatgtgactgtaccataatttacttagttactgattgattgtcagtattaccagtgacgatgggtgaacatcttgacatgtgtccatttctcctcttgggttgtatttcctttaagtgctcagttgatcagcctgccttttgaattttatttctgaagtagttgaaccagtttgtattccctgggtttgagtgtgcccattttcccaaatcttcactgagtttagatatcagacatcgattttctcttcatcaacatgattgatggaaaaattgctcatttgtatttgcaattacaaatgtatttgattgcaaataactgcaaatacagatgcaaatagtattttcaaatagttatctatgtgtgttttcctttgtgaattgctaattgattgtcatttgtttagaaggagatgctggacctgctggccaagataagtctgaggtgccagagactccagaaattcctaatgagctttcatccaacatcaggtctgtgtgctttgaatccctttccctcagcagagtgatcacacctaggacactgctgtgcttctctttctggctgctgctatttatttagtgcttgagctaacttatgaggaattacttatacaaagaatacaagaagtatatcagttttctgtactggagttatatcactatatagtgatataatattttggagatttaggggaattcaaaattatagctgaattatgtgatgttttgattagtgacagttgttggtattttgaaattactgaaaatacaagtggaaagatggacactttctgattggtcgggttactgggacgttcctcctcttctgcagagtagcgtgtcctaaccagcacattgattatggcttggagatgagagttaacattcacctgggctttcttttccagtttgaaatgtataagcctttcatactccttttttggttttccaatatttgggtttagaagaattcctcggcctgggagtgcaagaccagcccctccccgggtcaaacggcaagacagcatggaggcgctacaaatggataggtaaggctggctcagcagggcagttccagccacacagtgtgttctccagtgggcatggtgcctccgctaagagaagggggagggaagcagcacatggtgctggaaacatgctattgaggaacaaaaagtgagggtaggccctcgcctcacaccataggccaacagacatgtcagatggatgaaagagaaaaaccatgcatacatgtaaaatacatcttcacatctatgggaaaatgttggactgcatttctctgacccctagattgaagactttctaagcgtgaaaacaataggggaattaggaaaaaataggggaaaaaaattaggggcttaattgcagaaaaattaaaaatagaaggtgatcaaaatgttataagcaggctgggcctggtggttcacgcctgtaatcccaacattttgggaggccgaggcgggcggatggcttgaggtcaggagtttgagaccagcctggccaatgtggtgaaacccccgtctctactaaaaatacaaaagttagctgggcgtggtggcgtgtgcctgtagtcccagctactcaggaggctgaggcagaagaatcacttgaacctgggaggtggaggttataatgagctgagattgcactgctgtactccagcctgggcgacagagtgagactatctcaaaaaaaaaaataaagtcataagcaatataaagacaaacaacagataggatggatcagagtgggtttcagatcaaataagaggcagggattggaggcaggagtagatgtgtttttctaggagttttgccacaaagagaagggaaggaataagactagaaagtgggaaaggtggtgtcaaggggagttattatttttctaatgacgggaatgatccagtggaaaggggaaattgatgacgtaggcgacgtgggacaggggtttggtggagcagagtccccgtgtgggtgtgggaacgggcgcggaggtggagtcggcacatggtgtgatgcagattcttaaggtgattttctggtacttatttttctcatgagccgtaagagggtctgggggaagaggagtgtcagaggagagaggggctgggtgaagtcgctgtgcacgagagtgggctagtgaagagactggagcagaggttttcctctaggggtgatcctactttggggacactgggccatgatctggagacattttctggtgttctgatgaaggggaggggttagggcagggcagttgctgaacctcctacaatgcacaggacagtctccaccacaaaggaggatgggctgcctgcccatagtgcctgggcggaggccgtggctgacagctgacttcagggcagcatctggtggacttgggcgtaaagagacagaagatggtgtggcggggcctgttctgcagctgcagttggctacacctacaggcactggggggcacaggctgtattaaacagggctcggctgtgccaagcaagtgcaccgagagagaagggaaggagtaggagtatgtggaagcgccacggtcatgaccaatgtgggatttatgccagtgagtgagggaggagccctcggggtgaaggtcaggaggaggcattaggattgagaggctgaaggtgccggatggatagaaggattgttggagtcaggtcctagggcggtgagctgggaatatagatagtggtggtaaaggagtggggcgcttggatttgaggttggagcttgctgttagtggtagtgacaggggtgcccctgggagtgggcgtcgagtgtgggaggtgggatcatcccagcagggttcagggacccaaggccaggattttggaaggatcatttctcaatacttgaaatcacaagtaagacaggagcaccgttggtgagagtggcgggtccaggaggactgggtgggaccatgggttggcagctgatggcagcaatgatggggtcgagggtgacaagatttaaagttggcagtttttagggagagtgatctggaagccgaagcaagcataaggaaattactgaccttccctctgggcccgtgacaagaggccggtgggaggagcagcagctgcagctgagggctgtggggaagctgtgtcctggagagcaaggcgggacagagagggcctgccgatcacggcaggcacaggggcgcaggtgttgaggaggtggatcgtgggccacagtgagggtgtgctgggagcgtgagagacgagggacgggagcctggacttcctggtactgacagagcagcgggttcgaagtgaggttggtcctggcggagccacacaggtggttgttgagtgtctcaaggacccagttgaggaagtcgaggatgtttggggcaatgggtgttattttcagaggtcgttcccaagtgtctacattccctctggaccttgtgcatggcactgaagcaagggaggattttggtgtgtgtgtgtgtgtgtgtgtgtgtgtgtgtgcgcgcgcgcgcgtgtgcgtgcatgtgcttgtgtgtatgcgtgtgtgtgtgtgtgtgtgtgtatgcatgtgcacgcatgcagcactgcgataacggggcagggggagttaggtgattgcttaaagcacaagtgtgtagggaagaaacaaaggcaggaggggccattaaggagcctgtagagtgtttgggtcgggggctcacatttgtacagagtgagctgacagtggcctgagtgaggaggagtggggcagctgtaggtggggcagttctagtaggtggccctggagagcatgagagagcccttgggtgaaggctgtcaccaaggaggacaaggtctggggctggagggccaggctgttggacgctgacttgcccagaatgatgtggacttgggtggagcgcagtgtgtacgtggtgctgagcgggacatagggcagccactgtgactaggagttgaatgaggggcctccagctggctgtgtgaagagaggtctggggtcagccctggtcagtgggaccccaatgtggcccctgccctgaggtttgtgacccagggcaataagcgcctccaggtagaaagcagcaggtgaagggctggtgtcactgagagcgcagtcaggggagaggcggaggccctgagggtctttgtgcagtagagggcatgacgaggctgtggggacgggaggccaggtgtggaccaggaggcctgggcagcacagggacgtggggaagctgggtgggggtggagggcgaggctcacagggactcaggcctggagggcttgcagaggacactgtttgcagacagtccatcttagcttcagcgggtagcttgagatgctgttctagctagagatggttggtgattagattcctctctgccgacctctgacacagtttcagatgcttgggactgatgaaaatgtgtaattctaatttaatctaatttctttttatttaggtcagggagtggtaaaaccgtttcaaatgtgattacagagtcacacaattctgacaatgaagaggatgatcaatttgtggtggaagctgcccctcagctctctgaaatgtcagaaattgaaatggttagttaaccgaaatatgatgttttttaataataatgttttaccttcattgagattaatagtctagcttttagatttatgtagacaaaaatgtcctgtaatttttcagttagttttctaccttcgttaattttgttgttctttttttgagatccacagaagcatgatctttaaaattcaacaagcctgaatcttctttttcccccttcctttcctgctcaggtaacagcagtggaactagaagaagaggagaagcatggtgagtcctgggcacgagtgtgcatgtatgtccatgtgtgtgtgctcatgcaccttctccacgtgggcctggaaggatccagtgcaagggactgttgtgtgccaggttctggtctgggtcacactggcgggatcacactggtggtacataggaccctgcgggcatggattactcttaaggcgatggctgctgctccccatccttagaggagggggagggcacagttggaagctggaaactcactggcaactgtcctgcagatgacatctcgtctcttccgtacgattaaattgtggaagtagatgatctctgaggccctttgcaagtctagttctggaatgttattgttggttttctagctggacaactcagtagtgcaaaccccgttccccacaccagggtttgagtatcctggaacacagtttctgcagaagaggcaggctgagtactttcctttatagatctgttctcacaatatgactttgtttcctggcacctatcacaggtgagtaacgagggcttgttggttttgggggtttggggttttttttggtatctatatgaagccacccttttttatttgaggcggagtcttgccctgtcacccaggctggagttcagtggtgctatctcaacttactgcaacctctgcctcccgggttgaagtgattctcgtgcctcagcctcacaagtagctgggactacaggcgtgcaccactatgcctggccaatttttgtatttttagtagagacaggttttcgctacgttggccaggctggtctccaatttctaacctcaagtgatccacccgccttggcctcccaaagtgctgggattacaggcatgggccactgtgcccagcctagtcacggatttttaacatagtggatgtgtttcatttcagcccatctcagtttttcttattaatgttcagattgcccagtatttgaccaggggagcctattggagttattttctgggggcctttagacacatcccagtacactctttagcttccttgttttctgatacgacaaggtgtttccagcttattttgtgtacttcctgccccataactgcctcatttctccaaggcacctggccgcttactgctctgggttgcttcttgtttccaggcattttcactgcaaaagcagggatatacttttttaaaataagaaagtatattctgacttagtgatgatatttccaattccgatttaggattgtagggttttgcctgcattctttggttttatatatgcatctcttccatctcatgccaaaaagcctggctcccagcagcagcggctgtccccatgctttatgatccttcatatgctcacatagcaattttagaacaccacgactggtttttaacaacaataggattactggaaacgctgaaggattttattttattttattttatttatttttatttatgtatttatttttgacatggagtctcgccctgtcgcccaggctggagtgcagtggcgcgatcttggctcactgcaacctctgcctcccggggtcaaaagattctcctgcctcagcctcctgagtaactgggattacaggcgcccaccaccacacccagttatttttttgtatttttagtagagacggggtttcaccatgttggccaggctggtctcgaactcctgaccttgtgatcggcccccttggcctcccaaagcgctggtattacaggtgtgagccaccaagcccagcccaaggacttttttttttttggtaggtatgtctgcctgtttgttgggtatatcctattagggatgtacagtcagttaccctgttttaaagttgtgaaacaattctctagtggcgcatgcttgccaattggatatcactaagtttatttcattttgcattcaacctttaggcattagtgttgtttacctttttaatgtaagataattcgcatgattttaaggtcagatgtacaaaaccaggtataatcagaaatgtggggctttgacccgtcttctctaccctctactctccctgtctcctctaccctctactctccctgtctcctctaccctctactctccctctccctgtaggtaacagtaaaatagggcttatacttacatttgaaaaacaaacaaataaataaatgcatatgcatgtgcatgtgtatttactgatacctacacttatttccatcttgctctttttaatttgacagcagatgcaggctttcattttgcagcaatgcagagaaaccatcctcatttccttcatagccacgtcgtcctccaccgtgtggacgtaccctcgtttattcagtcagcctcgggctgatgtatgcttgggtgaaacactattccaaaaaacttcacatgatatttatcccatgagtaaattctgaaagaagtggaatagtcttgccccagtgtaaaagaagtatccgtacttagaagcatttcttgttatttctgtttgtaataaatggctatatttttggatgtcaatctacactccttcttaatctttgaaaatagaaaatctattttatttctaaagctttttacttttcaaggagctgatttccctgaaacactttgaaatgtgataatttccactaccagctgtctatcactcttgtgtactatctccttaacaaataaagattatttgaaactgtttcagcataaaaagagataggataaaaacttagtgtttttcccaccatcccacccatttagaataggtttttgggatagagaataaacttttaacataaaatcactgatttttcaacaggtggacttgtgaaaaaaattttggagacgaagaaagattatgagaaattgcagcagtcacccaaacctggggagaaggtaatggaatgatttccataaacactggcattttagcagtctgtttcatgcatttacagacttttacaagttggagcatctttcaatattaccattatcagtgatgtctgtttgcatatttaaatgccattcctggccaggcatggtggctcacgcctgcaatcccagcaccttgggaggccagcgcagacagcttacctgagcccaggagttcgagaccagcctgggcaacatggtgaaaccctgtctttacaaaaaatacaaaaattacccgggtgtggtggcgcatgcctgtagtcccagctacttggggggctgaggcaggagaatcgcttgaacctgggaggtggaggttgtagtggattgagattgtgccacggcactccagcctgggcaacggagtgagaccctgcctcagaaagaaaaaaaaagccattcctccctcctcccagttgggaggatataaagtgtgggacttcctctgtggggctacttccctggcctggtatccagccccgtcttgggagggggcagcggcttacttggggagctcaggagccaagagccaaaggcctgttgggctctgactccctgactctccccttctggccttgcccatcccttctcccaggtcctgtttgcagactgggaggctggctgcctgatcctggctgattgcaaagtaagagactgggaatttttttttttttttttttgaggtagagtctcgctctgtcgcccaggctggagagcagtggcatgatctcggctcactgcaagctccgcctcccgggttcacgccattctcctgcctcagcctcccgtgtagctgggactacaggtgctcgacactgctcctagctaatattttgtatttttagtagagacggggttttaccgtgttagccaggatggtctcgatctcctgacctcgtgatccacccaccttggcctcccaaagtgctgggattacaggcgtgagccaccgcgcctggccgggaatgtttttaagtcttttttttaaatacatgttctattgtacctggttccccgcagtctccctcacacatgtgtgatgtgcttttgttgggacctgtggcctcttgccagccactaccctttccttgggcacatgaccactagggcgggcacctgtgggccaacagggtgtgtctcaaatgccacagccaggtttctcttacagtcactttaaagaggaagaagaattttttttttcttttaaacagaagtttcttggatatttagcctaataactcaacaatttaaaaaagttttatatatagggatgtgtgcacacatacgtacacacacatgcacacatatatgtatttctccccagctgaattaatggttgttttagataattttgcttaacatgtcctagtttgtcacaaagctagggcctgaaatagccaatgagaactgtgcaattgagactaacagtagagggagcccttttaacaataataactggagaatgttgtcggcggaggctttgctgacagcaccactgtttgccttgctgaaaggagaaatgccttctgcagtttgttttttcattgatggaatgttaatacattatagtcctttctgtatgcatgaggggttgtcctggtgtccctggtggtatttctgagacccagtcgaaaaccctgaatgtgtccctccaggctcctagtggaggtcacctttgaagcctccattggtttcaattttatagctatgatttttacgcaaagcatattaggattgtgtttcaaagtctccttggaagagtaaattatttcagattggtaaatctttgggcttcagaagatgaaaggaaaagtgtccttttttggtaaacatctgctgttttgaaaaagagtggtcagtgagaacttcaaagtcagggttgatgtatgttacagttaggggaaaatcagcaagtgtctgtatgattttctttaggatattgataaacatcagacttaaatttaacttgttggtcttcttaaaacatttttgttacatttttttttttttttgagtcagaatctcgctctgttgcccaggctggagtgcagtggcgcgatctcggctcactgcaagctccgcctcccggattcacgccattctcctgctacattttttttttaaataaataaaaatgtggccaggcgcagtgacttacacctgtaatcccagcactttaggaagccaaggtgggcggattgcttgaggctatgagtttgagatcatcctggccaacatggccaatcccctttctactaagaatgcaaacattagctgggcatggtggtgcacacttgtagtcccagctactcaggaggctgaagcacaagaatcgcttgagcccaggaagcagaggttgcagtgagctgtgattgcactgctgcactccagcttggatgacagagcaagcctgtctcaaaaaaaacatgtaggaagagccaaagtcctttttccccctgccccagtcctgttcccccgagggcagtccccaggatgaacttggtgtgtatctctactttggatgtgcctcgtggtgttttttgagtttctaatgtcaccctcgtgttgatctgttatgcaggttgctttcttcatgcagcatgtttctctctctcatgttttgatacatgtagatgtagtttattcattttaattgaagccttatagtccattatttgcttattaattactctattgatggacatttaggtttttcagccatttcctttcatagacaatgcttccatggctcctctccatgcctcctagcattcaagagccagtgtctcttccagcaagaatcaggccactttctgtaaagggccagataaaaatacttcaggctttttgagccagatggtctcttgcaactattgaattctgccgatgtggcatgaatgcagccgcagcattagaccatgtaaatgagcatgtgtggctgtattcaataaaacgtactttacaaaaacaaggtccaggctgtgggctatagtttactgatttcagctttgggggttatgcccaggcttagaagtgctgtgccaggaagtacacagatctttagtttcaccagataggccactttcctcctcaaagtggctgtaccaatttattctcccagtacaatgaacatctgtttccaaacatccatgccaacgacagtcaagatagtgaacacactcatcaccctccacagtgtcatgtgcccttggtgagcccatcctccagcccatctccatgttccccttaccccacgccccaaccccagcagccacccctctgctctggttcactgtgctttagtttgcatttcctagaattgtgtttaaatggaatcatgtgatgtgcactctttgaggtttttttttcagtctggccgtttttactcagcataattattctgagatttatccatgttgttgcagcgtgtatctatagtttatttgtttttattgctgagtagtatttcattgtatggatataccacagtgtgttcatccatgtatcagttgatgaacatttgagttgcttctagtttggactattataaataaagctgctgtgaacattaatgttcaagtctttgttttgacagatactttcattatgttgtatgaatacagtagaacccctcttatttgcaggggatatgttccatgacccctagcggatgcctgagactgtggatagtaccaaaccctgtatataccatgttttttcatgatacgttccgatgataaagtttactttatgaattaggttcagtaagagatggacaataactgatattaaacagaacaattttaacaatatgtcagcaccactcccttgtacttaggggccattgttaaataaaataagggttactttaacacaagcactgggatactgccacagtctagactatctgataactgagagggctactaagtgactaacaggtggatggtgtgtacagtgtgtatatatactggacagagggatgatttatgtcctcagcagaactgtgcaagatttgatcaccctactcagaatggcatgcaattgaaaacttatgaatgaattgtttatttctggaattttccatttaatattttcagattgcaggtaactgaaactgcagaaagtgaaactatgggtggggataggactgttgtacctagaagtgggactgctgaggcatacggtaagtgtgtgcttaactttttaagaaactgccagaccatagggctgggtgctatggctcacacctgtaatcccagccctctgggaggccgaaatgtgaggatcacttgaagccaggattttaagaccagcctgtgcaacatagggagaccctgtctctacaaaaaaacaaaaacaaagattgccaaactgtgttgcaaagtggttgtatcattttgcattcctaccagcagtgtataagagtttcagttccttcacatcctcgtcagcactaggtacggtcaaactttaaaatttttcagccgggtgtggtggctcacacctgtaatcccagcactttaggaggccgaggcaggcagatcacgaggtcaggagattgagaccatcctggctaatggtgaaactttgtctctactaaaaatacaaaaaattagctgggcatagtggcacagggctgtagtcccagcactcaggaggctgaggcaggagaatcgcttgaacctgggaggcggaggttgcagtgagccgagattgcgccactgcactccagcctgggggacaaagtgagattccgtctcaaaaaaattttttttcatagttgtaatttgcatttccttaatggctaatgatgttgaatatctgtcctatggttgtatacataatatataatgacacccttgtgtctcatatgttgtaaatatttttccaatctatcgcttgtctgactttgcctttttatttaaaaaacttttttttttttttgaaacagagtctggctctgttgcccaggctggagtgcagtggtctgaatctcggctcactgcaacctctgcctcccaggctcaagtgatcctcccacctcagtctcccgagtagctgggactacaggcacacgctaccacacctggctaatttttgtattttttgtaggggggttttgctatgttagccaggctggtcttgatctcctaggctccaagcgatccttctgccttggcctcccaaagtgaaccactgcacctggccaaacttttctattttgatgtaaaatttaaacagcctttttctttatacattatttattttttttctttttgttatggccaagagtttaaggtgcagttatactttatttttgattttgtctgaagaagctgtcctatcctggttgtaaaggtagtctctagtttagtcttctttttcacgtctaggtctctgcgtggtctggaagtgtgattttctgctgtgtggtagccagccaaggcttccttaccccgcctttgtacccccacctctctagggagcccaggcactacgtgtttccgggctctgctgtgtctctccttgtttcagcactatggttttacctctgggaaagcctttctaaatgttcctccactcctccccgactctccaggttgtcttgattgtgagtaagtctttatggctttatataattgtgggatcagtttgtgtggttccatgaaaaaccttgttgtgattttgaccggaatcgtattgatcttcgcttgacttgacttttaccactaacttccactccattgccttgcctgtctttggagcaaaatgccttaaaataatcgcttatcttttgctgtctacaatctacctcttcccactctctcctaaccccattccagggaggccgctggctctccaccttcatccgagttgcctgagttgccctcggcagggtcacctgacctctcagttgttatatctgctggttatgtctgtgtcctgcgacagcgttttgatgctgttggccactctctccgtccttggcatggcctccagcacagcactctcctctggcgcccctcctgccgggccagtcccccttctctctgtcctttgctagttccttctcttttcattcttttcttagtatcaccatcttaatgttattagctgtcctttcaaactaattttttttttttactaagtcagcttccttagtggttatattccatttttctgttttttctttcttattttggtaattaatgtttgaatctgttaggtttagatttacctgcaagcaaaagaaagctaaaacattagtggcgtaaatgaagtataaagtgttttatctcatgggtcagtctagaggtagccatccaggtggcagtgaccctgacgccttctgcctcattcctccacagcatgatgtgacctcccttcctcagggtgcctcacaggccagcatagcttcagcttccagccagcaagagggagaaaagggaggaaggagaaggcctgcccttctccttcaggatatttactggaagttggacagcacttccacttatattatgttggctagaacttagtcacaaaggagaccatgaagtgaaatctctattttaggcatccatttgcatagccagaaatcaggaattccattatcacaaactagaacgtgtcaaattttctcagtgcctgccatgctcagaaaatggtagtgcttgcaaggcacatgggtaagtggaagaggctgcctccctggctagaggccgagggttcctggacccagcacacgtctcacatgtgggccgcacacagtggcgggaagctttgccaaagcggagatcagaaacagggtcgaccagctgtctcttccacaatgtttctctaggaaattgtttatttcattcatgtcttacagtcatggcataaagatgtttgaagtagcctttatgattttaaaatatcttatctatacttagtttttcttttcttcccaaaattttgtgtctttttatttcttggtgagactttgaaaaaactattaaaataaacactctctagcaaagaatcaactttcagttttatagatactcacttttgttttatttgattaatttctactctgttattccttttaatttctttgggcattgacttttcctagtctcttgaataaagcacacagctcctttattttgagtcgttgtcgttttaaacctacatatatttccgattgcacagctccttttaagcatggtttatccttgacttctaaattccttgaatattgaaaattgatattgaatattaaaaattccttgaattttaatatgaagtactttgttacaattttaacatatgggcagttgggattctttttttagttttttacacataaagatttttaaaagtctttttaatgataatatctaatgtaatgaaattgattatttggaattgatgagacttttaatgtggcctatttggtggtcagttttgtgtttcaaagtacttgcaaagctgcttacttctagacatacttcaggtccaggcttccacataccgttgttgatttcacagagaggcaaatgtaagactatatcctcaggccaggtgcggtggctcacacctgtaatcccagcactttgggaggccaaggtgggcggatcacgaggtcaggagttcaagactagcctggccaacacagtaaaaccccgtctctactaaaaatacagaaattagccggacatggtggtgtgtgcctgtagtttcagctactcaggaggctgaggcaagataattgcttgaacccaggaggtggaagttgcagcgagccgagactgcaccactgcattccagcctgggcaacagagcgagactctgtctcaaaaaaaatatataaataaaaataaaaatgtatcctcaaagcatgtatgctgaatctatcaccattatcgatttatacatgttatcataataattgcttattttctctctgtctcattaaaaaatacaaaacaggtgttttctgtgcttttcacataaattgtggtgtgcccttccttagtcttgatactttttatttttttggaggattttttcaatgctaaagaaatgcatatttgtaatttgggcctctctccagcctgtctttgaagttgcattggaagtaaagccatttcttattgtactaatggacttgaataatacattatagaataaatatgtgaatcagattgctttaagcgttttcttcattatcctgacttttttgctctcttttcaagaggaaatataaactttgttaatagtaagatattagctcctgccagcgtttttttttctttcttcaggtttatgaagaagtttttgaaaaaccatcaaaagaaccattttattacagtgtttcttaggctttctaaaggtttatatatgaggatgctttaggctaatggccaacagttttgaagactgttcactcactttaaagtatttaaatatttctcactcctaatttttcagtctccttttacatgatcttccctttgtttctctttttcattttatatctaattattaataaatatgatttttagatgctttttcttttcatttaaattttttattttgaaatagctattggagtacttctttttgtagatttccttctttcttcattttaaggttttgtgactgctctcttctctactttcttgatcttataaaccgtgccttgttctgggactgctagacgtcacgcccatatcttgtcctggtgagaacaggtgggcatgtattgaatttgacctgcatatatgttttttgttgccattctgaaagaaagttgtaataagcaagcaaatattgctagaatgactagcatggatgactgtcttaaagaggcatttatttgggaatgtaagaacttcttgtatcttgaaatgcctcttgatggatacaatgaccttatcgtgaacaagttatgttttaattaaagtcagtggcatataacaaatagtatttagctaaattgttgatgaaagtcagggatttgagtcttaaattatttcactttggtgataggaatagatcctcaaatttctttttttggtaggtagatggtgcagtttcatcacaaatactataactctttcagaaaaatgctattcagaatctctccttacctgaaaattctacacctgacaacagtatttttagtttgggtatttttggtcctagtattattggatttttcctttgctaggaatattgtttccattgaaattgttgttaaagaaataaaaatgggccaggcgcggtggccaacgtttgtaatcctagcacttgggaggccaagtcaagcagatcacttgagcttaggagttagataccagcctgggcaacatagcgagacaccatctctacaaaaattaaaaacaatcagacatggtggtgcatacctgtgtttccagccactcgggaggctgaggcagaaggatggcttgagcccacaagtttgaggccgcagtgagccaagctcgcgccactgcactccagactgggtgatagtgtgagacctgtctcaaaaaaataaaataaaaataaaaataaataaataaataaaaataaaaagagacatactctgttggtaagactttaatagttaaattgggaactactgaaattgattctaatcatgaagggttatatggtggggttttttgtttgtttcttagaggttttgtttttgtttttaaagaaataaggtgatagttttatgttcccaagtaaaatctctgaatgcagtatcttacaatatgcaggctggagattttaagttttggatataaaatttgttaccaccccattatcttataaaaaatcagacaccggctgggcgcagtggctcacgcctgtaatcctagcactttgggaggccgaggcgggcagatcacaaggtcaggagatcgagaccatcctggctaatatggtgaaatcccatctctaccagaaatacaaaggggtggcaggcgcctgtagtcccagctactcgggaggctgaggcaggagaatggcgtgaacctgggaggcggagcttgcagtgagcagagatcgcgcgcgccactgcactccagcctgggcgacaaagcaagactccatctcaaaaaaagaaaaatcaggcaccagctatatcatttaaaatatttataaacatatgccatgggtgtattatagaccacaaaaatgatttggaagccattaaaatattacatgtatatgaactttataaagataattaggaggagataggccttttctctatagacaaataaagttcatgataaggataaaatatgagttctttacctgaaaaaaaaatagatacacatataaatgacttaagaaaactgtattataaaaatgtgtttagctgtattgtcacaaacatttccaaattgatatgcccattatcttctggttcatgattactcagtgaatgataatataatcaataaagattttatttttactgaaaatgtcactgaaattcatattatgtcctcggttttttagattttagtcagttgtggcctgataggttatttctggtcttaatttcaccagtacccttttctgtgctttgcataaaaaaaaatctttatttttgattggttttgacagcctgccttggatgtcaattcagtttctaagtagtgtagaccctggtgtttaaatatactcactgtgacacattaatggatatatgagggaatgatgttgtgttagccccaggatgaaaattagtggaggctgggtgtggtggctcacacctgtaatcccagccctttgggaggccgaggcgggcagatcacgaagtcgggagattgagaccatcctggctaacaaggtgaaaccccatctctactaaatatacacaaaaattagccgggcgtggtggcacgtgcctgtaatcccagctactcaggaggctgaggcaggagaatcgcttgaacctgggaggcagaagttgcagtgagccgagatcgcaccactgcactccagcctgggtgacaaagcaagactctgtctcaaaaaaaaaaaaaaaaaaaaaaaaaagaaaattagtggataaggattagaattaaatagaatttagtcacattgactactaaacaatgccccagctcagtggagagaagtgtaggaggtatctggagagcagtaagtagagaaatcaaaggggatgtggcacaagtttcagaagcctcagcgccctgcaacagaagactgaagatgtggatctcactagtttgaagaggtgtgaagacttcagaagctacccagtgagacatcatgaaattgttaaaatctgttagtcattaggccttgaaaggaatggtttagaaacgacctagctgagcgagtgggcttgggcctttggtgcacgctcagcatgggctggggtccccttagcatgtggtggtggctgtgacagctcttgctcctcgtgggactgagctttctcagagagactgtgggacacgggagagaccgcggtgggaccgagagcctgcgccaccgagccctctctgtgcagggcttcccacgcatggcctcctgcacctgcaccacaactcactgctgaggaaattgaggcttaggagagtctcagtcccttgcccaaggccttgcactccagagcctggatccaaactcttatctagccccaaagtacaggttctgaccacaggagggagcagcaccgcggctccagcatgccccaggcccggagcctgtgcctccctgtctcagtgcggggtgggcgcgttgagctgctttttttggagcaacttatttcgagaattattttaatccttaaattccatatttcttcagcttccctttgaaaaaaaaaagggaaatttgtgtttttaaaaagtgttagttagtatttttgtcctttccaaaacatattcacttgtgcttactgttgtgagacacacatgtatttttctagttcccatctattattccttgctgtctgtttctgacctgaaaagcagcttccagtgaagagctatcactagaggaacaggacttggctgaatgaattaggttttattgagtttttaatttaatgtgggtaaagcaggctcaggagggctgaaatggacgaaacaatggcacaactttattacttttctccagggtatggattataggggatattttagagtaaagaaacactaagattcttggcattaaaatgcttcgatttcctatttatagcagtgatgcatatataatttttcatattggactgttattaaggtttttctgattgaaatctccgtacggtttcttctggccagtagacttcctccatccccagatgtgaccccttttaaactaataaagcctcttgataatacttacaatacttgtcacagagggcaggactgacattcacttagtgaagggcttgtattataccaggctttgctctatgtaagttttatattttcaggaatattcttaaatcccttaaagaaaaaaaatgaaaataaagtagaaatacatttattttagatattgttattaataatttttttttgagacggagtttcactcttgttgcccaggctggagtgcaatggcgtgatctcggctcactgcaccctctgcctcccaggttcaagtgattttcctgcctcagccttcctagtagctgagattacaggcgcctgccaccatgtccagctaatttttttttatttttagtagagacagagtttcaccatgttggccaggttggtcttgaactcctgacctcaggcgatccacccgcctcggcctcccaaagtgctgggattacaagcgtgagccactgcgcctggccattgataaatactttgtaaataaaatacactgtgtctatactcttacatgatgcaccatgttagtttttaaaacttgggagtaatttctgtatattagtattttgggttctgactgggtttctaggtagcttaacaaagcttttattgtactacaataaaagtactttgtacaagtagagttcatttacagtaaaaaatgatagaaaataatgctgttattttaatagtaataaccaagcaattaaagtaaatatatatttttaacaattttgaaattagctttctaagaaaagcgggtttagaagcaggcaaagcattcacttgtgaaagacacttttgggaacttcagagccttcagagattaatggtagtgatattaaaagtggagcgcgttccactgtcttccatgcgggagctttctggctctgctgctttttgttgcagaagcatccagtccagaatgagttaggtgttttgtaagtttctttcagtctcaaacagtctgtgctcttcccttgatttggccttgacagttttgaacagtacagctattttcctgactggcccccggtttgggtttgtgtggtgtttccttgtgattagagtcagactttgcatcctgggccgaaaccttccagaaacgaggctgtgctgcctttgctgcgtcttgctgagtggttcaaggtttcagattgttcctgactgcagacgctctccgtggcctctcgatgtggatgctgtctgccagcttctctgcagtcaagccgctccttttctctttgtaattactagcattttggaggaagtactttgtacaatcgaagtaccctgtgcttcactaagtttaatcatttgtttgtatcattatgggcttgtgccttccacttggactctgtgggctgtaatctcttactgccatgattttcatgcgcagatggcctcagatttggctctggagagctccttcaagctggctttgtgtcctttcagcctgcgcccagcattctttgagctgttccttgctttctggctcatcctgttctttccctgctccagccccagaatcagccatttccccaggagacctgggtcctttgattggagaatggagtgtttgccacttttggaggttcagctctcaggtcatctcagtgaacagagctagagggggaaaatgtatgtgtctgtgtttgttatatatgcgtgtgtgcatgtctgtatgtatgtgtgtatatatgtgaacgtgtatgtgtgtctgtaagtgtgcatgtgtatatatgtgtgtgcatgtctatgtgaatgtctgtgtctgtgtgtgcatgtgtgtatgtttatgtctgtattgtgcatgtctgtgtatgcgtatgtgtgcgtgtctgagtgtatacatgtatacgtgtgcatgtctgcatgcatgtgtacatgtgtatatatgcatggctatgtctgtgatatatgtgtatgtgcatgtctgtgtatgtgtgtgtacatgtgtgtgtgcaaatgtctgtgccctccctacctggtctccctggccgtgtgggtgccctctccctcctgtgctgggctcctgcctccattctccctaccccgggctctcccacccccagcctagtgtacatgcttccctggcattgcccacttcatggcttcaggaccaaatggctcaggagggaagatcagttactgactttcccctggaatgggcatctcataaggtgaagaccagtgcctctcatctccctctcgtggctagcatagcagtggacgttaagtgcatgtcatcaactgttgaagagatgaatttcatcgccagttgaacagaagttagaagagaaagggggaagtggaagggaatgaatgataaaatgtggggaagcacttgccagaggtgaaaaacgaagctatgtgcatttaggggaattacggacatttttcatgctgtagcctctggtgagccccatgctaacaccagggggtgctttaagcccatcacgaggcctctgagtgctagggagcgggcatagttctcttgtaatgtggttttctgccacaatttggacatttgtcgtttggacagtaatatagatttctgagtaaaatgtgataagaacgaagtttactagctttctgatctcagttaatgcgacattgaaagtctgttttttagaggtgctttgtacttttcgtaaagagcgtgaagcttgaccttctatgagtctgcacttgaaaagggctttcatgtgccaggtaaaaaggaaactcacaatattggcagtattgttgagatcaggtgtttttttcggtttgtttttgttttttttggtggggggaacaaccaaaaacaatcctacaagtatattgtacatcaagaaaaaataggttcttttgaaaagaaccaaagtcagatttgctgtagacttctctgtggccctaaatgccagaagaaaaaggaacagttgcttcaacatttggagagaaagaaactgacccaagattcttactatttagctagattgtcatttcatacataaaaacagtggaagacacatccagataatgcaagagctcaaaaaaagattgttcttatattcttccaaacctaagcctaaggaaagcctgagtgtgggcctgggatgaccagcgcagtggccactcgcccatgtggtgggggtattagaaaactgacgaatcccaactgaaatatatcctaagtataaaacacacaccagatttcaaatatggtgttggaaaagaagaatataaactatctcattagaaattattatattgattacatgttgaaatgattttgtatatatcacattaaataaaatttattgaaactaatttcatctgtttctttttacttttaaagtgaaactagtagaaaatattaaattacgtatatggcttgcatatttctattgggcagcattggtataggtgaaatgaattaaaattgattattgaaactgattaagcatatagaattgagtataactacagaattgaatgcaaaatccctaaactagttcttgaaaaaatagttttgtggaagaataacataataataatagatggtagggttgagggagtcaagggaagtaaaatcacattaaagtaacattcatttaaaagtttttttctccactttctttttcatttttattatactttaagttctagggtacatgtgcacaatgtgcaggtttgttacataggtatacatgtgccatgttggtttgctgcacccatcaactcgtcatttacattaggtgtttctcctaatgctatccctcccccagccctctgccccccgacaggccccggtgtgtgatgttccctgccctgtgtccatgtgttctcattgttcaactcccacttatgagtgagaacatgtggtgtttggttttctgtccttgtgatagtttgcttagaatgatggtttccagcttcatccatgtccctgcaaaggacatgaactcatcccttttttatagctgcatagtattccatggtgtatatgtgccacattttctttacccagtctatcattgatggacatttgggttggttccaagtctttgctattgtgagtagtgccataataaacgtacatgtccatgtgtctttatagcagaatgatttataatcctttgggtatatacccagtaatgggattgctgggtcaaatggtaattctagttctacatccttgaggaataaccacactgtcttccacaacggctgaactaatttacattgtcaccaacagtgtaaaagcattcctatttctccacatcctctccagcatctgttgtttcctgactttttaatgactgccattctaactggcgtgagatggtatctcatggtggttttgatttgcatttttctgatgaccagtgatgatgagcattttttcacgtgtctgttggctgcatagatgtcttcttttgagaagtgtctgttcatatcctttgcccactttttgatggggttgtttgtttttttcttgtaaatttgtttaagttctttgtagattctggatattagccctttgtcagatgggtacattgtaaaaattttctcccattctgtaggttgcctgttcactctgatggtagtttcttttgccatgcagaaactctttagtttaattagatcccgtttgtgtattttggcttttgttgccattgcttttggtgttttagtcatgaagtccttgcccatgcctatgtcctgaatggtattgcctaggttttcttctagggtttttatggtgttaggtctaacatttaagtctttaatccatcttgaattaatttttgtatatggtataaggaagggatccagtttcagctttctacatatggctagccagttttcccagcaccatttattaaatagggaatcctttccccatttcttgtttttgtcaggtttgtcaaagatcagatggttgtagatgtgtggtgttatttctgaggcctctgttctgttccattggtctacatctctgttgtggtaccagtaccatgctgttttggttactgtagccttgtagtatagtttgaagtcaggtagcgtgatgcctccagctttgttctttttgcttaggatcgtcttggcaatgcgggctcttttttggttccatatgaactttagagtagttttttccaattctgtgaagaaagtctttggtagcttgatggggatggcattgaatctataaattactttgggcagtatggccattttcacgatattgattcttcctatccatgagcatggaatattcttccatttgtttgtgtcttcttttatttagttgagcagtggtttgtagttctccttgaagaggtccttcgcatcctttgtaagttggattcctaggtattttattctctttgtagcaattgtgaatgggagttcactcatgatttggctctctgtctgttaatggtgtataggaattcttctgatttttgcacattgattttgtatcctgagactttgctgaaattgcttaatcagcttaaggatattttgggctgagacaatggggttttctaaatataccatcatgtcatctgcaaacagggacaatttgacttcctcatttcctaattgaataccctttatttctttctcttgcctgattgccctggccggaacttccaacactgtgttgaataggagtggtgagagagggcatccttgtcttgtgctggttttcaaagggaatgcttccagtttttgcccattcagtatgatattggctgtgggtttgtcataaatagctctaattattttgagatacgttccatcaatacctagtttattgagagtttttagcatgaagggctgtcgagtttggtcgaaggccttttctgcatttattgagataatcgtggtttttgtcggttctgtttatgtgatggattacgtttattgatttgtgtgtgttgaaccagccttgcatcccagggatgaagccaacttgaccatggtggataagcttttttttgatgtgctgctggatttggtttgccagtattttattgaggattttcacatcaatgttcatcacggatattggtctaaaactctctttttttgttgtgtctctaccagactttggtatcaggatgatgttggcctcataaaatgagttagggaggattccctctttttctgttgattggaatagtttcagaaggaacggtaccagctcctctttgtacctctggtagaatttggctctgaatccgtctggtcctggactgtttttggttggtaggctattaattattgccttaatttcagagcctgttattggtctattcatatattcagcttctttctggtttagtcttgggagggtgtatgtgtccaggaatttatctattttttctagattttctagtttatttgtgtagaggtgtttatagtattctctgatggtagtttgtatttctgtgggattgctggtgatatctcctttatcattttttattgcatctatttgattcttctctcttttcttctttattagtcttgctagcggtctatcagttttgttgatcttttcaaaaaaccagctcctggattcattgattttctgaaggtctttttgtgtctctatctccttcagttctgccctggtcttagttatttcttgcctccttctagcttttgaatttgtttgctcttgcttctctcattcttttaattgtgatgttagggtgttgattttaaatctttcctgctttttcttgtgggcatttagtgctataaatttccctctacacactgctttaaatgtgtcccagagattccggtatgttgtgtctttgttctcattggtttcaaagaacatctttatttctgccttcattttgttatgtacccagtagtcattcaggagcaggttgttcagtttccatgtagttgttcggttttgagtgagtttcttaatcctgagttctaatttgattgcactatggtctgagagacagcttgtcgtgatttctgttcttttacatttgctgaggagtgttttactaccaattatgtggtcaattttggaataagtgcgatgtggtgctgagaagaatgtatatctgttgatttgtggtatagaattctgtagatgtctattagttctgcttggtccagagctgagttcatcttcactttctttatggtgtctttcaatgacattttaaagacatttttaattttaatcaaacttttcaatcttttctcttatggttaatgcttttggcgagtcggttaagaaatccttctgtattccaaggtcagaaagatatttactctttttaaaaaagtaaagctttgttttgacatgtacatgcttaatccacctggagttgattttcctgtattctgtgggacagaagtgtagtttttttctctcctcatatggataaccaagttttcctcctttccccattgatctgcaatgctgtctctgctgaatatgaaagttccatatgcgtggaactctttctgtgttctctgccccagaggttagcaaactttttccgtaaaaggtcaggtagtaaatattttcagccatgagaaccatgtaatctctgttgccactactcaactttgttattgtagtgtaaaagcaaccacaggcaatatataaatgcatgagcgtggctggtttccaatagggctttatttatttatggacactgaaacgtgaattttgtataactttcatgtgctgcaaaatattatcctttaactgggtttttcaactatttataaataaaaaatcattcttagctcatgggctatagagaaatccaggtggtgggccggtccacaggctgtagtttatactgctccactggcccgcactgataccaccctgctgtaatgactgtagcttcagaacaaggccttgtgtctggtagcaaagcccctgccgccttatgcctcttcttcagctatgttttggcaattattggtcttgtccacttccatctacatattataacctgcttattgagtgccgtgaaaaaccctcttgggatttcagttggagtatttatgaacaaaactatctctccatttatttagacttgctttaaagtcttttagtgaatgtttataatttgatttgttaaggttgttcgtatcttttgttagatttatatgtgggtatttatagtttatctgctattataaatactgtatatttatttaaaattgttttctagttgttgattgctggtagatagtaatgctgttgacttataaccagcttcatttaaaactgtttgctttaaacgtgtctgttgagtcttttctgttttcttcgctgtaatagcagcaaacacctaatagggcacggtgtgcaggctctgttctaagacagctaataacataggtcatagtgagactcgggcactgttgttacccattttgaaactggggcatttggaggttaaggaacgtgtccggggccgtatgagtggtgagtggcagaggagtgattcaagcccaggcaatcgcacccagagtccatgcctttagcccaagctccgcaccattgtctgtgtcatctgaaagtcctgatggcttcatttccttctttccagtcttaggcatttaattccctcttactgttgcatttctgtggctaggccctctgctagagtaggaatagtaatggtgattgtgggtaacctcgtttccttccttcctgattttctttttttttttttttttttttttgagacagggcctccctgtcacccaggctggagtgcagtggtgcaatcatggctcactgcagccttgctttcctaggctcaggtgatccttcctcctcccaagtagctgggactgcaggcgagtgccactctgcctggctaagtttttgtaggttccccccccactgtggggcttggttattaatgcgtgttaaattttactaaatgctttttctgggtcgattgagatgattctattatattccttaattcactatatgattgtagcttttctaatatgaaacagtctttacattccttggatcaaatcaattatggtatattattattatttttaatccactgttaagagtctagttgctaattagtatttttccatttatattcatgaatgaaatggacccataattttgtttttcttgtatgatccttattttttttagtaccaaggtcaagaatgaattgaggatattctttgtttttatctgttctggaagagattgtatatgattggaatgtatttcttgacaatttgacagcttcacatgtaaaaccacctgagcttggtgtttctttgtgggaaatacttaaaccattgttttcatttttgtattaattatgagagtattcaggctttttaaaatgtgttttcgagtccattttgactgtcagttttttgaaaattttcaagcttattggaaaaaagctcttgctagaactctttaatatttgctctggatgtagtttagtttagtttagtttttgtttgtttgtttgttttttgtttgtttgttttaaccaatattacttacttaggcatttttctttttttaaatatatttttccagaaatttgtctgtctgtctaaaccactggcttttggctttgttgttctctttttaatctttgtttttcttttcattgatatctccagttttatttaaattttcttccttctctactatttttctttttaaatttattaagttggacacctaagttactagtttttatttagccttttaagaatctaatggaaacttgttttatgactataaattatcatgttttaaaagttagcattcattcattcaccagccatctggcacctgccatgtgctaggcactgttctcggcattcagtcagaaacgaatgacaaggttaacaactgtctttttggcagctgttgagatgttcctatattaatagacttcctaatgttgaacagttcttacacacctcaaataacctttgcctggccatcatctattatttacccaatataaaactatatttaatttgctgacatttaaaaatagaacttcatctctatattaaagtggaattggcctggagtttgagagagagagagagagagtttgtgtttaggttttagaatcaaggttatgtccattttataaaattaatttgggaccctgcgttttttcctgggccctagaacagtttaagtctgatgggtgatctgggttaagggaactttgaggctgggcactttcttcgcagtttgatctgaagccgggacccccccccaggccccaggctgctgggtcagaagcctcttaccatcacttgcaaacccaataccatgaggcactcaagtggttttgcggtcagtctttgctgaccagtaccaggttgcttctgctcttgccttcaggggaggtgggtcaggagtagaaaggccccagagggagggtccagtccttctttggtgccctctgtgggactcagcgttcggtccccacctcaggcagcctggcgctgatgctgatgcagccgccctgtgtcaggtgctcagcggaaccccagacttgttctccttgtttcctgtcgactcactctttggtcgtctgtgtgtcactgggggcctgttttcttgcagtccaaggttacctggaggctgctggtctctcgggccggacaacccccaccccatttaagtccctgcccacgagtctcctcttcagagaggcctttcctgtccacctagctgtgtggggcctcagccgcacactcaccatctctgacccgggctctgctatcctcacagcattggtcactgactgagaccatgcgactgactgagaccatgcagctggctgtcaggatgctggtggagggaagagtgaggagtgccagcttcagcagaactccttattctgtctgccttggcagccacagacacctgctcgtgtgaaggcggcagcgtggtgccatcacttgggtatttggaacttgaccatcctgtatgtgaattttcctttgctcatccagtccttagactcacttcttctattcataattaattctgtgacacgtgttttctgccgaggacctctgacctcatggccacttcctgctgcaggtttagacggtggtttcctcccccgctcacatgccagccattcagttcagtgggtctcttgttgcccagtaactaccttttatagctggtatttttggagtgattaaatatgttaagaatttagaaggcaaaatgtgtaataataacactggagccagaatgataaggaaatactgtagcaataggctcaatagaaaatgattaatattttagtaagacatttaaaatagcaaatccaattagttagtacagaggtggaaataaaaaacaaaataattgaataatcacctcactggccatttccagcattgatggagaaagacaattttaaagtccattttaaaacttagattcttttgctgctgctgcctatgagatggaaagggattctaaaatgtagagaaagtgaactttacaaccttatgtcctttgaaatttgcttagaggttcatctgctcagagacgtctacgtattagaaccattcagagagtgtttctgaaatgctggtgcccaggcccctcccctctcaattaggatcagtctctgggcaggtgctggcgctgggtgtaaaattgctccccaggtgacttcgtatgcagctggatccctacggtgccttccagcttctcagagggcctctctgagccctgcaggagccacgtggagaagctgcttacctgggccctttggttcctgtgcacaacgactgatcctgttaaacccagaaaatatggtgtcttcatgcccaggaagggaaggtcctctcccccgggtccctgagtggtgggggtgtcctcttggatttggctaatttgaacaggaagctctgcagttgaggcagatcttgcagtatccccctaaccgataggaaacatgcactgctgcccgacccagtggcccagcccggccactcacagcatcttcttctcgagcatgtggatggacttggaggcttgtttccaggctgttgtggaagaagcagatcctgctcttcctgagctcagcctcaccctgagcagcctcagttacctgtgattcacccccggccccaaggtgagatgaccccaacaatattttaaaggaaatgcctgcatcacacctttttgtctttgaactcctgaaaaatcaaaataacagaaacactgttgtaaagtgattagaagaatgcaagaaaatgaggtaaaagcatgttagcaaccttcattttcatgaaggtgtgtgagtcaatgtttaaatgtgagtgctgtagccataaaacaaagatggagagcaaggatccttcctgggaatatcttccatagagacttaagttcttttgagtgcttgaaaccagtttttccagatctctattgagtctgactcatttgttttggtttcctgaggatactctcaaaaggcttcatctgtcctatttacagaatagcaactatttttcttgccacaatgacgggatttgggtaggatgcttgggtttttttttttttaattatttatttatttatttttttttttttcagaattctgtttccatggaactcctgggtcagctagggtagcttgaacccaagtttatcttccccctctcagaatcccagtgaaatgaatggaacataaaaatggggcaaaaaccagtgagggttgcacccgcattccagaaactttagaaaagtttctttgggacttgcagatggggctggattcgaggagggcctgtagggcccactgaaccccactgacacccttggagggggccataggcatgggtggcgggtggggtgctctttgattcttgttccctgctgtggctcagtggcatttggaagtgggccctgaggaactcccaggttcaggcaggcttgccaccacgctggaggccgggaaggtgggggccagtcctgtgcctgcaagcagcactgtgtggaaggatgctggccaggggctcctccagtcactgaagagagatggaccaaagttcccttgtagacaccaccctgatgggccactgccctgcacttgtccctgatgggatcctcgaaaatgggtataaacattcatttgcaccactgttacaggtagtgagcagagagagggttcatgaagcacctcacgtgagcagaactgacggggacctttgaggaaagctcatcgtgggcatggggtgggatacttctgtaaatatgttcatcatgctctacgaatttaaaaaatgccaatgattaagcgaaaagcaaaaaaatgacatgaagacaggctgagaaggaaaggggctggcgggtaggaagccacagatggggaagaggagcgcgctgagtcaaggagggactgttacagaagcacacggatgtgatcagaggaacaaagtatttacctgaagccgtaaagaagcagaatcgacacaacagaataagcaaccagtgatgtttggggcaaacttgagaagcctttccagaatatgaaggaggaaacaccaaagccatggggacatgtgagagaggagatgacagaaaggggacagagagcccgggtgtgatggttggcattcataaggaggatacgaaaacaggcgaaacagatgccacagtggttctcctgcatggaagacctgagtatgcagacaggaaggcactccctgagtgtcagctaaaaagtaccaatatgatactgagacacatcctggtggaatcgttgactgtcaaggataagaaaagagctctgcaaaggacccagccaaaaaagctgataaaagaacaaaaatcagattgaccacaaacttttgcaacattaaatgttgaaagaatccagaaaaatttcacgattgtaaaggaaacattgcaacagaagaactttatatagcagcttaagttgtcatttgcatctggaggcagtgaaatggtgtgttcagatcagcaggtcggggaggatgagggacatgtggatgtctgcctccaggcaggccttttcctgggagcggcacgtcttcccttggcaccccatagatgtctgaggctcagcagctcacagtcgagtgtcaccagcttcctcccagacagacctcctttgctggctcagcatagggcatcactgtcccccaagttgctcaagagagtcccacccctccctccctgcccctccatctctcataaagcaagaagcctgcatgcttctctctagtcctgctgccaccctctcctgccttcatcagttccctggacggttggtcacaagagcctcgttgcctcctctctctctcccccaagttggaagccacgtgtttttattaaaactttgatctcattaggtttctgtgctcctgaaatccctttgttggctttttatcgcccataggatcaagtccgaaatcctcaccactctcgggctccagccacctccctgcctgtctctacacactgtcctccagcctgcagccttcccttggcttccggaacctgctggtggttttcacctctgaggaagtctgcacccagctctcccctttgtctggaatactcacccactataggcccacctgctgtaggctgccctccaggcagtctcctaccacccagactgtgtggggctcctcttccattcccccatctccttggtgtctcggcaacttgaatcaaacttgcgggtctcttttctgactagattgtgagagtcccaagggcagtgggcccgggccctggcacacagtaggtgctcagtaagtgctgtgagtgtgtggctgcacatagtggtgctgtccagcataggcctttggaaactacctattaatgaacaatctgcattgagtctgtcagtcatcatccaacaggtgaatgctcactgtcccactgcacagatacaccgtggcgtttccctaggcccctgctgactttggtgctggtgtgcttacaggcttttgctataattagaaatgctgagatgaaaaatcttgcccacgtattttttagcacctctctaacgtttcctaaggtaaatctcagaagtagaatcttgggtcgtctagattgtcaacatctttctgtcccatacctgaatgtgttcatttcctcattctagcaaacactggacatcttaattgattttggattccttgctaggagctaaacccgttttattacttttcatgttgcaaattgaggtgaataactttttgtttgtgctagttgcatttctctttttgtgaattcctgttgttattctttgcatggtgttctaatttagtccgtttacacttagtgcagttgttgatatagggaggcttaagtctgtcatcttgctccttgtttcacatatctccccttatggtttttgttcctcttttgcttatttactgccgtctttggggttgactatttgttagttttctactacattttgtccactggcttgttctctgattcagctgtggtcttgcagggccccccccatctggatgcatcctccttggctcagtggcaccctcatgctcctccatgtagactcagctctgtgccctggtcaggctgtcatccccacacaagatctggggcactcgtgggctggcctcctgagtgtcccttgtctcggggctctcacttgtatgctgcctccgcccacggctgacaacagttgcctctgatcttttgttctgttttacacttgtttgctagtctggtttctccttttctaatctgtccagaatcaacctgatgtatgtatgtatgtatgtatgtatgtatgtatgtatgtatgtatatatatatatatggagtcttgctctgttggccaggctggggtgcagtggtgtgatcttggcttactgcaacctctgcctcctgggtttaagtaattctcctgcctcagcctctggagtagctgggattacagatgcatgccaccccgcctggctaattttttttttttttttttgtattttttttttaaatacgttttaccatgttggccaggctggtcttgagctcctgaccttgtgatctgcccgcctcagcctcccaaagtgctgggattacaggcgtgagccaccacgcctggcctgatgtcctttaaaaaggattacagaatcctaaaactctatggctagaatggagtttagagatttcatttcagcaaagatgaagaaatttgaacaaaaggttaagaattgctagtaattttttcctaaagcatgtattttattatataatcaaaagtgagatagaatatattctaggatcgaaactctgtttcctaatagataaatgtatttgtgactagttcccttagtagtttctccagtattttttccttcttcatgtagccatggccagggaagagtcagtcatttcagttaagaaattcaagtcagttgtagctttttatttttctttctttctttatttttttttgagatggactctcgctctgtcccccaggctggagtgcaatggtgcgatctcggctcactgcaatctccgcctcccgggttcatgccattctcctgcctcagcctcccgagtagctgggactacaggtgcctgccaccacgcccggctaattttttgtatttttagtagagacaggggtttcaccgtgttagccaggatggtctcgatctcctgacctcgtgatccgcccgcctcggcctcccaaagtgctgggattacaggcgtgaaccgctgcgcctggcctgtagcatcgtttaagtgttgactacttaccttacatttaaccaagaaattattcctgaaccggataaaatcactagtcagtgtactttctcttaaaaataaatgactcatgtaaaattcaatatccattatactgaaaacctgtaatgaactaggaatagaaaactacttctttttcatgagagagagaaaacacctgtgtcaacagtcaacatcgtatgtaatagtgagtggctggagatatttctactacagtcaggaacaagggtgggtaccatgaccctatttagatattctacaacagtggtccccaacctttttgctaccagggactggtttcgtgaaagccagtttttccgtggactgctaagtctgtttgtacagtattcttttggcctcaaacccacctctggtgatgagaatgtttctttccttttggtgcaaggagggcatctcctacatgggagtttcatcacctgcttttaagaagaaagggggaagtcagactggccttcttgcaccgctgttttttaagtgcctttagctcaaaataatgctcctgccaaagtagcatatttttgggtgggatagtctgtcacccttcagtgaacaggtgatttcaataaatatttcccttgtcgaagtcaaataaaatatagagacaaatcttgaaatttaaaacattttattcgggaagaaagaattacaatttggggtatacatgcagaccagatggtcttcggtatgtctgaagaacagagcaggttgggagttttatcagaaagagaaaggttacgtattgtcttggaagaaaactcattggcactagaaaagttttggggagctggcaagctgggattggtgagtgacagtggtaggtaaagccggtcttagagtcacagagggttgtttcagtggcttctaggtaaaactggtcttagagttacagcaggctgtgtcagcaactgggcttctgaaaaatataactcttaaacatttttttatttttatttttgtgacagagtctcactctgtctcccaggctagcgtgcagtggtgtgattttggctcactgcaacctccgcctcccaggttcaagcgattctcctgcctcagcctcccaagtagctgggactacaggtgtgcgccaccatgcctggctaatttttgtatttttagtagagacggggtttcaccatgttgaccaggctggtcttgaactcctgacctcaggtgatctgcccacctgggcctcctaaagtgctgggattacaagcgtgagccactgagcccggccaaaatttaactcttgaagcagatgccctgagtgctttttcccctcaaccctatctctggtttagttgggtatgacaagaataacccaactcataaaatcaattttcagaccattttaaggtccatcagaaaggccagtttgaagatttctctgttttgtgttctgatcttttgccttgaccacagtgacccattggggctcatgccaagctcacttacgctggcttaacacataattctaagagggtttctcattcatcttccaaggccattcacgtttatctgtaaaagtagctaacatttaatgatattttgctctgtatgcattttttctcctatagaaatttaccattaataattattcattatagacaatataattattctaacagctaacatttatagagcacttaccatgactaaggaattgcatgttttatttaatacagtcacctacagatgagacaggcgttacacccatttgctaggttaggaaaatgaggcacaaaagttacctagtccaagatgatacagacagtaagtcccaaaggtaggagctaccccagatctgttgggccccggtctgggcagttagccctcatcctgtccagcttctcatacatccatgctaaaggcttaccacccatgtgtaagtagatgtaagtaattcgtctaatgagcagcggtctgttatttggaaggctccttttaacagcctattcctgacttggagtagcagttttctagctgctgccagataacagttcagtagttattatcttcagttgtcagattgtagaaatggcatgggagtagagctaaagcttcctttatagcctagaaataagatagtgattaatgaaaaatagttgatgtaaatttctaaaactatatgaaaacggtttggcattacatcataaagttgagaacacacaccctttgacccagtaatgccacttcctgttgcatacccgacagtcacgtgctcatctctattgggacatatataagattattcagagttgtatttttttgtaatagccctagacaaaaaaaataacccaaatgttgtccgtcagtggcagaatggatgaatagtggtatttcattcatataataaaacactattcagaaacgcaaatgaacaaaatacatgtaacatggttgattcttaaacataattttgaggctgggcatgatggctcatgcctgtaatcccaatgctttgagatctaaagaggaggatcacttgaggccaggagttcaagaccagcctgggcaacatagcaagaccttgtttctgcaaaagtaaaaaattaaaaaaattagccaggcatggtggtgcacacctgtatcccagctacttgggaggctgagatggaaggattattaagcttagaagtccaaggctgcagtgagctgtgattgcaccactgcattccagcctgggtgacagaacaagactctgtctcaaaaaattagtcgggtccggtggcttatgcctgttatcccaacactttgtgggggccaaggtgggtggatcacttgaggtcaggagttcaagactagcctggtcaacatggtgaaaccacgtctctacaaaaaatacaaaaattagcctggcgtgatgatgcgtgcctataatcccagctactcgggaggctgaggcaggagaatcacttgaactggggaggcggaagttgcagtgagctgagatcgcgccactgcactccagcctgagggacagagggagaccctgtctcaaaaaaaaaaaaaaaaaaggatgtgtttgcaggctgttttgcttgtgtgttcaagggatccaacttgacctacattcgagatgaacatatggtttatgaagaagtttggtgatggaatatttctggatgaacaggacacttagaataattattcagtcattctgtgcttttcttttgtaaattgaatgcaggtattcctctgtttatgaagaacacaacttttttttttttttttttttttgagacagagtcctgctctgttgcccaggctggagtgcaatggcgtgatctcagctcactacatcctcgacctcctgggctcaagggcatcatcttggctcactgtaacctctgcatcctgggctcaagcaatcttcccacctcagcctcctaggtagccaggaccacaaacatgcaccactatgcctggataattttttatagagatggagtttcaccacgttgtccaggctggtttcaaactcctgggctcaagccatctgcccgccttggccttccaaagtgctggcattacagcgtgagccactgcgcccagcctagaaaacaaacttttgacaggttgcatataaatcaattcctgaggtcatgagagagtatgttatttgaagcaaatacatactcttttgatttattgcccacctccccaccctacaattaatcaggcttttgtttattgggtttgcttaatgtcgggtagagctctgctcaggagtgtggctgagcagtcacatccagcagcggggcagggcagcggtcagaggcctccattcccatgtgccctggatcctgcttccgagagggacttctggcagcattaaagaccagacttctgagacatttttttttacattttattttgttttagatttgggggtacatgggcatgcttgttaatgggtagggacttggcttctcgtgtacccatcacccagtagtgaatgttgcacccagtgggtaatttttcaaccctccccctcccaaccctcccgcattttggagtactcagtgtctattatttccatcttcattttttaaattttattttaagatattttaaaaataatacttttggccgggtgcagtggctcacatctgtaatcccagcactttgggaggccaaggtgggtagatcacttgaggtcaggagttcaagaccagcctgaccaacatggtgaaaccccatctctactaaaaatacagaaattagccagatgtggtagcaggcacctgtaatctcaactacttgggaggctgaggcagaagaatctcttgaacctgggaggtggaggttgcaatgagctgagattgcaccactgtactccagcctgggtgacagagtgagactccatctcaaataataataataataataataataataatagtaataattctcttgaaggattgcagttgaaattcaaataaatctctaaggtcaataatgtgtatttatatgacttataatcaataactataaatttaaaaatcactagaagtgcaaatgcccatgtttctgaggacaagtgtgtgtgtggtaaaatgcaaataaaatagtcccagaaataactgttcgcttgagaaatcttggaagcattttctgaaaagtgtgtgcgcacgtgagcacatgaagtggcccaacgctgagctgccttgccagaggccttcctgccagaaggcagctgagtaaacagtctttagcccgcaggaaaagggaggccagccaggtaggaggcaggaggggacaagaggggtgactttgtgtccccttgaaacacacgtgggctgccacctctctgtttgcctaacttggagaaactgcctttagacactggatccatggtgagggtgccacaaaaaggtgccgtgggtggttctgcgatgttcacagcagacttcctctgagctcaggatcaccaacctttcagcggagaaaagagctttgagatgaatttcatagctgtgggttatttatattcttaaaatggagatggagaaggaagtgtgtcgatgaggaaggtaaattacattttaatgaaagaacttgcctggacatgacagcttgttaggtggtgctgataatatctataaatacttttttcactgtgcgctaaagtattccaaacatgcctggctaagaatgtttcatagccaacaagttgacaggaggtaaaataactgtatcagtgcacaggaaaaagcacccatgccttgtcctgggggcacttgcaacttgcttctttctggggaataaatttacgataatggttaacatctacttgagggtttactatgtgtgaggcactgaactgcttactttatattatcccatttaatgttacctgaaggataaatattattatttccattttcttgtgaggaagctgaggtacagagaggtcattccaaggtcataaagttaggaggtggtgaggctgggttgtaccagcccctggaaccacaaggcactgactgcgggtcctgctgcccccgaatcctcctatggtctaggtggttttaggtcatattttgtgtaatgacagatttcctttccttttcttttcttttttcttttttgagaaaaaagggtttcgctctgttgcccaggctggagtacagtggcacagtcttggctcactgcaaccttctcctcctgggctcaggcaatcctccctgcttagcctcctgaggagctgggactacaggtgtgcaccaccacgccttggtaatttttgtattttttttgtagaggcagggtttcaccatgttggccaggctggtctcaaatttctggcctcaagtgatctgcccacctcagcctcccaaattgctgggattaccggcatgagccaacacacccagccatgacagattttcaataattaacacagcaggggcagtcatctaattcctgtgtgggggtaatagatcctcaaactactattggattaaaagtctttaaaaacaaggttgtttttatctggaaaattgttgatatatctacatgagcaacatataactcgaggtctgtcatcagagaggtgtgctttttaaagcaaataatcacggcttgatgcgttcacgctgcccctgctgtgttaaatgaaagcttgaaaattgccagagtgttggtgttttgcagcaatgtattccagtgcctttatgctaataataaaacctgtcctgactatcacaatcccagcccaagtgtacttattttaaagtcttaatctcttaaacataaattataagctttaagattagtgttccaaattctgcttggtcctgtgcaatagaaatatgaggagtttggccagattacctcttagtgtctttttctacattgtaactctccaattttgtaagatatttgtttatattagtctcctaccttaaggtccatgccctaaacatttttatattagagttaacacgatgccaaatgcacaggaattacttgatagtcattatgaatgggttttaatagaagtttgaatttcttaactaagtcaatgagacatttactaatttgtgtataataaagacaatatatttttctcttgggaagtagcttattttattgaattcatttcagtcatttagcgtcttaatttaaaggcattttatatagccttttagaaattaaacgtttgatataaccatagattcatatccagttataagaaataatagacgcccaggtgtggtggcacgtgcctgtagccccagctactttggcaggctgaggcaggagaatcgcttgagcccaggagtttgcgttcagcctgggcaacacagtgaaaccctgtaaagaaaaaatagtagaaaaagaaataatagagatatactgtatgccttttgcccactttcccccagtgataacatcttacagaaccatagtacattgtcaaccaggatattgacaatgaaacaggatccagaacatttgtatcacctcaaagatccctcttgttgcctttttatagccacaccctcttcccccacctcgaactcttccttcacccccagctaccaccatcagttctccatttctgtaactttgtctttccagaatcttgtgtaaaaggaatcctacagcatgtaacctcttgggattcacttttcttattcctaatcctctgagggccatccagtttgttccatggattagcagtctgttccttttttttttttcttgagacggagttttgctcttgttgcccaggctggagtgcaatggcgtgatctcggctcactgcaacctcgcccccccacccgggttcaagggattcttctgcctcagcctcccgagtagctgggattacaggcatgcgccaccgcgcccagctaactttgtatttttagtatagatggggttttgccatgttggtcaggctggtctcgaactcctgacctcaggtgatctgcctgcctcagcctcccaaagtgctgggattgcaggcatgagccaccatgcctggccagtctgttcctttttattggtagatagttttccctggtgtggatgcaccacagtttagttaaccaattacctatcgaaggacacgggggttgtttccagtttgtggctactttgattaaagcatccgcatgcatttgtatacaggtttttctataaacatgaattttcatttgtttggataagtgtccaggagtacaactgttggttgatactgtagttgcatgtttagttttataggaaactgccaaactgtgttccagagtggccatatctttttacattcctgtcagcaatgagtgatccagttttccctaaccagcatttggtgttgtcactattttttattttagccattctgattgttgtgtggtgatggctcattgtggtttgaattcgcatttccctaatgcctaatgatttcaaacatattttcatgtgtgtgttggccatccttatatcttcttcagtgaaatgtgtcttttgcccattttctaattgaattatttgctttcttgctgttgtgttttaagagttctttgcatattctagctataagtcctttattggatgtgtgatttgcagttgtttttgctcattctgtgacttacctttgcggcttcttcccagggtctttcgcagagcaaacatttgaaatttttgtcatgcttttggtgtcaagtcttcgaactctttgcctagtcctagatcccaaagactttttcctcctgtgttttttatcttaaagttttatagattatatttaaatccatagtccatttcgagttaatttttgtttaagatatgagattaggtcaacgttttgtttgttttttggcttatggatgtccacttaacccagtgccaaatggtgcaaagctctctctgccactaaattgcttttgtacctttgtcaaagattgcttgggcatatggacatattcgtatggatctacttttggattctgtgttctgttcatttgatctatgtccctctgtcaatactgcactgtcttgattactgtaattgtataaaaagacttgaagcctacgcggtggctcacacctgtaatcccagcactttgggaggccgagatgggaggatcaccttagctcaggagtttgacaccaacctggccaacatggtgaaatcccatgtctactaaaacaaaaattagctgggcatgctggtgtgcgcctgtgatcccagctacttgggaggccgaggcaggagaatcgcttgaatctgggaggcagaggttgcaatgagccaagatcacacaactgcactccagcctgggcgacagagtgagactccgtttcaaaaaaaagccttgaaattgggtagactggttatttctgtctttattctttttctgaaaatgttttagctattgtagttcctttgcctttctgtatacattttaggataatcttgtctatacaaaaacattggctgcaagtttggtaggatttgcattaaacatgcgtatcggtttggggaaaattcatgtctttactgtgtcctgtcttccattccatggacacagtgtgtcttctcatttatttagatttcctttgatttctttcatctgcattgtttcgttttccatttccaagtcctatacatgttttgttagatttacaactaaggatagtcttctattgaacaattgtcaatggcattgtatttttaattgcagtgtccatgttttcattgctcatacatagaaatatagttgattttcatatgctcatcttgtatactacaaccttgctgaactcacttattagttgtatgagttttacgttttacttaaagtcccaattatttaacactttctatgtgccaggcattatgctaaagctttcttgtacttgtccaagccagtaaatggtggaactaggatcttcatacataaatcatttatccacttcattagttcatttcacaaattcttaggcagagcttatgtgaatcacagtgaatctaggcacaaggtcctgccctcctgagcccacagtctgaaactagcagaagtaatgcaagtgaatatgtagctatgatacgttcaaattaaataagttgatttgttacaactgagtgcatttactagctcattctgtaagtgggtgaggcaaggaagggccccttaccggtctggagtgggtgggggggtgtccagggagggcttcctaaagaaacagtgttgcagggcatgatggcttacatctgtaatcccagcgctttgggagggcaaggcaggaggatcacttgagcccaggagtttgagagtagcctgggcaacatagtgagaccctggctgtaaagaaagagagagagaagaaagaaagggaagaagataaccatctgatctttgacaaacctgacaaaaacaagcaatggggaaatgtttccctatttaataaatggtgctgggaaaactggctagccatatgtagaaagctgaaattggatcccttccttacaccttatacaaaaatcaattcaaaatggattaaagactacatgttagacctaaaaccataaaaaccctagaagaaaacctaggcaataccattcaggacatagacatgggcaaggacttcatgtctaaaacaccaaaagcaatggcaacaaaagccaaaattgacaaatgggatctaattaaactaaagagcttctgcacagcaaaagaaactaccatcagggtgaacaggcaacctacaaaattagagaaaattttcgcaaccttctcatctgacaaagggctaatatccagaatctacaatgaactcaaacaaatttacaaaaaaaaaacaaccccatcaaaaagtgggcaaaggatatgaacacacacttctcaaaagaagacatttacgcagccaaaaaacacatgaaaaaatgcttatcatcactggccatcagagatatgcaaatcaaaaccacaatgagataccatctcacaccagttagaatggcgatcattaaaaaatcaggaaacaacaggtgctggagaggatgtggagaaataggaacacttttacactgttggtgggactgtaaactagttcaaccattggggaagtcagtgtggcgattcctcagggatctagaactagaaataccatttgacccagccatcccattactgggtatatacccaaaggattataaatcatgctgctataaagatacatgcacacgtatgtttattgcggcactattcacaatagcaaagacttggaaccaacccaaatgtccaacaacgatagactggattaagaaaatgtggcatatatacaccatggaatactatgcagccattaaaaatgatgagttcatgtcctttgtagggacatggatgaaactagaaaccatcattctcagcaaactgtcgcaaggacaaaaaaccaaacactgcatgttctcactcataggtgggaattgaacaatgagaacacatggacacaggaaggggaacatcacaatccggggcctgttgtggggtggggggaggggggagggatagcattaggagatatacctaatgttaaatgacgagttaatgggtgcagcacaccaacatggcacatgtatacatatgtaacaaacctgcacattgtgtacatgtaccctaaaacttaaagtataataataataaaaaaattaaaaaaaaaaaggaaagaaggagaaagaactgatgttaattttcccaagcttattgattcttatcaactcacatcagtttctgacattcagagatgtctgtgatcaaagctcatatgaagagaattctaaatgttgcatggcaaagaacccaagaactcctggcccaaaccgcatgcagctccccactcgtctctgcgtcctcctcacctccttcacctgctgctgtctcaacttgaccccttccatctggcccctgacccctggactctgtggcctccctgagcggccagcacagtcacgtctaagtcgacctgaccatctgcctgctgggtgctgctggctgctgctggctgctgctggcgctggctgccctgcacattctccatgccctcctttccatggcaccagtttctgcctctcctttgggtttctttccccttgccccctggcaagctgggttttgaagtcatttgggatggaaggtgggccatttgaagagctgtagggtcaggccctcattctgccagtccatttgggaaaaatcttccatgtcactaagctcttgtaacaatagctacaaaagttgcttgttagttgggaactgaaatctgcctgtatagagatttgccctcagatggatttccaggtaaagacagacccccatccccattgagcagggaaggagcggcccctccctggcagtgctgtgtcctctgatggcgtgcagcacttcagagttactctgttaggcagcatggctctccctttgcatgggagtgagtgtcccacaaccagcactgtctctgcctgcgcctttcctcccagccccatggccgtgtgctgagtgcaccggccctgttctgcctttggactgaggaggcgtgttcctcttcctatgtctccctgactgtaggagcgatctctctttgagtcggcatggaagaaggagaaggacatcgtttccaaggagatagagaagctccgcacgtccatccagaccctgtgcaagagcgcacttcccctggggaagatcatggactacatccaggaagacgtggatgccatgcagaatgagctgcagatgtggcacagcgagaacaggcagcacgccgaggccctgcagcaggagcagaggtggggggtagtaatggggagggggccctgcagcaggagcagaggtggggggtagtaatggggagggggccctgcagcaggagcagaggtggggggtagtaatggggagggggccctgcagcaggagcagaggtgaggggtagtaatggggagggggccctgcagcaggagcagaggtgaggggtagtaatggggagggggccctgcagcaggagcagaggtggggtgtagtaatggggagggggccctgcagcaggagctgaggtggggtgtagtaatggggagggggccctgcagcaggagcagaggtgaggggaagtaatggggagggggccctgcagcaggagcagaggtgaggggaagtaatggggaggggggcctgcagcaggagcagaggtgaggggaagtaatggggagggggccctgcagcaggagcagaggtgaggggaagataatggggaggggccctgcagcaggagagaggtgggggggagcagggggataatgggaggaggcctgcagcaggagcagaggttaagggtagcagaggcagggagtaatggggagggggccctgcagcaggagcacaggtaggggatagcggagtggggggagtaatgggggaggaggccctgcagcaggaacaggttggggtggggcaggagggtaatggggagggggccctgcagcaggagcagaggtaggggtgtagcggagtggggcagtaatggggaagaggccctgcggcaggaacataggtggggggtagtggaggggggatccccaaagtcaatggggactttgctgcatacctccttgtcccagaggttgttctgtatgtaatttaaggacttcaagattatcattgaagaaatattaactgctgcttttataaatctcatgtttgacttcacttttggttgtagcaggggttgtgaaaataagaaataaatattatccttttctttggatgaaacgaataatttacttctgttgtctttcaatgtcttaattaagaagccaacacacaatgagatgagagagtgatgagccgctggttttgttctccctcaggatcacagactgtgccgtggagcccttaaaggctgagctcgcggagctggagcagctgatcaaagaccagcaagacaagatctgtgctgtgaaggccaacatcctcaagaatgaagaaaaaatccagaaaatggtatatagtatcaatttgacttcgagaaggtgaacactcaaaagtttcagagatgaaaagtcacctcagtttaaaagcaaaaaggaagatagaaaatcattactcttttaagttccagtttgctaagaaaatgaacagtttacaatgttattatccagctaattttcagagctttaaaactgtaagcatgttaagtgtattaaaaaaaccatgttttcttacctccttccagatggaatactggctagttataaatagcgcttccaaacacctctgtgaaaagtttttttgaaagcctgttctttgtgtttctgctgtaacctgtttagttctgtaccagaactctctagcaggtaagtggtgtgggcataccaagggaacagtagtcctttattttggtttagtggaaagactttcagaggtcagtgccgaatgaaggatgactgtgtactttttgataggcacttgataagtagaatgaggcctgaaaatgaatacattatatttttagttaatttccaatggaaagggctaacctcagcctgtctccatatcaggtacctatcaactggattgttttcatttttgttttttgacctctttgtaattgcatgtacttctctatgtaattttcctcttgatctctactatcgtttgcttgtgtttctagtccttaaagttcataaatttaaaaaggagatttcaggatggcctttatggacgttgtctggacatacatcctcactttcttccgcagtttaccctggttttcctcagacagaggctagcgcagccccccggagtccttgttctccttaagagggtctcgctctgcaaagcattggcgccatggcttttcctttgcatgggtgtgcataccgagagacaggcagcttaggaaaaacaacataaggaagacttaaaaggatgcactgatttacgacgttttttgatgttagccatttttttggaaattgttttttaaagcaaaagttttttaaaaacatggtttatagtttttcacttacatatactattgtaaatacttagcagagtcttaagttactgtataaaacatttcattgtgtttgaagacatacttatgggtcttgaggtctgggtcctaatacttttaaatagtgtatttattatgtaaactgaggagtgccatttaaagtgtgaggattgcctgaaaaggttttgtttctttcttttttttttttttttgagatggagtcttactctgtcgcccaggctggagtgcagtggcgcaatctcggctcactgcaaccaccgcctcccgagttcaagtgattctcctgcctcagcctcctgagtaactgggactacaggcgcacgccaccatgcccagctaatttttgtattttcagtagagatggggtttcaccgtgttgaccaggatggtctccacctcctgacctcgtgatccgcctgcctcggcctcccaaagtgctgggattacaggcatgagccactgcacccggccaggttttgtttctttaaggattagcacaaatggcaccgttgggtttttcttcatacaatttccaaaataaattctgtactcaggttgttatatgattttctgagctgaataagttcaggagcagattattaagatctgccattctgaaacgctggtctttttctccttcctatagtgcaccataaaattctgtttgatcagattatattacatacattttgggggagtggagggacatgagttaagtagcccttcatgtatttataatctcttttctactgaatcaaatgacttagccatgaccctgaatggaccttgttttacttcaagttgagatgtctgccttttatgaatttgtatatgtgaatagagtttgggggttgccaaaaattgcatacattgtatgtaagtaaaattttttatgaagtagtctgtcaaattgtatcataaagtttatttttcttttatacgtaaatcattaaaaataatcacatattttttccataa

SEQ ID NO: 2586 - DNA, 80358 bp, Homo sapiens; identical to SEQ ID NO: 2585

SEQ ID NO: 2587 - DNA, 1502099 bp, Homo sapiens; identical to SEQ ID NO: 2000
  misc_feature (369735)..(369735): n is a, c, g, or t
  misc_feature (455030)..(455030): n is a, c, g, or t

SEQ ID NO: 2588 - DNA, 1502099 bp, Homo sapiens; identical to SEQ ID NO: 2000
  misc_feature (369735)..(369735): n is a, c, g, or t
  misc_feature (455030)..(455030): n is a, c, g, or t

SEQ ID NO: 2589 - DNA, 551953 bp, Homo sapiens
taggatcgcgtcttcgccaggaggactttcccccgcggattgtggagcatccttccgatgtcatcgtctctaagggcgagcccacgactctgaactgcaaggcggagggccggccaacgcccaccattgagtggtacaaagatggggagcgagtggagactgacaaggacgatccccggtcccacaggatgcttctgcccagcggatccttattcttcttgcgcatcgtgcacgggcgcaggagtaaacctgatgaaggaagctacgtttgtgttgcgaggaactatcttggtgaagcagtgagtcgaaatgcgtctctggaagtggcatgtaagtgaacataatgaacctcatgtgcacatttacttttatttatttcaagtaagttttgatgtgttcccatagacgctgaaacctaaagaatcaatcaacacactgcataattttacttggtcttcttcagagaagtctggtcaagatagtatcaagccagggtgttgtagtaagtttgtttatatgaaatcaagatgaccaatatgttattataagaaagcaggccgggcgcggtggctcacgcctgtaatcccagcactttgggaggcggaggcgggcggatcacgaggtcaggagatcgagaccatcctgggtaacacggtgaaaccccgtctctacaaaaaatacaaaaagaaaaaaaaaattatccgggcatggtggcggcgcctgtagtcccagctactcgggaggctgaggcaggagaatggtgtgaacccgggaggcggagcttgcagtgagccgagatcgcgccactgcactccagcctgggcgacagagcgagactccgtctcaaaaaaacaaacaaacaaacaaacaaacaattatgccttaaaatttttgcactcttcagcttccttgttgtcatgtacgtcttcaaagataagagaattgggagatttcaggatgctggaatcttatgtatatagctatatatattttctcctaaataatagctcatgggcctgtgtctttcttttggtaaacaaaattgtacttttctttctttcttttttttttttttttttgagacagtgtctcccgctgtcacataggccggagtgcaatggcgcgatctctgctcactgcaacctctgcctcacgggcttaagcgattctcctgtctcagcctcccaagtagctgggattacagacaccaggcccagctaatttttgtatttttagtagagacggggtttcaccgtgttgcccaggctggtcttgagctcatgacctcaggtgatccactcgcctacaatttcttatgtagctatcccaatgaagtttttcgttctcaggcatctgcttctgatttacagtttgtgctaagaaacctggaacccccggatgctggaaatgtataactccaataggaaaagactaggagaatcctaagacccatattttttattttttgtgaagtgccttgagctatgagcagtaggactttagttaacaatgggattttgtactggccaccaaatagttttatttttataaaatgatacttcaaaaagccctcaaattaaatgcaatttgaaatacacacacaaaaattcaagaatgcaaatatccatacctgttccatttttgttttgaaatatctaattttggaaacttttcaaacatattgaaatacctcaataccaaattttattgatttttttcccccaacagacccttttatggtgaatatgactggcattattctcccattttcaagataaagaaaatgatgcccaaaaagtttaggtgaccaagattcagacaataaattaatggggatgctagaccaggtcctgaatcttctaatttttatttttagggaattgtgtcatatttgaagaaacactctaaatgaaatctggtctattttaaatatataaaaattaagaaattttaatttttcatttttaaaattctatctactcagcagcaaataaggtgtttaaatccttaacaaaattttacttttcaaaattaaagtatataaaaattgacctgtcattttgttgtttcatctaaaagaattgctttcttttctaattgcgtcattaataatgaatcaaactgttctggtgggaatattttaaaccatgatttttgtgtgtgtgtgtaatgtgacagtaattttttttattttgaagtaaatgagctttaagaaatacttgaattactcatgacctagagaggaaaacaagaaggcttgcaaattggattagggagtgaataaaatccctttttctaatgccatgtcaacagttcattccatttgaggcatcacaaggtcaaataatattcatttatatgttgctcatctctttccattcgctcatcagtcttctatctttccttatgtgtttcataaaacatattaatatggaaatttgggttaaagcattgtgatttttcactacctattggtaactaatatgtattttcataaaatgacagaggaacagctgtagaggaacaacttcagattatgttaaattggccttcatattttagaaaactcaacataaatactcattgtggtgcattcacttagtttattaatagaaggcggatatccactgaaagaggtgttaaggaatagcaatgaagacacattccaatgtattctcaaagagctcacattctagttgggatgacaaacatgtaaataaagagttactataataaattaaatatacaaacaataaagcctattataaagacatgtaaaaatactacgcaaatccggagggaagacatttaattcttcctagataggtaagcttaagaaatgattctaagaggatacattactttcacagtgatttaaggtcatttaagaatgtcccaggtggaaattgaagtgaaagaccatccaggtagaaagaatggaagcttaaatgaacactgtgtattcggagaactgccaggtgtctggatatgaggttgagagcagagtaaattggaaaggtaggcatgtgctgaataaaaatctaagctattttgttatgagaaaagagaatctttgaaagagaattgaagattgcattaaaggtatgatgattgaagtcagagaggcattaagtagctgtcaaataattcagaaaagagttgatgctagattctgaactgaacatagcagtgaagattgaaaggaggaaacagcttgaaacatatttaggaattataaactatgtgacatgatcaatgagaagtagaggatgattactagatttgttttgttttgttttgtttttggttaagtgactgggtatatagtgctaccatccatagaggtgaggggcaggtacaggagaaataactctagggaacagaacagtatggtaaacgttagctgtattgtttgacataccaatgaaatagtaagcttaaaatatctcaagtttcattaaagaaacagcttcttctagagttgaggggagaggtctttctgagataggtgttgaagccacggaagtatatagaagtagatgtgatttccaggcaggctgtgttcagggagcagttaataagggctgagtccaattccagtgcttagaacagtaatatttagtggtggtcaaggcaagaaatgctcatgcaaaaggatcagtctcaggagaggtatcagagtgatagaatatgggcagtgaagtggcaagaataatcaaggaatacattaaaaaataataaaattggggccaggtgtgttggttcacacctgtaatcccagcactttgggaggcccaggtgggtggatcacttgaggccaggagtttgagaccagcctgggcaacatggtgaaaccccgactctactaaaaatacaaaacttagccaggtatggtggctggcacctgtaatcccaactactcaggaggctgaggcaggagaatcactcgaacccaggaggcagaggtggcagtgagctgggatggtgccaatgcactccagactgggcgacagagtgaaaccctatctcaaacaaacaaaccacaagagtactaaacatggttgacacgatgcaaatcccaaatgatgatcaaataaacagtacctgtgggctccagtgatggggacagaacagctgaagagcgagtagtggtgggatggaagtagcaaatgctgccgggtctttcctagaatggagctctgaatggagcatggagaattagagcagggtacctcaacctctgcattactgacatttgggatcagaaaattatttagtgtgtgtgtgtgttgcgtgggtgggtggattgtgctaggcattgtaagatgtttagacatacctctggcgtttgttcacaaggtgccaatgggattctccctagccctgttgagacaaacagtatgtctccagacattggaaatattcctcaggagagaaagtcagttgagaaccactgacctagatgtacctaagtagtcaagaatgtattgatatgtaggacataaacatgtcacaacttttatcataaaatgattattgattaaaaatatggaattttttttactattttttattcacattagttgtcatttttaatttcaaaaatgttcgattctactatgatacgaaatgtggaatgttattgataaccatctgtcttgactgattttttggaagtcagccagttctttaccatactgcattcattttggtgtttgttttcctttaatacatgcttcacctttatgttctggaacaatacagcagagggaaaaaaattcaggaccaatcattgcaatgaatcacctcaaatttgcttttatttttttcttagtttgcaaaaaaaaaaaaaaaaaatagctatccagaaagtgttttttgagtcacttgacctcaaaaataatctctaggcaaaaaatgttttttaaatagttagaaaacagttgcagagttaataagcaagaggcctggtagtcaaaaagctaatacatagttttccaatgggaccaccaggagagccatggtgtagctggtgcagataaagtttccgttctgaacactggcgctccctgtttatggagcagaaggagcacagggggtcctcacagagattgtagctgcctgtgatgcagctgagtcagtggcagcctctagagatggcagctgtagccccaggtggcaaatagatgacagcagcttgatctatcgaccagggtaagagggggttctggcctaaatgaaaattcatgaaaaattgatgaagtccccagattattttttccgtttccttttctcagcactgtgccagtgcagagagtagagattaaatgaggtgctgaacgctttagtggcaaggaggttgtggttcaaaggtcaggggtcacatagaaaccaatctttttttttttttcttttttcttactgctaaagcaaaacacaagaaacttttcagattagctgtgatttacctttgctttgataaataaaatgactacatgttcaaaagttggcttttgatgcagttacaagagagaacagatgtgattcataattcaagtatggaactggaaatagattgaattccatgacttcaggatgattattttttctttttctcttattttttgtcttctgtatgaagactcatgctgtatgaaagtcatttagagaagaagaaggtcttgcattatttatagggttacagattgcgagaatagcaaagctatggaacactgtccaaacataatgctcctgtttgcttaaatagaaaattaaattgatggtttatctgtacaaagaagagaggctacagaagtagactgactttagtatgagagggcacaggtggcactgaaaatgaagacaaggtaaagagcttccttgatctcctcaagttaataaatatgtaaatgtttgttttttattttattttggctgtaaatgcatcttatctaggcaaaatacctttacacatcataaagacacaagataaattaaattgcaaaaagatcaatccatagagagctttttaaaaaaaatgcttaattgagatatatttaacataccatatcatttactcatttaatatatacaagcaatgtttttggtgtattcatggggttgtgcaatgaacactataatcaaatttagaacattttcctcaatcctaaaataaactctatacccattagaactcagttcccattcctgcaccctctcaccccagccctaagtaaatgctaatctactttctatagctatacattttcctattctggacatttcatatgttagaatcatacaatatattgtcttgtgtgactataatagcatcttttccttaacattaatgttttcaaggatcctgtttgtttagcatgtattagtactttattcttcattattgctcaataatatttcatggtatcaacataaccactttttatttatccattcattgtatgatagacatttgcattactcccactttttttctgctatgaacaatgttgctatggaaattttgatacacatttttgtgtgcacatatggtttcatttgggtattctcataagtttatgcctaagagtagaattgtcgagtcatatggtaactgtttaactttttgaagaatatatatgtaattattattaagtgtagattaaatgatatttactggtgcattgaagtaactgtatccaactcacctctcaatatgaaacacagtcataaaacatttctactgttttatccatattattatgtgactgttatgttagattttctatgtcgtatgtccataatttcaggtaagagtcaactatttaaaaatatagaacaattaaccatatggaaacaacggatggccacaaagttcctaataaatccttgtgtaacttctactagactgttttcagtttggtcccaattaagttggataatcttactgtttgagtcttcacttcattttctgttctgtttgtatttgttctgaaagctggcaatttgtcttctcagaagctgacgttacccttcctgagaataactgacagtactttcttcattctcgggttactttctcttccaaatatactgaggttttttctttcacttgtcaggttcagactaagaaattaatgaacaattatactagaagtcagttaagtaagtctaagagtgggaaaacaaagaactattatcattctctatctttcttaaaacaaagaagcacacaaacaaacatatcaacttaaatgcaaactccgtggcgatgagttggactggaactaatatttacaggtgaggaccaaaaagaatataggagcaactttcgttttttgtaattttctccatttgcatttctacaaatgtcaggtgagatttcatatatttttggtggtgatggtgggtggtaggggaggaggatacttacacagctgaaaaacgctccctagctccaggtacttcacaggataatgctaatatgttattttggctgttttgtgagtgtgccttttaattttgccatactccatcaaatactttcaaatgcagtctctcctttgatcttcacaaatgaaggtgtgaaattgctacacctggggaacgtgtatgaatttgtgatctatttaagtatgtataatgctgtattttgatacgaggtttatttctgttgattgaattaactgtattcaaactctctctcaacaagtctcaagttgccattcactgacaattagcctgaattaactctgactcccaggaaagcacataaatgaagtgaagtcattgtgtcctctacttttcaaaaatttattcccataaacagtataattctgagtatgatcctgaggtctgcagtcaagtagatcctatccataaaatgacaaggaaacatattcatagtgatactaagagttcaggagataaaatatgttgaggtctgctccggttttcgatcccagaaacccttttcatataaagttaagaaaaataatttaggattttgaatttatttcttactgtaattttttgtttgtttgtttgttttgagatggagtctggctcagtcacccagactggagtgcagcggtgtgatctcagttcactgcagcctctgcctcccaggatcaagcgattctcccaccacagcttcccaagtagctgggactacaggcaggtgccaccaaacctggctaatttttgtatttttagtagagatgggattttgccatgttgcccaggctggtcttgaactcttggcctcaagcaatcctctctcattggcctcccaaagtgctgggattacaggtgtgagccaccgtgcccggcctcttactataaatttttaatttattaaatttcagctggtgtgtagatgcaagttgattttactgaaaatgtaggtaggttgacattagcttaggaaatataatttcgtgcagtaactcatatgcttttctcccaggatttgtgtttcggcagaatacagatttccaatttcccttctttagatctataattacttaaggaaggttacacttcttttaagcatgagtcagtatatatgataaggcctttacagaattatagaagtaaaaacaataggtgaagttttgtttaactatgaaagtttttgctttatagatgtttctaacagtctatgatttagctgctaagggatgaggttcaatagtattaagatattctctccactatataccattagaattgatttttcctcttaggagattttcaaaagcaattctgaaccacccatttctgaattaaaaatacttatacatttttgtcaattagatattcatccactttttgtcactgtctcccaaaaaatactctatgaaagcattactgagccccaggttgggttgtttctctaaactatttgaagttttctaacatagtcctcctttgtctactaagacgtcagtagtttaacaactctggatgtcttagtctgttcaagctactacaagaaaataccataaactgggtagctttttaggaaaataaatttatttctcatagttctggagcctataagcctgagttcagagagccagcatggctgggttttgtgaggccccacctcctggttcatagacggcatcctcacaaggtgaaaggcactaatcccatttagaagagctctgtctcatgacctaatcatcttccaaacgctccaccttcagtgacatcaccttcagggataagatttcaacatgtgaattttggggggatataaacgttctgaccacagctctggcctttggagagacttcaagcaagggttgtaagagaggcaggtgtttggatgcaatgacagacagggcctggaaattgagcttaaattaacacccaagtagagaaaaggctgttctttctcaccgatattggcagccctacacatttgtcggttcctcatctgaggagttaaccaactgcgaattaaaaataatttttaaaaactaacaaaaatataccaacaagaaatattacaaatcatgtggtatagcatctatttgcatatcatttacatagtattaggtattataagtaatcaagagatgatttaatatatacaggaagatgtgtagctatatgtaaatactatgccattttataaaatggacttgagcatccaattcaggggtcttgagaccagtctcctctggataccaaggaacgaatgtgcctctttctgagagccaggccgtttcctagtaatgcaactataaaggcaagcatcacattttttgtgtgtgattatctaacatttaagtctgaaccaagattttggaataaacgttacagtatctatatatggaaatgaaatgtaactattttttccataacatgaggtatatttgatataaaccattttatataaatctgcctgcctcattttctttcttcttgctttctttgcttattcaaattgaacaagtacattatacatatatatgtgtgtgtgtgcatataaacatacatatatttttttcttaacatgaggtatatttgatataaaccattttatataaatccacctacctcattttccttcttgctttctttacttattcatattgaatgagtatattatacatatatgtgtgtatccatgtttatatatacatatgtatacacatatgcatatatatgtatacacatatgcatatatatatgtatacacatatgcatatatatgtatacacatatgcatatatatgtatacacatatgcatatatatatatgtatacacatatgcatatatatatatgtatacacatatgcatatatatatatgtatatatgatgtgatattagagatgtgatcccactcactgtgttgcctaggctggtctggaactcctggccctatgtgacccccccctaccttggcctcacgaagtgctaggattacaagtatgagccatcagggccagagaatactttctcttaaatcaatgtttaaacatctttgttgggtttcctaatcgttaagagtaaaacgggttaaagagcacctctggtgctgggctgcatatgaggagtctgagtcgcctcaggtggcagtgaaccttccaccctggtgatgtagggtaggggccttcagacagggcatactgcaggagtgaggaggggccgcaagttgcttctaggtgagtctgaatgaaagatggacttagaaaactggaaagaagtataaaagcaaaaccctgaggttgtgcttggccagatttcgagcacaaataatgtattagcttaattggggagtagatgtagggtagtagagggagataatttaaatagcgaggtagaaattagtaatgactaaacgaattgatgagctttcatgttatcctagaacccaagggagcactgtttgatgtgggcttgttatttggaagtgaggtgtaaaaggagacatgataaacacagtgtggggtagatgggagcccaagagtgtggagggaggaaatctactgtatgttcaggtatagtaggatgaggattaagttgattaattaagttcagaataggaaaagaggagataaaatgttgaaaaaaaaggttgatagaaatttaaaaaacgcatctgtagttcaagtgaagatttaaatttagtttgctagagttttgtacagtaccttctactggtcggtactcacctaggtgttaggatacagatacttagaacaagctttgtttgatgggtatagagtttcagctggcaagatgaaaaagttctagagatctgttacacaacagtgtgaatatacttaacactactgaactgtacacttaaaaatggctaagatggtatattttatgttgtgcattttttttgccacaattaaaacatgaaaatattaacaaaacaaataaaccaccaccacaacaaaaaccaaggcatggctcttgccatcaaagaacattcaataggatggtctagaatgtggtatatgtgagagtgagggaggaggagttgctctggtgtgaaatacagaggagaaggaggctgactctgcaagagaatgtggaacaggtgaaatgattttgctagggagaaaataattaataataatctctggggcttgctaagggccaggcttatttctgtgtttcacacttatggctgattcagttctcaaaacaaatctaaaatttgggtactattattttctctctattgtatttgaggtacacagaaaggagagctgggatttgaacgctggcagcctagctctcaagcctgctttcttaattactatgctaagcatcctcactgatttacttgaacaagcaaacaaaatcatttgacacttaaaagagtcattagcattgccttaggtattttacccagaaacagttattcaattgtataaatacaatgatgacccctggaataggtgaagtccaagagtagcattttggcgcaaacaattctgtgattcctgggatatgacggaaagaaacaacagaaagagtaatcttttctatttttttatttagttacatattgacatttgagagctcattagtttattccagtaatttgattttctctgtacagttcctagttgtcaaatattagcatcaagaaaatccatcactttcagttctcattgacatgtttgcaggccaaagcagcttggagattaagaatccaatttataagacaagtcatctatcattgaatatccaaagataacttgactaagttttatagaaaaagaaatatgataatagcaatgatatcttactactttaggatactttctggagttttttgagtcattaacatatttatatgcattatttcattgctatatgtatttgtggacatttgctgacttagatagtttcaaagttcaatacatagtatcattaacattggtctatttgactttcaaattactctttttatttttttatatttaaaaatgaatcaaaggaggaagcatagccttttcaaccaatgatgctgaattaaatatccacaggcaaaaatataaatgaacagaaccttgacttaaaccttacaaattatgcaaaaattaatctgaaatggatcatacagttaaatgtaaggcataagactatatatatataaatatataaatgtaaatataagtatatatgtatatacatatatatatatagagagagagagagagaggcaagttctcactctgtcactcaggctggagtgcagtggcgtgatcacagcacactgcagccttgacttcccagactcaagtgatccttccacctcagtcttcccagtagcttgtgctacaggcatgtgtcaccaagcccagccaatttttgtactttttgtcgagatggggtttcactctcttgcccagactggtctcaaacttttgagctcaagctatccaactgccttggtctcccaaagtgctggaactacaggtgtgaaccattgggcctgacttaaaactataaaatgtttaaaaaataacgaaggagaaaatcctttgtgtctagaatttggtgaagaataaagcattaaccaaaagacaaaattaataaatttgactttattaaaattaaaactttaattcttttaaagatcttgtttatggaaaaaaaagacaagctacatacagggagaacatacttgcaaaccacatatctgaaaaaagcatatctagaatttataaagatatatcaaaattcaacattaaataaaactaataatctgacatcctttttattttaaaataagtatacacaggaagtatgtctactactagagatactagtagtatctctcttagatcctgtgaatctatacttagtacaaaataaaatattaaaattagttgtcgagctatcttaagtagacattaataatatacataaaaatgaatttggaactgaatcgttctttggaaagcatttgaatgtttgtttttcttaaatattgatgaattcatattttgagtgtccatgatctgttaaaaatcttattcaaattcatgtatttactgttttaaatttatacatttaacttgtgatacattctgtgtacagtttcatgaatttatcttcatatctttgatttttgttacatcgcagttttttagtttaaggatagattttatttcattttcttttttaggggaagggaaagaaaagagaggaatgtttgttcatgggagtttggcaagaatgcccaaaacatgacttaatgagtagagtgcattatggagctggcaagaagtccctactttaaacgaggttaataaagagatgcaatgcgtcttgatcctttgctgctaaaattatgcatggattattgtgaatatttctaagtacctgtttaaattcaccattacaactgaaatgtcactatcggagaaagatcagctgggcgcggtggctcacgcctgtagtctcagcactttgggaggccgaggtgggcgggtcgcttgagcccaggcgttcaagaccagcctgggcagcacggtcaaaccccatctctacaaaaaaatacaatagttagccgggtgtagcggtgctcacctgtagtcccagctagtcgggaagagcccaggaggcggaggttgcagtgagccgagatcgcgccgccgtcgcattccagcctgggtgacagagcgagactcgtctcaaaaaaaaaaaaaaaaaaaaaaaaggagaaagatcaaggagttttggggggtggagggggggacgcaggggccggagtctcgccttgtcgcccaggctggagtgaggtggcgcgatcttggctcactgtagcctccacctcccggattcaagcgattcacctgcctcagcctcatgagtagctgggattacaggcacccgccaccacgcctgggtaatttttgtatttttagtggagacggggtttcaccaggttagccaggctggtttccaactcctgatgtgggctgatgcgcccgcctcggcctcccaaagtgctgggattacaggcgtgagccaccgcgccctgccgagaaagatcaaggatttaagactatgtcccaagaaggaaaagctaaaggaataggaattattgttccaggagcattaaagacatcagtagatcctatcgttcctacccggcacctcaagaactattctcccaaagagagaatacatttattctatttaaccttaagaaagaaaaggatcagtggataaaagtttcagcttttcctcggtgtgccatacggtgattatgctatatgtgttctttcctgggatcttaaggaactgtgggccaaccaaaacaacataacctaataaacctaaataataaataaacctaaaaagttgcataaaatatgttttgatatggctttgccttacgtttttcctcagaggaaaactgaatctccaggataatgaaacaaggtaacaagacagttctgatgccctttcagttgcagaataattctcagcactttcctatacacaaggaattcaataaagtagaaataattttcttaaacttagcattatcactgttttgaaaagtccttgaaaaaatcccgtttgtgcatacgtcttgcacgtcttatttcaaaatccattgagattgtaagcaattaaatcaattgcattttgtagaccaacccctcatttgtaacatgtaattccccaggacccatgtgtccagattcaagagcagcttgatagaaagactgatttatttttattttcttcctgggtctgctttgaatattcttaaaagaaggaggaaaatgctgtgtttaatattcatacaggattttgtattaaaagcagcttctctcaaaagcctgttgttaagaaggactacctataaaggggtcaacttgtgaaatccttcctaagtacttatttggttcttggggattgatggataagctgatggagtctaatcttcaaatgtgtatgtcattaatagagatgtaagaatctcaatgtgctttgtcttttcctttcctgacacattataaggaaaagctttactaatgaagtacccaatggcaataacccattatatgctagaatctctctttgtatcagatgacatgcaaatgaactgttctatttctgtggagaaagagagacaaggagcggtctagttaatcatacttgaggactgcatggttgtcttctgggaaatattatcatgattcattcttatttaagggtcctcaccctatgcataagaaaatctcccattcattccatttgggtttgatgttaattataggggcattaacggaagctttctcataagaaatgaatataggattaaatcagaaaataataaggcaacctttagatgaatcaggtcatgatagagctatacatgtagaagctggcaggttggaggaagtttagagatcctcagtccctttgttgtttagatatggaaactgagtcctggaggagtgaagtgacttaactgaagtcccagctgatgagaggcaggcatgagatgacaaacgaagtagcctctttcatcgggcagcaatgtagagaaagataattctgggagtttaagagaccacgttctgaccattttctactattaactactcctgtgatttggggcaaaccttttaccttctctggatctgttttcttaaatttgaggtgagactagactaagcatttgccctctggaaaaggggaaatctaagcaagctcctataggagattagtgtgtgattattattccagcttagttcattggaaaaaagatatttctaaggtatcatgtatattttgttttcaaaattgaagacaccagccttggatatcaaataaatttagtagcacttttaagctaaccttttccctaagccatgaaaagacttttttcttattccagaaaatattttattttatttttatagcatttctttatgtgtcttatagttggcaagtaattgataatattgctggtaaaatgaggcatttccttaatcttacatgtcttgagaaattagctgttcatgtatccatgtctacacagtcctcgttcaccttgtgaccatgtaattaagtcatttttcttttccaatcagccattcaggtctaaggcaaatggttttttgaaagattatgcacaccttgtaccagtacttctggtccctttaggtttaaagtgtacaagtagagattcctagtatatcaactaaattattttcttcctttaaaagagaaaataatttttttaaaaaagcaaagaagtaatttttttactcatatatttgacttacaccttgtatataaaatgttttgttaggtgaaatgtattttatctatttaccaaaacattttcacccaaatagcataattttacaagtagcagtcatatattaaaccaacatcacatttgtcctctctttgaacccacattatctgaactactgtaaagatctttttcctgtgagtgtttttattttattcatttttttaaaaatgttatttattttgtgttatattatcttcctggttatatgtaacatctttccatcttagatatgttggaaactccagaaaagttttaaaaaattaccaacagaaataaacaccacttcttccattgtgttttaatttcatttctgtcaactgtatgacttgaatagacaatctgtggaatgaatttagttttagtactttaataaaataaaatataaaaatactacacatgtaagtaaagtaatttagagaaatttcagaactagtttttctatttttcaaagaatatttagaaagcttaaataatagcttgcacatgtactcagaaaataggagtcatctaaattgcaaacttgtttaataagttcttccatatatgagcgctatgtcatcttcaaagttttcatataattggcatagtgctaaatattttataacacctctgtaaaataagttaaaatatttttctgccacaaaacattgtttttttagctttctaactcttgtgatatctttgtgaatattagccctttctctactttataaaccaagtaacaaatacaataagcctcacattttacatagtaaaaataagcggaatcatcattactccgtgaactaaccgaacttttatagtccctttaaaaatgttcatctgttgttttgtttgggagtttaaagatagtttattctgcatttaaagatactgtttatttcagtacatagatgcatttgaaactagaaagcaaatttagaatacttttgtatttgtttgtgattatcagtccaagataaaaatggtttatcttatccaactagtctttctttacctataccagagtcctcagttggagtgacctttggagtggctggtgtcttgggtgatgtagttaatgagatctagcgacatcatgaccctgaccccttcgtggccctgactcctctcatccatcttcttaaccccacaaggctgcaagtcagtgtgtagaatcaggattaaacaagtgtgaataaacaagttcaagagttttctgcagggctgccagtgcatggcagtagcaaagtaagacacagagaacttaatacctgaaatgctctttgtgcacctccacgaatcctgttggagaaatcagtaatgtttgtggtcagcgtagtgcgtctaatctcctcagttcgctccattcctggacagtgatggcagttggtctttataatcacatagctgttggcacattcaatgaaagcatggctgatctatcacttacccaatgtcacacattgctaaagcttttatctcattaactgtgattaatgtttgtatggcatgggcttgtcatgtaactgttcatattcagcaattgtgaatcccttagtttacttgatgactgaagggtatttctcgtttcagaagagaactttatcttaggggcccagcagcctttttgcaagccaccattgtcacatggcttgagaactgtgtgatgtagcccttccttggctccttctccattactgtccttcagggtgttacttgccattaaacttggacacttagaaaaaaatacaagaaatgtagtagaacttcaaggaagtatttacctgtaattctttcgtctaaacattgcttttctaatatgatttccaattaagtctgtgttcccaaagtcagatggaaaggggtagagatgatggatgcaggtattttcttgcctttggctacggttcttgtctttttctgtgctatgcttggcaagtctttcgccttagcccagggcagcctttggtaagttgaccagtcagtgattaaacatatttatttagttcagtgggtcagagctattgcgacagatagaaaattactgatggattatcaatttcagcacctctgacatctggcctcagtgtagtccatcatctgaggactcataacacattttcttcaacaataacatgctcagctacctgtgtgatcacacagctgaatatcggaaagattttgttcagatttaataagacaaaagttgcagaaatcagacgagttctgcacctatacttgagaatctaaaagcacccagtggtttacacacaaggctggaataagaactgacttgcactgtaaatatgctttgttgatttttgtgatatttttataacatttttacacttacattttggatttgatgaaatagttacttggaattattttggaaacaatgtgacatataaaaataaaaatattacttgtttcaaaatattctattaaaaaatttaaggcattaaaataatggttttaaatgtttggtctactacagtgataaaattaccaaaataaaaccccaactcaaatacctatgatactaaatcttttaaattataaacaagatgtgaaataagatttgcaaaatttttgtgtttattgttattgctgaatggttcttttaacccaagggagttctagtaataaagaataacaaccttattgcaaatgctaatctaacacagaaatgtattctattcctctgtccattttactatatctcagtataattttcttcatatctgtatttcaaagttctacataaatttaagaataatcttgattcatttttcaaatgattaaggttagcagtttgttttatggtaagtttatgtcttttaaaaactggttatatttgttgagaaattaatagattgtggcagagaatacattgtaacttttattttggctttattctcatttgtaaatctttcatgtgattatccctaaggctttatactccttgcacctaatggcctactttctgatgagcctacatttaatatttatgtgtgctgtcataaaaatatttttgaagctaaaaattattcttaatcttcatatgatgcattttcacacattctcttgaattactaaactgataagaacttagaaatgttacctttgttcacaaaataaggattgagctctttgacattgcagtttacatttattcactaatacaccagtgctatgtgccattaaattgaaaggccctttggaatgtccagctttttacaatgtgatataatgtggcaatattacaggttattgtgggccattatttattgtcaaagacttcctgatttgtcttagaattaagtgaggtttcttctatagttctgtggaaacctttagtagttgactatggcatttaattaacccatctctcctttgatatctcagagctggcttggaaaatgttgggatgaattctagtcacagaatatgctcagtaatttagattgggctgaaaaaactgctgtggatgttcaaaaaagacacaatttaaaaaatgagggagatcagattagaatatgagtttgatttggaaattcatttgagcagttgtagggaagccattgtaacattttttccttaaagattaatccctataacaattagaacactaaacatttattggttttaaattcttaaatgtgatgcctagcacttatgcttcctcagatgttttacacagttattttaaaattggagatgctccctacgtgcactctatttcgcttgatgcccaagtttccttttgattttactctacgccattgacttctctctgaaatgacatgtattataaactatacatgacttgtcaggagcaggtcaacagatatttttatgtaaagcaagcatgcaataacagaaaagttatatacagtcacgcattgcttaacaacagggatatgttttaagaaatgagacattaggcaatttttacattgtgtgaacatcatatcctgaacttacacaaacctagatggcatagtctactacacaccttgactataacgtgtagcctattgcttctagcctataaacctgtacagcatgttagtatactgaatattgcaggaaatttgatatgatttggctctgtgtcgccacccaaatctcatcttgagttgtccacttggggagtaagggacctggtgggaggtgattggatcatgggtgagggttcctgtgtgctgctctgatgaatggtagtgagtgagttctcacgagatctgatcctttaaaagtgtttagcacttcccccttgctctctcttctcctgccaccttgtgaagaaggtgcttgcttctctttgaccttctgccatgattgtaagtttcctgaggcctccccagccatgcagaacagtgagtcaattaaacctcttttctttataaattacccagtctcaggtagttctttatagcagtgtgaaaacagactaatacaaaattgtaatacaattgtaagtatttgtgcacctaaacatgtgtaaacgcagaaaaattacaataaaaatacagtattataaccttacgggactatagtcatatgtgcagcctgttgttgtttgaaacatcattacatggtgtatgactgtatattattttagcataaagattacatggatcaaaccagtagcatgaacacttgttcttccatcaaaattaatcaacttagaagaaaatatttatgaatgtaacttgatatgggtcaaagtttctttaggtaaagaagcacggaagtaaaatctccagatgctttcacatagaaacggatcttatctgttacctcacagggaaactgagaaattaagcaaagtaatgcatatgaaagtacgtcacaaactataaagagctgtaacaatgcaagtattttaatgctgtgtgagttttttggtacagaccaagaaagaaagaaaatacatagctatccatttttagaggctctggactggcagtctaagagttgcggttttatggaattcacatcgacatgtaatgatttttcatgtgagcacattgacattgtccagtttcatatagtaaaatgtaattcagaaagacactgagaaccacagttttaaagtactgccttccttctaatgttcttgtcattcaaatgtccttgaaagcatttgaatcagtaattttgaatgactgttatgatagaatgtttaataaaccctattaagcatgaattattttcttcacttctcttacaatactggattagtgttttgaatcatcaacaaccttgatttctatactgaaattccattttgttagcatcatgatgaccgataatgattacaaatgtgtagagtaacaattattttaacgtgtaatagacattggcatttattccatgtgtccggcatgaacatttgtcctacgggcaaggtagtttggagagatatggcaaagaactaagtcaatgatgttgatatagcaatctaataactttactttgatgacctaaaaagatttaggcattgggagaatctggaaaattatgaagcttctaaaatgtgtcctgaagagattcaaaggaaatcacatttttctcctgctctggattgattcatactataatttacctctcataaaactgatcatatgttaatattaagttaatagttgtaagttgatagtaaaattttaaatgtggagtagctgcacaaaatatggaagaaaagaatttgcttttattctgtgaatttaagattagcctgacgtcgttatgctcattttagcagttgcaaagataaaattcattggcatagctggaattacagtgataggagttggctttgaagaaaaatcaactttgccacctattgccttgtctgtattcaaaatagtatacattttagctaagtttgaatgtggacttaaataaaaaccaaaactaaaagataagaaaaagcaactgagcagctttatactgagcagaacagggaacttaaacaggcattggtattttgaaattgatttacatgtagccagctttgtttaccatactccttacccttagaaacccaaaataatttcttattagtcagtgttatgagcaaattaatggtggaaagaatgcagatgttttattattattattatttttgagacggagtctcactttgtcacccaggctggagtactgtggcgcgatctgggctcactgcaacctccacctcctgggttcaagcgattctcctgcctcagcctcccaagcagctgggattacaggcacctgccaccatgcgaggctaatttttgtatttttagtagagacggggtttcaccatgttggccagtctggtctcaaactcctgacctgaggtgatccacctgcttcggcctcccaaagtgctgtgattaaaggcgtgagccaccgagcccagccaaagtattattatgctgacctgaatacatgctcaggttttgatattcttttaaaattctttcatattctgtcagcataatcattttaactaatatccatttcactatgaattcatgtaagtccttcattggttgaaactgagtggggaatggaatatcctgattttaaaattttctgcttaatgatacctattacatttttaattggcttctactggaatggggaaatacaattggattttgcatccagcaatcttactgacctctcttgggttctctgtgaaataattgttttatctgcaagtaacgaaaatttctcctatttgaataaaagtcttatttacttaaattaaataataaattaattaatattttctgcttaactacttaagccagatttgttttgtttaagccaccatgctctgttgaaatttttcttgtaggtattgttttatattatatattagtgttggaattgcttggatgattaagatctcatcagggtaataattctaagtgtcagttttctctatattatagaattatgaatatactatgttactctacagtgtaaaattcagttttcatccacataaattgagctttaattatgttctggaaattttcatacacatttcatcttcactgcaagccactgatatttagaattttattattattattctttttgaggaaatttaatggcagggtagatttttttaaaaaaattgcccaaagcctaacagctagccagaggggatttttgaatttccatgtgttagttcaatgacctggatattttttccacttcacacaatatctagagtgtttaatgtaaggaagaattcttaggattgatctctttgtgaatataaagtgcaacgagactttctgattatgggagttcaggatcttgatttactgagatgtaactctcttgttctacacagatgaagtagataactatttttaaacactgaaaggtgtgtgtgtgtgtttatgtctaaagagagaggaaggtagtattaaatattaatctgctccccaactctaaaaatgtagactctttgatttgtggtcatgaacatattttcttgtttgatttcaaatttcagtctagtgtcccttgccccttaggctgcagatgtcaatttgtggtcatccatgccgatgtgtaaatgagtaagtgttgccccggcaaagagctgaggttataatttagccgtcgctgcccctttgcttttgtgtggattaaaatagctactatgtaaaatcttcattaattttcatattcggagtatatgtagaaatccacaaagttagctaatttaaaatcagattattattacactcatagtaaacccatagagaatggccacttaaaaggctgaagtcccgtcaaacacctttttttaaagggatgacaacataaaaaatgaaccaatgatgcctcaccttctcagatctgttccacatgtggtgttgtggtaatattgtgagcactgaagtattaaaacagttttgtcttgtgttccctcattctgacaggccaatgacataatgtcgacaagccatctctgatagattcaaaattgaaagtgaatacactgcctctttttcctagttcacactaatggtgtttgagtcaacgtgctaatttcactgcttccaacatacagtcctccctagtaagtctgggaatagcttgtgaggggctttttttttcaggctgcaaagaactgtttgatcaaagtcattactttgttattaaaggagaagaatggagaggaatcagcaataaaagcaaagacaagtttaggatctgaactctgaaaagcagtttgccaataaagatattaactctatatgatttaatatttccacaacaatgttaatcagttgattttcataaacatacatggactgggagtattaacaatagtaaaggaagaaatttagtgttctgtgaattgatttttagttctatgccatattatacagtcctataaaggaagataataagctataaaaggaaccagaccttatcacccaggcaaatttttgttggtttgtttgtgttttttctgcagcagtttccaggaaatcaaaagttttgcttctctggctatataattcaagatgattcatcaaattattgcttttacaaaggtgcaaaaactttgaggagttagaaaataattgaggttgattattggagcactttggaagtattttgttcatttatttatttaatcactgaaatagttactagagctttctgtgaatttagcttgttttggtgtgtattaaggtgtggcccttgccttttgactgcttgcacactaatttgaaaaattagacatacacatatgaaactgtttaacaattctagagagtggacaagaaaatgataaacgtaggtaagggtagaggacagcagctttcatatatatatatgtatctatatagatatatagataatctatatgtatctagatatataatctatatagatacatatctatatagatgcatatgtatctagatagatatataatctatctatatagatacacatatctatatacatagatatataatctatctatatagatacatagatacatatatagatacatatatagatacacatatctatgtagatagatatatagattatctatatagatacacttgtatctatatagatagatatgtagataatctatctatatagatatatatgtatctatatagatatatatatgttcacaatggtgtgtaaaacatacgtgtgtaaaacatttgaaaaactgctttcttgcaataaaatcctactggaaatcccagtgcccagtgtctagatgggttaaaggcagatattttctgctcctttcgttctggatacttcaaagttcaaatgattgaaaattatttttgtaggatcagggaggcttgagccgaatgaaagatatgagttagaggaggtgatgaagcctccttcttcagaagatgtcttttgaatggaacaaaatttgaaaaattggaagagaggaaaatggagcatatcagaaggaaatagcacggtgaaagtagacatttcaagccgggaaagagtagcgtttttggactgtgagaagacccatgtgataggagtagagtttatattactgattcatgaggagcctgggttaggagaagccaagctaacaggagccacaaatgccaggcatagatatttcgaagaccatccaggagtcagtagtatgtatatattcaggaacctttgaaaatggacatgacacaatgtgatataacataagttatataaatgtggagttgtaggagtgggttactgtgcaaaatataatcagggtaggaaaaacttgaggggtctgttgtattcttgcattcacttttggtaataggtatactggcttcagaaatagtagtgcagttaccttaattttagtcataaactaagtatacaacttgtttaggcaaccatttttagttccaattaaaagtaacaaataaagtatccattataatttcttacagtttccaaggtcttaccctctcttcctccctcccttcttccctttaccttttctctcttcttactctctatctttattctccctttctttcttttttccccctttctttcctttttcctcttcctttcctctttctgtatctcttcctaccatataatatcctggacttttactcattataaatacttaactctaatatgatatgattatatcctcatattccagtaacatcagaattccaatgggaagaatctaggcaattttaagatatataatttaaataatggcatgtccctacttttgctcattttccaggtagtttttagatacaagctttctttgctatgaaacctggaactataataaaatttaggccagatattcacacttagtggaaaaaccatattaactataatagttgtggtctgtctgcaccacgccaatcacagtcacatgagtgtctgtggatttctgcttctaagggtgctgtttatataaaccaggtgactatagtgaaggaagagatttgcttttgaagcataaatcactacaaatttcaacctgtccaggacttatatcatctgtaggtgtttgttttgttaattactttgcatttcattcagatgtggtgctattgctttagtattctaagattaactctgctgaatttgggggtcaaggtctctatcatttgtttcactgataggcacacaatattctttcttcttaacgacgaaaagattgatcagtgaaagaagacaaacgctgaccaagctacacatcggtatttatgtccgcgtgcctgatcaaaagtgtgatctgagtgaatctaaacttttcagcatgaggaaatatgaaaaaaagtgtcttagatatagaaaaagtttgcttcaccataattataatgctttttcaatacaggtatttaccagttatttagtatataataaagttgttgtatatatataacttaactgaagtataagttgattaacagccaattttagagtgcaatttttagtaattcatatcataaaataaactatatacaattgtcataaaaatatggctatgtttagttcacttctacttctgaagtactattagttgtttcacttatataattaaaggaaaacatgtttgcagagtctagagcctacaaattcaaaactggttattatcatttattcagctcccagcgattgcacacatttgaccctaaatgacaaagtaaatgaaagccctttttcaaagtaatacaatcagttcaaaaaatattgtgctaataaagttatacattctaattgaaagattgatggcaatccatttagttgttactaggttatttgtgacagacagatgcagagtaacctcattacagtcagaattgtgatgacttgtagctgaggagaggaataaagctttaaaccattgtcacagtccctttccaaaacgtattcaaagatgatttaaaagaaaatatatgaccattaaatagaagttcgaattggttacctaggagtgttattatagaagcaatgaagtaatcatctgtttgatccacaattggcctacttaaaattcacaaatcagatttacagattccaatttgtgtaagagaaaaacagtgccaaatactggattaaaaagattatcccttgtggtttggcatttttagttcatatttttagttgttttcttcttgatcatcaaatatatatcggcttattttagacatttctgcccacaatcaccagttcatgataaattattccacagtattcatttgtacgttgtccaatagtttaaagtcaggctttcagcattagtacccaagggaactctatcaacattctgaagttatgtaattgagaaaaagaaggaatatgggtggatatatatatatatattttttttcctttgaaagatggtgaagtctttgtgggatatatttcatgtatatttgattttgaaacttcttttttttttttttttttttttttgagatggagtcgcactctgtctcccaggctggagtgcagtggtgcaatctcggctcactgcaacctccgcctcccgggttcacgccattctccagcctcagcctcccgagtagctgggactgcaggtgcccgccaccacgcccggctaatttttttgtatttttagtagagacggggtttcaccatgttagccaggatggtctccatctcctgacctcatgatccgcccgccttggcctcccaaagtgctgggattacaggtgtgagccaccacgccaggccgaaacttctttttttcttaatgaaaaacaaggtagaaatgttgacctacaggaagctccacctgctcctcatagtcttcctactgcaatatttgcatgtatttctaaaatttcttatgttcaggagcaccttttttgtttcaaatgtgacagtccggtgctatgcttggcacataaaacccgttttattctgatcacttctcatttgtggtttaatcttgcgcacagttgtccttgcctctctcctgtctcagcatttgagctttctgttactcttgtacatactgaactttttcttgtgctcctcactatcaccaccatgtcttttattatagatatctttcaccatgaatccttttattatagattatttttcaccatgaattctaaaattctcttacattgacaaaagtactctttgcaagaagactatttaccaacttgaaagaaggctaattctatttttttaagtgaatttctcaaaagaagattttcattgtgtgggtaagtcagttaaatatctattgggtatttcttatccgctagtaaacttaaaaaaggtgttctttctaaggtagtgtctttccataaagttgacattttatctttcctaatcaggaaaattaaggcctcattcccttgtaggttgtgttatcagttaaggctaaagttttgacttatccaagcaggtgaattaaagaatatgtaataatagagtcttaaccaacagaacaccagtcagttgagaggttgtgtgttgaggtgaaagaccaaggactgaaatgggaatgaaggaccttccattcaatcctagttatagatcatttaccaaagattacttactagctatgtaaggcctcagacaaattatttagtgtctgagtcacagtttttcgcctataatgttaaccagctttgatggttctaaacttataagggtgtggtgatacttatattttataattaaacgtgatttattcatttatgattcattaagatagaaaatgtttcaaaaattatacttacttctcatttatttaagcaggtgattatgggaggacttctagatgccaggtgcatatccaggtgttaaggctatgtcagcgaataagctagaaaaaggcctcctagagcttatattctcagtgcttacctattcagtgcagaagcttgaaacctatatgaatgtaaacacagtagtcctttcctcattgctttctaggggcgctatcctctcattagtcatttaggagacctcttggttatcagatcaaaaaaacatggtatatactgtacagtataagctttggtactatccctggtttcagatatccaagtgggggttttcgaatgtatccctcatggataagaagggactgctgtacacaaaaataaaactactcaacatttcactattaacaatatgtggatgactaattttttgcacgtttttgtgtgtactgtgttttgcaatatttttttcagattgctggtgtagtccatctattttgctttcttgtatgaattacataaatattttcccatattatgtttttcttcaccatgatatttaatggtggacctttcatcccatgttctgtgctaattttcttaattctttgtcattggatatttaggatgtttctagtttttcagggttgcatatgaatatatgaactatgaagaacataccgtgatacaaatccttgtgctcaaccttggttatttcctttgaataaattcatacagtagaattaccagtcagtgagtatacataaaaatttaaacttccatcaaaaaatatctgaaaattcaggcttactcatttcttttccttggatattttcctttgctaatatgataggtgaaaatattattgcataataattttactttttatttctagtgaggctaaaagctgttgcgtgagtattggcttaatctttctctttttgtgaattgcctatttatgtttaagtgttttctccttttggagtgctctttttagaaacttttacaactgtctttttttctactaattatttctttatttttagtaataattattaattattactaattatgtgtctttatttttcaactttattaatgtttacttgtcaagtaaaacttgtatatatttatggtgtacagtgggatgttttgatatatgtacacattgtgcaatgactaaatcaagctattaggtttatgcaaaagtaattgtggttttggaccatgaattttaaatcattataactaggctcaaacacatctttattaatcaaaataggaactattacaatcaacacatttttgccaatgagaaataagtttgtttattcctgtagcataaaaatctgtgattggggatttgacgaactcttggaaagcattttctgcattctgcaggttgtggaagcgtttttccctgcaaaaagttgtcgagatgcttgaagaagtgatagtcggttggcgagaggacaggtgaatatggcagatgaggcaaaactttgtagcccaattcgttcaacttttgaagtgttggttgtgcaacgtgcggtcgggtgttgttgttgagaagaattgggccctttctgttgaccactgtcaggtgcaggcattgcagtttttggtgcatctcatcgatttgctgagcatacttcccagttgtaatggttttgccgggattcagaaagctgttgtagttcagactggcagcagaccaccaaagagtgaccatgaccctttttttggtgcaactttggctttgagaagtgctttggagcttcttctgggtcccaccactgagcttgttgtcactggttgtcacataaaatccacttttcattgcacgtcaccatcagattgagaaatgacttcttgttgcatagaataagagaagacaacgcttcaaaacaacaatttttttttattattgctcagatcttgaggcaaccactgtgcaagctcttttatctttccaatttgcttcaactgttaaacaaccacagaatggttgacattgagttcttcggcaacttttcatgtagttgtaagagggtcagcttccatgatgactctcaaatggtcattgtcaacttccgatggccggccactgcactcctcatcttcaagcctctcgtctcctttgcaaagcttcttgcctcaccactgcactgtacgttcgttagcagttcctgggccaaatgcatggctgttgttgtgaattgtctctgcttctttacgacacattttgaactcgattaagaaagtcacttgaatttgctttttgtctaacttcatttccataatctaaaataaatatagaataaacagcaagtaataagtaattagcaaaaaaaaataaagtgagaaatgtgcattaaaatgatgtataacataaccacatttatttatgaatgcattccaatactaaacggcaaattttaacaatgcaaaagctgcaattatgtttgcaccaacctgatatttagcacaggcatcacctcacatacgtgtcttgtttaatggtgaaaatatttaagatctgagccattttcaagtacatacattattattaactacagtcaccatgctttatggagtttttattgatacgtacttcaatgcttggtatatatgtaacacattatcctctttccatgcacctctgtgtgtgtgcataaaggtttttcattttctatgtagaaaaacttcaaagtaatcgccatgattttctagtgattgctttaaaatggaaacatatatgattttccatcatttatatatgaattattttgatacactgacagtatggttagcattacgttgtgcaaacttctttcgttaactagttatggaagtgaaatttttttatttctgctgttttttcttattagagtattagaatttcttactgctttttcctttgaaatatatatattattggataagtttgggacactgccagccaaaagtgaaaatggcattaatgggactgagatgtacagatccagcatattctctatgtgggtatcatttctacctttctaattctaatggcttggtggaaccttaggcctacactggatctttggttgaaagatgctcccctccacacatacacacaaacctttccctctgagatatgctgaaggcatctgaattttcttccttagtattcatattttagagcaggcaaccaaaaaggctatgtataggcaggttcttttagccttcagtagcttgctgttttgttgtgttctaatggcattagatgtttctagataagtctgttctctccagatttactcatatctagcatgtttttcatacagattacttggctgtatccaggtggcatgtacgtttaagatagctgcattagtggttaaagaatgctaagcaaaaacaaaccaaccaaccaacaaacaaaaatcaatagtaaaaagagattggagatccttaggagatattaaacctgccagtaacataaggggaaatatgtaaccttcaagaatccataaacatgaaaagtaagttgttggtaagctctaaactcaatgagggaaggaactatgtatttctttacattaaaaaaacctataccacatatgaaagtgtctagcatagttatcaatgctccataaaatgtgttgaatgagtacagcatagtctccattctctttttataatttacttgtgagactagagaatttaggaaatattcttttgtttatcagatttgacaatttaatttttaaaataattaaattaattggaagaaaattactacaactttctggtagagtgtttatatacgtttgtgagtagctgtgttgttttaaaagagtaatattctaaaatagtgtcattaaaatagggaaaatacattattaagttataaagtgaattcatttgaaatcagtcatttaaaatatgtttaaactggattaatttgggtgcatgttttcctttagaataggacctaatatattgccatggctcactcttaaaattatgagaattaaaagaagcttattataatctttacccacaaaatgcatatgatttattatagggttgtgatttttatccaacactcttgtattgaatgatgatgtttaataatattgtaatactgtatgtcagaagatttattgtagttttgatttctctgagccaagagacagagtacttggatgtgttttggtggttgttgactgataagcaataaaatgatcctacatagacctcagtggtaaatgtttttccaactctctctgattaatatgggttttttttggtgtaatatgtcaattttatcagatttaaatttatcattaaactagctggtagtttcagcccctggaaaggctattttgtctgagctatcatattttaagcaatattatttataccacaaggaaggtcctgatgaaaaaaagtcattcttgattaccgtttgatcaaccaaaaatgtctctataacattagatgaaataaatgaactgtatagctgtaggatttgaaactttcaactattgcaaatagatgagtagaagtttccattcactaaagagtcactacatctcttttggccactgatttttttttttttaagtacaagagtctttattctctagagtgtgaaaatgtctacaatactgtgaggcactggaaaaatgaagattactaaagatgaaaaataattcatgtaaaccgtgtgtggtaagtttacaatatttttgagtttaattcaacaaatatgttttgaacatcttctacatgttaggcagtgtgctaggttgaaggtttacagaagtgaatacatcttaagagagagatgagtggagaggagatgtttatggttgctccatatgaaatagccaagcatagaagcatgctgtataaatgctccatgtacagttagctacgaataggagcatctaaataacttttaacttcttgcttcttataatcttcaatacgtctctgtgcttatttatttatatagcaaaatgcatcataggacattgtgtggcaattatggtttataagtacaatgtcaaagttttttgggggtcattgggagcaaaaagctgttagagatttgaaaggcaaacacatattatggaataaaaattttccatttttttgtcaggtaatattttgagagggtagcgatgaggccactggggaggaagagaatttaacatatatgtgattttcaaggtagcaaaagactctggaacccacattgtcccatttctatgaattgcatcatgcctttgttaaaatcactgtgctaacaataagatttcactcagggaaatcaaataacaactctattaagaactttgaaaccatcaaaagaaatcttgacattatatttatcaaatatttgaaatctacgtataaaacaaattatgattaggaaaggaattatgtggatgtaaagaactgtgtattttgcaaaaggcaaagaaacagcaatttagtactctgctctattaaaacacattccgtcctgggattcctttagtttttatatttattcctaatgaaaattcaccctgtaattttgcttggtattttaaaataacattactgagaaaattggacatatttagtagtacatagggataatttctaaaatacaactataagtatttacaaaatatagtaatttttagtgtcctaccatatttgtttgttatatatgttgggagagatgtcattttcttatctattttattcagaaggaaataaatctgatgatgctcatatattttcaaaattccaagcaaaattgttcagaaaaagagttggaaacaactgaagtttattctgttttatttcccaaaattgtatcatagaaacataaaaacaatctaaccaacatggagaaatcccgtctctactaaaaatacaaaattagccaggtgcggtggcacatgcctgtaatcccaactactcgagaggctgaggcaggagaatctcttgaacctgggaggcagaggttgcagtgagccgagatcacaccattgcactccagcctgggcaactagagtgaaactttggctcaaaaaaaaaaggaaaagaaacataaaaacaaggctaggtgatctttatgagaaaatgcttaaaagctatttccacagagtctttttggtctttttctccatgataggtaagcttttaaaaaccgaaagaattaaaaaatataccacacatttgactttttatttttgtagtaccgattttggtcaaagcattcttgaaaaatttaaaaacacatttgcgacttttaacctagtaatctattcttctcagagagcataataagaataccttgctttccaggtatctgggattatggtaccacaaacaggaaggagaaactgaaggataaaggttaacttaggattgggttttttcaagaagtttccagtgttggcacagacacaggctctatctatgcccctttcaattataaaccaacagctctgccgtgaggatatcgtgaatgttcacatctttacctgtcaacacttctgaaaccctttcagcacctatgtctcagtctattcttgatcaaagcatgacctgctcactaaagctttcataagataataatttaataagaaactcccagccagaagacaaaggaaaagattgtgaaggaggccactgctaatttccctccctacataatcaaatcagtacagctatccagccaggactcataacccttaataagtcactctactcgattaagagaaattgattttcctctactgtggatcatagtgattatgataaatatggtatctgccgttcactgcgctccccgggcccaccccccgtttgctgccagtgtccatctgtttgcaggacggcaggtaaacgagctagagagatgacgccgtgtcattaactgcagttggtatcagtgctttgacagctgtggaattgagtgtttccgtagatcagcctagaagcccgtataagaggcttgcgcagcaattacacctcctgacaactctaccagcagccttcaacatgcaaaactcctatgctgcgatttttaattgggaatagggaaagaaaacagataggtgggaatgactgcagtttgaactctagttttaggatatgaagagtgatgtatagaggccaaagagccacatgctaccttcactagattctaacttgatcctaaagttatttggagtctgtggtgggtatgtcttattgtgatctctgtaatcaagtctagatttccagagaaatcaatctctttttaatttaattaatttttttttagaaacagggtttctctctgtcacccaggttggagtgcagtgatgtgatctctgctccctgcagtcttgacctcccaggctcaggtgattcttccacttcagcctcctgaagagctgggattacaggcatgtgccaccatatccggctaatttttttttttttgtatttttagtagagaaggggtttcgctatgttgcccaggctgctgttggcctcctggaatccggcaatcttcttgcgttggcctctcagagtgctgggatttacaagcgtgagccaccacacccagccgcaatatcttaatacaccaatgttgactgtagaatgtttctgccctttcttctcactcacctgaagaatcttgaagcagttggttttattttaatcattttccatcactgtacatcattcaatagtgcttgatattttaacatcagtaaacaaacaaacaaacgaacaaaaaacaggaaagtaatatattctgtcagagcagaattattcaattgcttaaagttttcatataaactttccatgtagcatgttgaatgtttgtttctataattaaaaatacctaagattattgactgggtatctgaaagggattttatacagcacagtacatagagtagcaataataaagatatattttttaccagcttttgcctttgtgagtattttgggtttgggacatggttgtacatatttcctgtttatatattctacacataatgtggtattacagaatgacgaattatagaaagatctggaatattattcttaactaaggaggcagtaagataattaaggagacattgaaagtagacttcagagttcttttcataaaataatagatttatttctcttgattaaggtttttatttggcctaagtctgacttaagatttttataaattagcttcatcattaaataccaatgtactattttttatggtatactaaattgttgctccatttgagaatattctaatagtattagggaaagttagtcttgttaattcatatcttttcctatatatgaataagaaagggcataaaatatgctttttttttttttttttttttttttttaagaaatagggttttgctctgtcacacagactggaatgaagtagtgcagcctcaaactgttgggctcaagtaatcctccaacctcagcgtccccagtagctgggattacaagcatgtgccactacacccaattaattttttttttttttttgagactgagtctcactgtcaccaggctggagtgcagtggcatggtcttggctcactgcaacctccatctccctggttcaagtgattctcctgcctcagcctcctgagtagctgggactacaggtgcatgccaccatgcccagctaatttttgtatttttagtagagatagggtttcactgtgttagccaggatggtctcgatctcctgaccttgtgatccgcccgcctcggccttccaaagtgctgggattacaggcctgagccaccgtgcctggccacacccagttaattttttaaattattttttgtagagacagggtgttattatgctacccaggctggtcttaaactcctaacctcaagcagtcctcccactttggcctcccagagtgctgggattgcgggtgtgagcctctgcatccagcctcttttctaattttaaagatgaactggagagtttcactttattctcacgactcttattgcagagtctactctcctttaaagtaactttagtgttgttacttcttagcttttctcaagaaaataaagccatcacagtggaatttgatgattatttttttttgagacagggttttgctcttgttgcccaggctggcgtgcaatggtgtgatctcggctcactgcaacctgcacctcccaggttcaagggattcccctgcctcagcctcctgaatagctgggattacaggcatgcgccaccacgcccagctaattttgtatttctagtagagacggggtgtctccgtgttggtcaggctggtctcgaactctcaacctcaggtcatccgcctgcctcggcctcccaaagtgctgggattacaggcgtgagccagggcccccggccgtatatataacatcttaagcacatttaatttgtctttaatttgcatttaactttttgtcccttgagaaataacaaacaaaatgatgataaaagttgttaaaactctggctgtatccccactgatttcgagggacatcctcctgttatccaggggagtctaattgtacagtctgttgagcccggacaagtctgtgcttgagagaaactccccagacgactgcctgcctgtaagagacagtgaggaaacgcaaggcaggagacacattttcttcaattttatctgcgtaagcctgaaactttatgcattgaaatacagccagatatattcataatcatctcttagagcttggccatcccagtatcttcagttctgtgaccctgacagggaaggtcattggtgcagcccttccaagcaaatgcagttaaatttaacagaattttttttttcaatatgccagacacagtggtaaacgtgtaatataaagattgctctgacactcgtttgaatctgaacgactaccaggaaccttccttcttattatccaaagcctttctcttgcaattcactctttcttagcttttataataagggttgactacttgaaaatatggttcaattgtccttaccagcactataagcaattttagtttctcactagttttcatttgcttttcattttttgcaatgaaacccatcacagtctattgacctactacaattattaagtctattttatttgtgattatagtttgtgaaaatacaattaattactcatattatcaatgagagtacaatgtagcataatttccaccacacgttgttaatttaccaaactacttaaatctgatttacggatttttttctcgatagtagtttagatgccgtggtactttcaagatgatgagagaatcatgaacagagaagttcctttcaagtgaaaaatgcagctgtcgcagaatctctagtgtatccaggttagaatatttaaaactatgtattcatattagagagacatcatgggatatgataagcagaaaagagagacactaattgtgaatagataaaaggattcacatatgtcttaaaactttcaaataaaatatgcagagtgagtttttaaaacgtttttcctgtttatcccttgtttaatgttccgttttagttctaagtcgatcctacaactaataacagatatgaaaagacttggaatgattgtctctgtgttctttgtgccataatttaaagtggccagaagcaagcaagtggaataaacaggacaattgcagagtttatggaggattaggccaattgcaggcttccacacttagggaggagaaaacatcctcatgaatatgagattggaagtgtctagctgtgagaaaaggaaaaaaaaaatgtctgactctggctctgtgttgcaaagcatgagggtctctgtgctagaccatgacttagcaaccgcgctgtttttaaaagtatttgtgttgtaagaatttattatataattatattctattaaaggtagaataggagcaatctggccagttctaatcactgaatctatagtacaatttgagttgagatgaaacaaaaacagcaatagaggaaaatgttaagagtttttaatgttactgagagttaatctgattatgcttaagactgtggagttggagacaaactgcttccaaattccctgattaaaaaaaattgaaaaattttattttatacaagtaattttctgatgttgaaaaccttgtattatacctccaaaatctgaatgttttaacaaaaggaaaaatctccttccatgtactttattccattaatacactccattcatatttgaaaattattaaattttaaattcaatagtggattgtacttggagcagttcatctaaccagccatttacctagggtgtattaatactaagcagccttgcagccacatctaccaatgtattaagagcctactaataaaaatatgatttactgcctaaagtttctttttgcatccttcatcacttgtctgatttggaagtgtggtatataatgcagatatgaaaccagctcaaagttaacagttcatagctgtaaagatcagtgcatgctcacggcagaacaattttcagagtatgttggtattattaccattttgcactttctaataaaacgttttgttcatgtaggctgtatcttctgcactcaggctttaaaaagacctttcatccccactttctctgaagttggacagcagccgcagtagcagctgcctctttagtcactttgcttcccctcattttgataattatgggcaaaggtcaatcattttcccatcaaggcaaatcctgacaaccccacatgtcagagcctaagttatagatgacatgcttgtcaacaccaaaactcagagagtatatctttacctcctcatgaccagctgaaagtcaaaaccctactgcaaaccagaggcaggaggggatgaaagaagggtggctgtttgccctgactttgtcaactgcagacatagttccaggcagatttttgtaattttaaactctataaatgaacaattacattccactttatacacatgaactgtgagcgtcctgattgaatgcaaatgcttctgttaacaacatgacctcgtagtgccttagacggaaagactttagttttattgtggcgattgttcttaaacctagctgagttttttagattaagatgaaatgttttaaagctgggaggggggacaaataatgatcttttaaaataataactagattctgggtgaactaaaagcctggctaggaccattataggaatacagacactcaattcagttcagtaaacactgaagggataaggagacagacattttatttatatcatgaaattggatattaaatttgcactgctcagattatgtcagatattgatttagattcaattacataatacctcccagtatccctagaatcagcattcaaagaaatatgcattagtgagtatggtggtaactgggtgctaaaagcctaggccaagcaaatcacagaactacctgcaatggaaagtttgtgctccaagggtcctagggtatttgaatttctgaccatctatcaacatgttacctacatgtaccttcaatactcccaacactttgtcctcccagaatatgatatgaggttaaaatttagcccagggtcccaatttaatatctactgatggcgtccctttctttatataatcaaacatttttgtaaaattatttgggtaattttattacaaatactttttaggggctttctgtttcaaagaaacctataataactcttctttttcttcttgttagaacaataataaatcctcctatacagtaaatcattacctcctcacttctcacttgtttaaatcaaaatttttatttactgcattctatgagtgtcagatagtgagttacttacaagtatgctgtgataaattggtaataggacattcattgtcaggatgaaagaaaacattactttccaagaaagttatgacccaatgtgataatttaggattacaaagaaagtgtatgaagtatttcctgaaatgaacaatgtaatttgatcttatagcaagtaatatttatcccagattcttgagaattaaagtctgcatagaaatgtaatgcgttgtgagtctatgattctgtgttgtagctgagcagtacttactctttcctttatatgctaagatgggatgtacatataaagccccccccccttgtaataggcttataacagatgtactcttttataaacagccattatccttggacgtatatctgttcaggcagaatgacctactattggtcccactcttgaagaccattgctttgcttgtcttctgctctggtccattgccttgttgcctacattccagttgttcaccttccatgatgcccgtaagaagagagtcaaaggctgacaaatgcacaggtgttttctcacttttcttacatcctaccccctctcagttattcattatggtaatggcactttgtgatgtgcaatttctggatttatgacccattcttgataagcatgaatctggactgcctgtgcatctttgataaggttctagttggatagcagtgacctttctggatgtaattctgggaggaagattaaaaagcagtccagaaagtgacaggtttgggacaataacgtatgaatttggctctgctggcaggcaagagatgtaagccgtgataaattagaggcaaaccaaacaagcttactgaatgatttttcatttctgctacatccttgggtaaaagtctattgtatgaattgcactaatactgccatattcctctagccgtgtgttagactacttgtttactaattgcataaactggcaaattattccgttaatgtagttttacagtaaccaaaggctgcatactcaattaaaaatatgggcaccattttgcgtacttgtgctgtcttatacgttgaacagtcagtgagcatttggaagagagtcatccaaactcataaaaacctctctctctgtttctctctctctctctttccttccaccccctttctcatatttgtatgaaaagctattagaaatttccatatatatacccaaatcctgaggacatcttttccaagtttagagagttaaagatggattataaagagaatccatttatcaaggtaacttgttaatacactgtccttaatattcttctgtatttgataaagtcttaaactcttaatatatgttccatgttgaatatatagcagaaatacacttgtatagataattatgtttattacgtatttaaaggataagaacacgtacactgacgtgcaagcacatataccccttcagagaaagacagacaaagatttgttttcctccaaagtgatacttctgaggagtgctaatatataataacctaatcttaaggacatgactataataaaggctaaaaagcagttttgtcaggtggctttgtaaatctgtcttctttgctattggagcctgttgcttatacacacatggaatacaaaataaattgtccacgtagcaggcaaatcaatacgcggtggtccctaccaggattaatcatgggaggagttccatcaccactcacacatggctgcattcagggtgcacagggcctattacttctgcatctgtctttaaagggagccctctagagcttgctacaaggggaggagaaggcagctacctcttctgagggcctgaggtaggtcagacaccaggctaggcatgtgcacatacagagttctgttccagtctcaatgcaatgcagcgacctgtcgctagtagccctgtttttacaagtgaaaagagaagtgtgtttccctgccccttcctcagcagaaagtctggcactcagcagtcactctgtcaacggaaaacaaaatgaataaggccgggagaaatgaagtaactcacctaagattgtactaattgaaagcccagcaaatccagatttgaataggactctgtgtgtcttaataccagcaagcaaaccaataaacaaaaagcaaactgccagctgcagtaccttatgacagctttgcaatttacctaccagacaccattttcttaaacagcagcttttttttttttttttttttttttttttttagatggagtctggctctgttgcccaggctggagtgcagtggtacaatcttgacaatcttggctcgctgcaacctctgcctcccaggttcaagcaattctcctgcctcagcctcccgagtagctgggactgcaggcatgcaccaccacacccggctaattttttctatttttagtagacattgggtttcaccgtgttggccaggttgttcttgaactcttgatctcaagtgatccatccacctcagcctcccaaagtactgggattacaggtgtcagccactgcgtccggccccacagcttttttgaaatataattcatgtaccatacaactcatccatttaaagtgtcagacatcactttaatatttatattttatacttactataaactcagtatatataaaatcatagtgcctcttcttttagctgtgtttaatacttatggactgaagacctgttcatttttaacctaagtagagaaaatatagagtcgagagtatttttctcgcttgaaatcagtagtgcctatttttgctaaattttttgattcctaattattgctattcttcctgcatttctctgacatccatcatttcttgcccatttttttttcatattttttagtattctggtgccttcatatttttaccatactggtgtgtcaggcattgggactattcttagaagttgttttgctactctattccactctgtaaacttacggaccattgaattgtcctaaaacatttactttctccatgacacgtgctattcttaaaataagttatgtcaggttaaattaaaaagaaaggccttcaatgactgtcagtgtcctgcatgatccgatcttaccttatttagacaacctttccttttgtaattcctatcagaaaatgccttttctgcacagaccagccacttaatgtctcacttacagtaatgtttatttctaactttgtggcttatctgacttgtttaaccagtttactctcccttttatttccctaattaatatgacccaggatgagaattaaatagtatttcctttatcaaggcttactctcccacacattctcctaatacctttacctaccttgcaatcctgctgggcttgcaatttgtcccccatatttaactcttggcagacagcggtcccatatttttttcctcatgagtatttcctatgtggacatctcgactctctaacaattttaaatttcttgagaatctgttccgtgcctgatttctccctcagcagctttctaccctctttgcagtatgttcttcttaaaataatacattttgatttgtctcaactatatataaaacgcacatgcataggcatatgtacatagttttgtttgaaaagaaaaaagatttacaatttatttaaactttgtaaacttcaaataaaatattggatcaactacattaactcacattggaaaggactctactgatgaaaaatatgacaaatatatggcactggggttttaatgtaaagttagtcactaatttttagaaagtaagctgactgggagaaggaggtgtagataagtagattttcatcaattccaagatacatgcttttgtgataaacttaaatataatttagttttctatcaggcctcaaataccagatagttgtgggccttgtgaaataattttttattaatgccttgccaagtggaacatgatgataaaaatggatagtagctacttctctcatcatttttttgtcttattttaatctctctaaaggtaaaaacatatattatgataggaagtagtcagttgccctggcacatttatttttttgtcattttctcttaagtgttagtattatatacaatgaaggtacttagattcaaattgaaatgaataaagttaattggctttatacctggtttacagttcagagtctctatgatagatacctggagagtgactagtatagtttagctgggtgtgcatgggctgaatggataatatgaagattacatttttatgggagtccaacaaaggagttctaagtaaaagtgatctgtgagccttaaaaaagtattaaaattaaataaaatgaatattgattcctgagaaacatgtttgaagtttgaaccttctggctctaacaattatggttaacaaaaaaatgtgtatttatattttcaaggatattattgtgatttcttgtagctaacgttctgaaggaaccgctgtattttaagtcatgtcttttggcttgacttttttatatggcatgaagttctaaatagctttatacaattaacagaggcattatttttaaatgttaactaggctaggttaatattgtttaggcttttacgtgttttaaaatactcccacatactctaaaaattaagcaaactatagaactatgatggatctagtaagggagcacttttcttggtttatcatcattttttttgcctccatcacacatcgactgaatgagataatcgatggaaagacttgaaataagtgtggcataaacacatcagtttatgtgtttctagaaaagatcttttctgtcacagcaaatgccatggtaaaattcttattttttaattaatattccctcatgttaacaatctaacagcatgcttattcatttgttcttcagtccagtgtggcattattgctgtttgttggttgaacattggctgtggtctgagacgcctggtatcttgagtttctgaggtgatgctgtcatgctcttcacctgcctgaggtggtgattagaaagcacagttacagccactgctcaagtcatctgaaaatttccttcctgctaaatgttacagggtagaggccattagttcttctacaagctacaaactcccagcctgctgccatgtcatgaagccagagaaatcaaaaagccacctactgaccctgcctattgtctgggcttgtcgtcttctgtcagtagtgtgccacaatcagcgagatacacatgtacctcctgcctgctcagggtttggccgccccctgctcccagcacctgtttgcttatacatgagctttgcatgtttgaatttaaatagacacaggagggtggagagagggaggaagggcgatgcctctgtcagccgtgggtcattactacagaggagacaaacccagcgagcagggaaactgggaagcctggtaacgtggtagtgggtgatgaaagatgagtattctccatggaaatcatttttttccccttttaaagttgaatggggtgggtgattattaagacaagattaataatcattttgattatcatatctatcaatagatgatttcttcaattacatagagaattataaatcagatgatgaattgtgacctgggtcttttccaaagttacctttccttgatctcttccaatgatgtcattgcaaaaaattgtctaatttatcaaaaaaacaacatgaaattcaggtatgcgtacaggtgtaaaaaggccaagatttggccaggcatggtggctcacgcttgtaatcccagcactttgggaggccgaggagggcagatcactgagatgaggagttcaagaccagcctggccaaaatggtgaagccccatctctactaaaagcataaaaaattagccgggtgtggtggcacgcgcctgcagtcccagctactcagagattgaggcacaagaatcacttgaacccaggaggcggaggttgcggtgagccaaaattacgccactgcactccaacctgggtgacagagcgagactctgtctcaaaaaacaaaaaacaaaacaaaacaagaaaaatggccaagatttagtaaatatgtacactggggactcatatctgggatatatgcaatatgcacctgtttatggtagaaatttttttacctaagaagaaacaatactatcatctttctatttcaacttgtttactaaattataattttcttaggtttagcaaatgctcatttagtaattgtgtcatcctgcatctgggcttctaggctttgaattagaaaatctgagactgcttgctgcctttggtatttattagttccatgaccttcggtgagttctttaatctgcctgaagctcagtatcttcatccacaaaaagggagcactggtgcccacttgagggggccctaaagggtggaaatttaatgacatgataattgtgagtgctcttttcaaactgtaatgtgttatataaacatcagatattgttactattaagactgatgtcatataagattaaccatggtctccaaaagatacaatactcatagtttcattactaaataaacttttaaagtaaaaccaaaatactttcaaaaataaattgtattaattattaccaccataatactgaaagttttatggaaatatttcctctctaaagcacaccgttgtatgttagaatgttttcctggtgtactcttttactatgtgtaatttaaaaagtaattctagactatcaagatagaattttattataatattactgcttaatatgacactttcttctaattttattgtgccaagaatttgtgcaaaagttacacaggcagatagttaccttcttttttcctttgggttttcaatacgtactctaacaaaggaaagatgaaagaaatcagggagaagatctggcatttagaaacacacactccctcccacacacacatccactccgaaaagttataaaggatctgttgaatttgggggataccttgaagaacttcaagctgtcaccatttcactaccccatgcggtttgagcaaatgagcagccttgaactttgcacacagagacgcgaggcctgggcagaaggcagtgcatctgcaggtccttgcatgactaatttcctgtcagcaagtgattttattatcatttaaataagaatggataataatagctgtaaacttggcagatggctgaattggtaaattttaaaggaggtaggtttgaaatacttctgtgcttcctccttcaatgccttcacccactccttaagccccgtggcaatcaactattttggttaccacttttgatttaaccactgtgttcattcctatcgattaaaggggctttaatagcacaatattgtgatggctgtttaagcagaggacatactgtgtttcattgcttcttatttacactgggcaagggggaagcccagttattggtaggtacttccctcttctaatcatttctgcatgaaactttttttctttctctcttcactcaacgcttaagaggaaaggaaaactacttgaacttcttagttcgtatttctcatataaagttaaaacaatgtataaaaagaactattgtgtattcagttctcatgttcccattccttaatcaacacaggcttatcaatacagcaataaatgaggacagtctgaagcacaggagagatcactaatattgcagccaattttctttcctaaaaagtacaggcgcaaaaataattcatatcagatgaggtcttacaaatattaaacaccattatgtcaagcaaataccgctaaatatgaaacaaaatattgactctattacataatatagttatggttaacaaaataaatctaatagggaattttaaactaccaatttagcttaattaaaaggtacaatttcctcaatcctgattaaataacagtaaaagcatagattgaatccactccctctgagatttttaaaagaatgtttgagaaagcttgatgttggagttataattacacaacagtaatctgcttattcctttgacttaaggtattaagatcgctactaaccaaagttcattaattgaaagcttggagacaaagtaaatttttttttttttttttttttgagacagtctcgcactgtcacccaggctggagtgcggtggcatgatctcagctcactgcaacctctgccccctgggttcaagcgattctcctgcctagcctcctgagtagctgggacaacaggtgcacgccaccacgcctggctaattttttgtattttttagtagagacggggtttcaccatgttggccaggctggtcttaaactcctgacctcgtgatttgcttgcctcgggctcctaaagtgctgggattacaggcatgagccactgcacccggcccaaagtaaattttaatggtatctcgcaaacatatgtgtgaagatagtagtatttaatgtatactagccatgttagcttggggaattagtatttatgcatgcccttactaagctttcttagcaggtgtcttcatgcttagaaaagtcaacttgcaacccgtgtgtaagacaaaacatttgtcacgagttcagtacttgtcaagtgggatgtacattctcagaggtcaatagtggcttataggagatttagatgtgtctgttggcattaatcagctacacacatcactctcatccaactcacagcttgaacttccttacctaccaatatctgtgttggctgcctgaaaagcaaactgttgagcaacagatttaagaatagatgattgacttggttccattcaatcttgtcccagatgtgatctctattaaatattttggtgattaggccttattcctattttgctttttttttttctgcttttgtgattccattgtccattagtgttgtggttctcatttcctttctctctaaattctgcatatttatttgttaatgtactgtatttagtgtactgtttaggcgggattacaaataacttgtgaaataacaggaaaattgatgaaaaaagaaagagcaaaagacaatgcttcctcaggaaaatgtcacattggatgattattttatttgttcctgattttttccttttctgcagatacatgattatataattgtttcagttatatgaaacaaaaattagatgtggaggaaaactctaaatagggaactctaatgttcttttaaaatgaagaatttaacgaaaacactcaaaactcccctgctgggctcaagcaggttgaaattaattcaagacggcagataaaatttttaaccaggccgagtggagatgacggatgtgacagctctcagttaaaatgtcttttagtggcgaatgcatgcatattagtcaagggatgtgacatagctgtcccgggtgagagaaaatgaaccaatgaccatttgcattgagaacaaaagaaaaattctttatagcaaaacgtaaagaaagacaagtaacttgaggtttcatatttatttgttcgtgtttgacaatatttttggtaatctttttactgcaagaaaacctctgaaagttagcacaaacatatgtttttaagcagtgattcttttctttctcctccatatatcagaaaataaatgttgagtaaaatgtctgtgcccaggaaagtcaggtaaactatttttttttcccttgcaaagaacaacagaaaagtatctgtagatggtcatacttcaaaagttgtagaaaaaaagccttaccaactgaaaactcagtttcaaatttgcctacatgaataaaatattggaatgagaagcctttttttttttattataagaacactggctccctacttttcttctttctaataataagacaatttggttgtgtattataaagcaaagcaaataaaacaaaaatggatgtgattctatgacagaatgttatagggaaggaaaattatttggaaactacaattggcaggatttgaccatgtgaaagtcaagtttaattaactttaggaacagatgctttcaagacatagcagttaccagttagagctacaagtataattgagttttatagtatagggtttatttttccaattaaaatcaaattgcattatcataattttgttattagaagatgtaacactctggcttaaaaggggtactcaaatgtagacctagatcttgtcctcttttgatcaaaagaaaagaatggacaaagatgtattttagtctcaacattaaatacaatttccactttagaaggtagttgttacttcctttaataatgtatcctccccaaaatggtatatgagaacataaaaatttattacaacattagagccaaaaatagaatacaaatatttgtatacaaatattcagtgatgctaactggattcagaaaatgctaccgaattaaaattataatttatctgggtcttcagtgataaataggaatcccttacttaagggagatgaagtttatttaaggcgaggtaaatggagaagtaagtttttctcctgtatttttggccttttcttgtctctcttttctggaattatcaagctttctctcattcagatgaatgctttgtgaatcttctctttttgaatctgcagtgtaattctatgtggacagacagctttctgttaacatacactattttgacagactacaacttgatttgctgttcaggctttgactatattcacattatggcttaagtattttctttcatagtcatttaccaagtgcccaacacatttttaaatcagagaaaaatacattttatttactttccatgccgagctcagcaagaaatggtattttctcctatgtcttgcattaaaaattgcatttgcaaatggcatatttagatgatgttgaagaaattaagcaatatcagttgtaccttttcatagtgtaaacatgtaaaatttctttaaataggaaaatactattggttttcttggaatcgctcccatttaaattctatcctttagatttttttcagtccaatgcctttgcaaatttctagtacacactttctactactgtaactttagtacatcctcagttttactacattacttgaaaacatgcatttttaacaatctcctgctcttttgcttttgattttctgggcatattcctgttactcaatgtattcattcagcagagtacatttatgctacaactatggactacctgttcacagctgtagattattcagaatcttcttgatactgataatatcttcttatttacagtttgctggtatactgagaaaatgcagtagaataacggaagtacaatgtaagccatataaatcatttaaaatttactaggttccatagtaaagaggaaaacaaaacagctaaaattaatttaatactatatttagcctaatatcccaaattttatatcaataggcaatcagtaaaacatattaatgaaatatgttcattcttttttattatactgaatctttgaaacccagtgcatacttaatacttgcagcacatttaattctaactagccagattttggtgatcaacagccaccgctgactgtggccaccatactggatagtgccactctaagaccttgatactcaaagtgccccatgaacagagagcatccacatcacctgtgagtatgttcgttgtatcaaatctcaggccttatgccaggcctactggatccaaatcttcctttcaacaagatcccgaagttactggatgcacattaaagaaagaaaatcactgcatttctggtttcccaaatgtatagaacattggtgttaatattactgcctatgacatagattcttttccaaacagctttattgagataaaattcatattccttataactcacccttttaacatgcaaagctcaatttttttagtgtattcacaattgtgcaactatttcagttatctaacttgataatatttttcttaccccagaagaaacacttctacccatgagcaatcactcagcacttccttctttgcccagtgactgacaaccactgatctactctatctatggaattgccaattctggacattttatataaatggaattatttaaggtgtggtctttcagtctgtctcgtttcacttagtataagtacattgatctgtagtctttatttcttttgatgcctttgtctagttttattaaaggagtttaaaaatgcttcttcttccagtttttggaagagtttgtgaagaatttgtgttaaatctcctttaaacgtttggtagacttttccagtggtgctgcctgggccagagattttcttgcaggacgttgttttggttatgaattcaatatcgttactggttatatgtctattcagatttttttattttttcttgtttcatatttgatggattgtatctttcttagaatatgttccatgaatgaaatatggtcattaagtgaattgaaaaaggcaaacacttttcctttaccattttcccatgtattttgcagtcaagatcattctttgtaattaccattgtgacagtactacaaccaaaatgagcctttagaagtgtgtaatttctgaaattaaatttatctttatgaattttcgaccaatgctgaatagagaaagatattttattttgccacagttgacttcctagttcctgatcacatgcaataatgagaggaagccagactggaaaaagatgtctccttactaaaataatggaagaagtagcccccattccttccttcgaaataacaacaacaattctaccaacacgcaaaaggtcagagccacattttcatggtataaatgacatctaggttaaatccttatattctgtcttggatgaaacttgatatgattcaatccaaccctccatctaataatgattctttgacatttctattttataatcgggttatagccctttaattttcttgaatgtttactataacaagacaatcacctctcataaaccaatctactctattattagataagtctaaaatttaggagaatctttcttattttaagtagaaaactgtctcctttctatacacatttagttctggctctgccaatatgagcaggatggaacaagcttacttcatctgctacttcacagcccttcagatatcagaaaaagcagtttcttcttaatagactgctaacagaattataatgggatcaaactgaaaaaaaaacttgtgagaacataatctacactaataataatcccctaatgcacttccacttgaaaaaatacacatagtttaatgtatcttctatcaatttctaaacatgggtttttctttcttagtacgaaactgttaaaaagcaatcaataataaataggtacagaggaaaaaaacaggcagtgaggtatgtttagctaaatatgtcctcaaagtgttgattttaaaatggcttgtttttagacgctggtgaggctgtgaagaaaagggaacatttatacatccttggtggggatgtaaattagttcaccactatggaaagtagtttggtggttttggaggtttttcaaatagcttaaaacagaatgaccattcaaaccaacaatcccatttctgggtatatatccaaaagaaaacaaatcgtccaaccaaaaggcgcatgcactggcaagttcatcacaacagtattcacaatagcaaagacatggaatcaaccaaggtgaccatcggcggtggactgtataaagaaaatgtggtgcatgtatgccatgaaatcctatgagccataaataaagaaaatcatatcttctgcagcaacatggatgcagctagaggcttatcttaagtggatcatggcaggaacagaaaaccaaatactccatgttctggtttataagtgagagctaaacactgggtactcaggtacataaagatggcgacaactgaaactggggacttatagatgggggagagaaagagtcagggaagggttgaaaagctacctattgggtactagactcagtacctgagtgatgggattatttgtactccaaacctaagcattacacagtgtactcagttaacaaacctgcacgtatactccctgaaactaaaagttcaaaaataaatattcatttttaaatttgggaaaataaataaataaataaataaataaataaaatggattgtttttgaggcaatgaaattactggacgtatggtcagtgctcagtaaactttagatgactgtggtatataggaaggcaggataatggtcctcaatgatgtctgagtcctaatccctgaatatatctgtgcatatatcagattcatagcaagggggaattaaattagcagatggaattaaagttgctcatcatctgactttaacatagggagattatcttgaatcatccaagtgggctcagtgaaatcagagagtccctaaaattgaaagagtggagggggataagggatcagagtcatctgatatgagaaggacttcacttgctctagctggtttcaaagatagaagaaagtgcctgccaaccaggaaataaaagtaacctttagaacctggaaaaggcgagggaacagatagtcccacagaacctccagaaaccccgtaaacaacatgatcttagcccagtaagactcatgcagacttctacaggtttctatgataaatgtgttgtttaagctggtaaattgtagcaatttgttacaacagcaacagaaaacgaatacacatgatagttatttaacagaaaactaacacagctactctgttctggattcaggtctaattactaaaacagttcttttgaaagtcaccagttatctccatgttattaaactctgcacattttcagtcttcgtttgacccctcaaaagcacttcatgtcgttaactattccccctttcctctttaaagtacttgttatctttgccttccatggtctttcacttccttgctttctttttaccttcttgacctctttcgtggtcccttttacagctcagtccacctcagttaaacattttagagccttctcctcttcttgctcaggagctctcatctgtggtcattgcttttattgccactctttctagagagcatgcaaattttcatcttcctctgggcctctcttctgagttgtacccacataacccattgcctacctgaattgttttttctttgtcttaaaatttcttcatctcaacatcatccaaaccgaacttataactttcctgtccactgggcaccattctccttctcctttcaaatccaaggcaccttcagtattgctataaattttgtgtctttctgtactggttgagaagggttgagattgggtagaaaatgcatggcaaatgttgtcaggtttgattttactttagatcgtgttaaacaatgtaagattgtttatttatgcatatgaatcattttgtatttttcataattaaattgatgtcaatcccaattttattgaatcccaagtatcagctggctcagcagtcactaagaactgttgtgaatgtgctattgtacctatgacactggaaaaccattatgagttaaaccaattgtcatacatattagttatttgaaattcagtgggaggaacattttcctgtgtattgcaagttgctgtgagaaatgatcagttttctttcaaggatttcagttgtgtatgtgaaataaattcttaacatttttaagctcctgtaatattgcaggcattttactttagtaaaatagtaaataaaatatacttcatttaattttaacaaatttctgctggtgattagtactttttaatatatttattagaatattaattagaatatataaaaatatttattagaatatataaaaatattcattagaatattcattagaatgtataaaaaatagaattaagctagttaattattaaaaaggcaagaatttgaatagagttcttctgtttctaatgcttatattatttttatctatatcggttgttcccaaagtttggtccccacaacagcaacatcaatatcactcgggaacttggtagaaatacaaattcttggacaaccaccccaaatgtacttaatcagaaactctgggatggagcccagtaattggtattgaccaaacaggtgatgtcaatgatgagtctgcacattaaataggccctacagatgagtttgatacacactaaatgtagaaaaccatattgttataccactgattatatgtctatagaggtgatgcgcccctatctttcttattattctcctttgactcactgatttttgctgctaaagcagaaccaggaaataattcaatgttttattccaacttactaagagatcccatacttaacaatgagtattcctaagtatattaaggttagcatataattgaaaggttaaaatatctaaaattcaattgaatgttttcactgtaaactatattcagcttcattgtcttctgctgaaagtcttattttacttcattatggcagcttaatgattctccaattcccatgttgaatttccaaggaaagaaacttataaaaagtttatgctcggggaattcttttgctttctgtgtgggagtggagcagttctttacacatcttccttacctccattgaaaaagacaaggtaactgaaggctgttggagtccatggggtgaggacttgttagcaattagtaatatgtgaagaaactgtctgttccctattttttggtatgctgaccataaattgatttgagtattcttgctttactttattgtaggttgaagggagctattgcttatgaggaaattcattgtgttctaaagccaattctaaatcagagtttgagacactgtttctatattagagattatctatattttattctggagggcaaaaattgccacttagatattacatgtcagtgcatatatatttctaaatttctcaggggagttgtgggagataaacaataatagtacacagtgaaagtccttgaatacggccctgattgtcccttcttttagcctagatgttcatatttcagttgtttgatttaatgaatagaaagggaaacataataattacaactcaaaattctcatatgaaatgaatctaatctcattcaagttgtctagtccctaaacacagtcagtaaaaggatactttagagctgttctcttgcaggctgagccgaggagtgaaaatggttaactgaaaactttgaaggatatttaagttgaccatgtgcagtgcatgtattggacaccagccaggacccagtaaaccccctgtgccaacattgggtagaactcattgataaccaaaagcagttagtagaacctgtctcagtgagtacgttggtcaatacaggcttcatgggaatggcccctgttattaatgtttgaagactatgacttgcccttacatggctgtgatttagagaactacccactgaagtcactgatgtagttcagtgtgtgaaaaacagacggcaaaccatatgaggtaagttaatacatgtaactggggatactgcaggaaggagacagttgaattctttggagaaaaagtggtttacaaattgaatacattaaaaatgaatattattactggtttactcatcacataaagaatagggccaggggataaatacctctctagctcttgcaactcaagagatgtttttcatatcttagataataaatacttgcagtaggtttagctcataactaaaagtatgtgctaagagactcccctagaagagtttgtcttccgacatgctgaattgccctggggttggtggcagcttaataaaatatgtgagtgttcagtgcggagctgttaagttatttattccacttctgatactgcatgcatgaactgccactgtttgatgaatcactgaagagaatgggaactgacaaacaactcttcctttagcggctgatcacactgacagcatcaatagaaaaacacatcatgggttctaaaatgccacattttcaccgtttaccctgaataagacatgaagctctttaaggaaagcagtagtacgttatcattaagggccagctgacagagaggcaagtgtgctttgaactctctcaagtcatcattcttaatttcttctcttcttagatggaaggcccacccacatgggttctgagcaaggcagggactgttgcaccttttaaaatctcattgatagattggtttcatcaacacccatcctgactcctgcccatcgggagaagctcctattctcattagggtcctgtaatgtctgcagctaacattgttctcatgcaaatagaatgacacagaagatcagtgccatgaaaattcaatttcccccaaccatcattaccctttttcttttagttattcccactccaatctgcaggaggtaatgtgtgcaatctgctggtactgtgcaagatgattactacattttagtgatgaatttcccagctattgcactagggggtgttttagcaggttccctgatacacctaatgtagatgtggcagtagtccttgcagtccttacccagctcttccatagtggatttccacaaggagtggatgcctggtcagtagaacttgtattcaatactgttcattctttagtcatcagtggcacttgtgaaagtagtgatttgtttaatgttgtctgaaaaataaaaataaaatatatctctacctgtccaaattgaaggattaaaagctctgtcaaaagaaatgtagtaatttttgtctttagtctatgatcaaacttgggtaatttaataaggatgtaaaattcagggtagctcatataaacatattgaaattataaaagtgtgtaagttaaataaaaatcctgttttagaaagaactatggagaagtcctacttgtgtgcagctgaaaagtaaggtaattaccaaagtatatttcaaattcctatacttaatattatcctttatctttgaagtttcttcagcaatgggattaaatatgtaaacattatattgtcagtggtttattacgttttagaagttctttgtttcttctgaaattatccccttgcctcttcattagtctggaagttagctgtaagaaaaaataaagggagagagaatgaagaaaaaatatatagattcaccaggcattacagatttgtatgtatgcccctgttcaccacaaacacaaaacatgattatagtttctctggcgattattagcctaataataattgtaaagggcaactatacaaaacacgattttcaatgtaatttttataaaacttatttatttcacaaataaatagatataatctttcccagtgaataaaatactttacatatggtagcattttacgtacaaaggtgactaaaagaattcagagttttaaacatttatttgaaagaaagaatgataattattttataaagtttttttggaaaatacttttttcttacacatggtgatgatgtatttgtagataaattgtatttatgcaattccattcacatgattttgagatattttcattggattgattactggctgaattagacatttttaaattactgaaatgtaccctcttaataatatatccttataattatgtcagagaggctgatataatgaaaaaaggagtcaagttatttctttacctgaattattctgttctataaactgatatatgtaatacatttcagtaactgtggcgaaaccatttagactgtctatgggacacaccatgcagtttagatgtgagcagttgcctacatgtggtacagaaagtcatatttgaactacagttttagtaccgctactttaagatagattctgagcatgtaattactgcagtcttggcatgtaattaccccggagttacagtttatattgacctccagaaataatgagactgtaattttaaagtaaaacatagaacttgagtgtaaaattgtatgttgattttgaactgcttgcattgtgagtttgttctcctgaagaataacttattactatgataattatcccagtttcctatggattcagaatatgtagagtgttattaaagcatcctttatgactgagtggttaactggttccacagataggtaaaagaaggagtactccagtggtttgaaagaagctgctgattacaaaagctccctccctgtaagcttcatggcctgcacttctcagaaagatagactcaatggagcatgactgcctagggcatctgggtcccaggaggttttagttgtttgtttaggtgttgagaaaaacacattatgaccgtaataataattatgtgtttggaattggatttttgcatctgtaacacaaagttccatcttgcataaaatgcaacctcagcaccattttatgcttaatttgcatatgaagcaatatgggactattcaaatataggcttcatttgactacgtaccaccagtgttaatttagtatagtattaaatgtctctgatgaccactcttcaagcaatgtttggactctttattaaggacaaatgtgtgtacacactcttagatgatattaaaactaaggttaaaagattttaaattattttcagtagtgtgtcacttttaaatacttttgcataacctgaagagagtaaagtagttgaacattatttagatagtgatttcatagcaattggttttttattttctgaaatatagcccagagatattttattttttgcttattataagaaatcacatttcaaaatacacaattcagtttgaaaatcagtaagttagctttatttattcccaggtgttttctgaaaatacgttttttttttcttagcctttcttaaggcaagaagcagtcattcaatttcccttattcttttctctctccttcatctttctcctttcttacccctttttctgttgtcatggttttttactaaagcatgtagttcttcttctgtacagaaacattccatgtaatcctcaaattaataacttcatccaaattatctacaaagtcatggtttgacagtaatgtacccacaatatttctctagtgcaaattcagccgtaccagtaatgtgttaaaaagtcatctttttctaaagaagctatagatataattcatctcttcttgaattcaatttgtaaaaatttgagagttaacttatcatattttaacttggaacatttgcaaaccttcttatgtcatagcttctcagtattaaaaaaaaaatagggcatatggcagaaaaccatactctgtaaaacacgacagctcaggagaaaaaaataaaacagcttaagaacaaatattatgtccatacactaataacaacatggtgtatatttgtactgtattttttattttcaccatttaatttgaaattattggatggtttaaatatataattctgaatggtggatagatattaaaataatatttagcttcataagtattgaccttacacatttagatgtcctccagacaaagaatgaacatgaaggtatcgtgctaggaaaagaattaccgttgtcttctgtgtttcattaaaatagctttcaggcagataaacaactgtttccgtacgtaagatccaagaaataccattttatggatgccaagttcagcgtcttagtgagttctggaaacttacataatggaaacagtacacacctgcctctgtgtcactctctccctgattaaaagtgatatggctaaggacatgaagaaccatctccctcttttatgaatcaaataacgtatgctttataaatgttatgtatttattctttcctctaataaggctacacatgggtttaaagcattgaggcctgcgttagggagatcagcactagaggtcagagacattcagaatcctgcagtttagcatttagcaatgttactttcttttttcttttcttttttttcttttgagatggagtcttgctctgtctcccaggctggagtttagtggcacaattttggcttactgcaaccttggcctcctgggttcaagcaattgtcctgactcagcctcccaagtagctgggatcacaagcatgcgccaccatgcccagctaatttttttttttgtatttttagtaaagacagggtttcaccacgttggccaggctggtctcgaactcctgacctcaggtgatccgcctgcctcttcctcccagagtgctgggattacaggtgtgagccaccgtacctggccaagggtattacttttgagttttcaataaaggcagtgttacagattttgcttcatttgaattctatgcaatgtttttgtagttcctgatatcaaagatgtctatcagcttttaaaatgtatatagttaaaggattcctcttgccatctaaacatgcatcaagaataaagaatctatacatagattttacaaaagttattttatgttacataaatcattcagaaatttctattcattcatgtaaggcagaggcatagctgattctgatggtagtcctgctaatcattcaactgctaacttacagagagtccaataacccaatgtcatatgttgtgttgttgtgttgtaaaccattcatttcacaatgctgtgtatttttaaactctttaatcacagaggtcaactataattgctggcatcaatttagagtcctcctgctcttttctttcataatgttccattgtcgcatgctacagtatttataataatttgaaattataactgtatgttcatgtgtttgatgtctgttttctcaacctgactgacaattctatttgttttgttcaccaacttacacctaatatttggacatggtctgggacacatactaagagctcaagaaaagtgcactgaatactcatggtttataatctttgaactgaatatcttactgttactttttttaaaaaaaaatctatatttcaaacttatttctagcatagtcaaaaatggtttctctcaaaggatggatgtatagctaggcagacatacatacagataaaattgatatattcatatacacatagagttctgttcttaagttgtaattatgtttgaatcaactacatatttcatcaacttcccactgcatagaaacagtctgattagaggatccattctaatacagaaacatacatagatgtgtagagatgctacatgaatgttgatactctggttgtgatattgtgctataggtttgcaagatgtaaccattggtggaaactaggtaaagggtgcaatttatctttgtattgtttcttgtagctgggtacgaatctacaattatctcaaaataaaaaataaaaaagtggtatgtggcatttgtgtaaaaattgaaccagacgtagaaaatgaggtgtaaaacaactctttttattattactttagcattagtgacattccatatttatcatttgcacatttaaatagtagggccaggctggtataaagcctttttaccgtccgggagggaggtggggggtcagccccccgcccggccagccgccccgtccgggagggaggtgggggggtcagccccccgcctggccagcagtgctgtccgggagggaggtgggggggtcagccccccgcccggccagccgtgctgtccgggagggaggtgggggggtcagacccccgcccggccagccgccccgtccgggaggtgaggggcgcctctgcccggctgcccctactgggaagtgaggagcccctctgcccggccagccgccccgtccgggagggaggtgggggggtcagccccccgcctggccagccgtgctgtccgggagggaggtgggggtgtcagccctccgcccggccagccaccccgtccgggagggaagtgggggggtcagacccccgcccggccagccgccccgtccgggaggtgaggggcgcctctgcccggctgcccctactgggaagtgaggagcccctcagcccggccagccaccccgtccgggagggaggtgggggggtcagccccccgcccggccagccgccccgtccgggagggaggtgggggcggtcagccccccaacccggccagccgccccgtccgggaggtgaggggcgcctctgcccggcggcccttactgggaggtgaggagcccctctgcccggccaccaccccgtctgggaggtgtgcccaacggctcattgagaacgggccaggatgacaatggcggttttgtggaatggaaaggggggaaaggcggggaaaagattgagaaatcggatggttgccgtgtctgtgtggaaagaagtagacatgggagacttttcattttgttctgcactaagaaaaattcttctgccttgggatcctgttgatctgtgaccttacccccaaccctgtgctctctgaaacatgtgctgtgtccactcagggttaaatggattaagggtggtgcaagatgtgctttgttaaacagatgcttgaaagcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaatcagtgataatttgttgatatattcattagttgtccacattccctaactcctatatttttgtaaacttttaattgaagtataacatatatacagaaaagtaacaagaaggcttaagtatccagcttgatgaatttttgcaaactgaacacatctgtatcaccagcacctggattgtgaaatagaccatgaaaagcaccacagaagccctctcatgccgtatctcaatctttaccaagagaacctatcttctgactccatagagctgtcttcttttatccccaacttttctatttttaaaaatttcagtatatagaaatttcaaagagtaaagagtagcaagcattacccatcacctagatgcaatatttgttactattttgctgaagtctatctctctctgtatgtacaacacgtaccatttgagtgtgttatttgcagatggtgatactttacccataagtactccagcatgtatctccagccggatcaacatggcaaaacccactctctactaagaatacaaaaattagccagatgtggtggcatgtgcccgtagtcccagctgcttgcgtggctgaggcataagaatagctcgaacccaggaggcggaggttgtagtaagccaagatcctgccactgcactccagcttgggcaacagggagaaactctgtctcaaaatttaaaaaaaagaaaaaaaagaaaaaagaaagaaacattcttctacataatcacaatattttcacactcaggaaatttaatattgatataatcttattatttataaaaattccataaccagatatccccaattgattcaattgcatctatcataatgtttttgacacaagatttaattcgggattatgcattgcctttggcccaatatctgtttttccttttctcttgttctatctcttagtttgaaaactttttccagccttttaaaaaatatttaatgacacagaagtgttttttttgtttgtttgtttgttttaggcggagtctcactctgtcgcccaggctggggtgcggtggcgccatcttggctcactgcaggctccacctcccgggttcccgccattctcctgcctcagcctcccgagtagctgggactacaggcgccgccaccactcccggctaatttttttttgtatttttagtagagatggtgtttcaccggttagccaggatggtctcgatctcctgacctcgtgatccgcctgcatcggcctcccaaagtgctgggattacaggcgtgagcccccgcgcccggccgacacagaggtttttaagcagtccaggccaattgtttcatagatagatgcctcatacatatttatgtctcatagaaaaagttacaaatgtcaactcattgctatttatgatgtttctttattctttcttgcacttacatggttcagcatctggcccgtaggaggtaccaaatggtgataagttcattatactatcagtttaaaatcttgtctaccagctctgtgacaaactgtacaaatttgagtaagcctgttagcccctttagacctaaatatctcatctttgagtaaattgactggattatcttccattgataaaattgtgttatttatttaaacattgtatttggccatgttaccatatttgaagttagtattactaccatggaatggaaaattatataaatatttcatcatctagtattctgaatagagtatcaactaattgtacaatcttatgaatggttaccaaagaatttcagaacattctgtgtagaaaatatagtataaaaagtctttgcaattgctctaatttagacttccaagttgttaaaacatcttttgaagacctaggtggcctcactgctaggtatactctctttattcactttatctgttgcatcctttatagcctacttgggaactttttttccttgagctcccagcataagagaggctactggggtggcagttaaacccatatgtataattttgccctgtatttcatttcataaatatataagtctttttctgtattcttcaagacactgaattttctgcatgatatttaggccttaacaagttatggtagtttagaaaaagatatttaaaaaacattgtatcttgttgtgtacattagtactgttacaaaggttaatacatatttttttaatatgctgaattagcccttgggtcttctcacttaacaattttgacaaggttttatggaagttaccctgacacttccattagttattggacaactggaccttcttttctaattgtcttccaaaaaaggggacatgatgtttctctgccgcattaactttgttgtttcctgtaaaacttagcaggcaaaaatctgagcttgtaaatgagagacttgtcttcgtcttgatcagagacatgaaatttgcaatttaaatgagaaaaaataatgaacttaatgcataccttgaaagaagtgttgtaatgtgccaatttggttctcataaagttgattctacacatccctatgaaggtattgattgtgtccatgtagtaaagctgagggtgccgtgaactcctcagtgacttggcatttcatcgttacagacaatcagccttccaagcacttggcttaacatacctccagcccctaaatacatgacgaagtcagtggcagaatggctgtgcaagtagtctggctcttaaccttaatgctagccttggtcttatgaaatcttgttattaagaaaacctcatggctatatacagttaaaaatgaatgtcactgtgaaatctctacttttaaggagttatctggcctccattggtagtatttgcctactcatatttgtcaagttattctttgaaaactagcaggaagaataggaaataagaagtctgatttgaaatcttggtcttccttttcttatttcctttaccccagagacccagaaaatggagctagctacatttctcacacttactgtcatagttacatgtttatattctattagttgtaattatttttcacctatcctctcattagaatgttatacctatagagcagataccattccagttttaattttttgccccgactcctagtaagtacgtgacctattacagggaacttaaaacaaacaaaaagtctgctgagtctgggatgttttaaggatcgaaggaacatgttggtccaatttgccttcacagagggttacctctgctttctaccgaatgtgaattgctcccatgtgattttgaagaattccagtctacctcagggaaggaccacatgtaatgccagagtctgcaaacttggcagcttttaccctctctcatctgtgggattgttttgtcctgggtttagatagctaagtgtctgtaaaaagattctttttgtcattaaggagcaacaggaaatggagagcagcagtgactccatttccagtgtctaaagaagaagacttaagcacaaagtaaggactttccctctccacttgtttaatataatgctctgattgcatccacacgtatgcaaatggaaacattcagattccagctcctaaggacatgtgaataaatgaaatatgtgtccgtgttcttatttgctgagtgaatttatgaacaagtcaataggctgttacagataaagtgattatttaacattgtgttaaaaacttcacttggaaacttggattatttcttaatatttataattggctatcttagccaattatcttagatacctatgattaaaatagccctgtttgaatttttgtcttcaaatttgtcaagttttagtaagcatgtgtcattatctaccagaccacctctaaattaaaataaaaagagataatcagaatactgacttgccaagttgtttgtgaatcacacttaccaggtaccagatttgtagttaaactcctcccagaatttttccattagtgttatagaaatttcacatgctaaatacaatgcaagtatatactgttaaaattttcagaatatcgtttctgaaaattactttgctccctgcaaatccaccctactcacctgtatcatttgagtgaaaacttttctgtgtaactgtgactgagcagttaaaccagaaacctgctttaggtaaggactgccttgatgtttgcaatttttcccacttttttcttttcctttctttttttattttttcattttaaagataaaggtcactctaagaaggtagttcctgagttaaaagtgttccatagggttggggattacaatagaaacagacaccgttccccaccaagggggcaggagttgagcatgagcctccccactgtggtcgtcctggggtctctggggggtgggatggcatctgacagtgatgggcttttcttgatggcttcctttctttgtacctaactctggtccataaatagagcatcacatcatgctcccagactgacaccggggaagcttcataaatcagcaagtgagtgttccggcatgatcctttggccactgccttccctccagagctgacacctgtcaccttttaaagagtgtacattctctgtcactgtagctgattcctgtcttttctttattcattctcatatgctgcctaggtggtattatctgggtggctgcccatatattatttaaatcattaccagtatggcctaggtaggtttttaattatgcctaaaaacttgatagttccagatagttattgggtatacaactaagaatataatacaaaatgcattttatttttaaaagaacatacatatgtgtttaacagatctaattatatatatatttataatcaacaatagaatattgcatttaggtggcttataaataataccttaaagcacttaaaatgataagaattcttaagaatctgtaagaatctgagagttaaggaaagtgctttgaatatccttagactgttaccttttccaataagtcagtaagcattggtgatttgttaatattataaaatacgtatcttctctgtggcacacgtcactttattggagaaacatatgtgactcaactcaactgttatctggtcctattttgccctaattatggtttctatttaaatggcattatagaatcgcttagcttttaaagaggggcagtggaaaagatctgtaaaacttcagcaagtctataatctacatgagcagaaatttacctctcttaaatgtctacatattaatgacattaaaaataaaataatcgacccatgttggggatttctgtgctttccccaaatgaatgtttaaaattttattttgaattctattaaagtgaataatgaccacaaggtgtttgtaattggggagatagtaagtgcaaaatacaagcagagggtgcttaaaaagaacaaaaaaagtctgtttcttattgattggcctgtggtgggataaatgtgtggcttctgcctttaatggaagctgattgttcagggatgtgccggtgagactggtcgattcttgagctgttgtttactgggaaggacaatatgaattttctagagggatgattggtgggatgtcaaggctgtcacccttttctcctcgtcactgacagacagcccggtgacaattaccagtgatgggacattgcctgcactggcatatacactagaggatataactggcaaacaacaagagaggaaagcactcctggaaaaaagatataatcagcagttgtcaggactggttacatatctgatgtctgcataacagggccaaggcacattagctttaccactggggtaacatgcagcctgcttcgtcctgcttagaaaactgatcttagaaattttgggaagtttagaggataacaagaattgttggcattctttctacttgacagttaatataagaaaaaaagtattttacttattttttctaattaaaataaactttgggaaattcaaatggactggaaagtagatatttgtattctttacagaaatagttatatttgtggtatgtttcctcatgagttaacttttatgacttttcttgccaggcttctgttattggcaaaagtccaaatggacactaataagttgtgttgtacaggtatcagaatgagagactcaattccataattttgccagagaagcatcatttaaatggtggagtatgttctatgctaggtaggtagtacacagacatatccaccagattttctataaagattcttctgtcagtctcatgctgtctatttccttccgttccattgcttcggaatttcaaataagtttaaagaaaaagatcagcatttccaaagcctaccttaatgtgtagagaaactaatacctaaattagaccacctggaataaaagagccgtcaagtagctgtatttatttctcagcaagagactattctttgtgttaatttacaaatgtaacttatttaattaatcatgtttaggctaatcacctcttagagtcaatgtattctgctggaagtttactgtttggaaaaattcacaataagtatagttttatacagtcaaatttacatatttttgttctgtaggaattagtcatctctttccacccagggttttcttaacatcaaaatgaaaatgtctccgcatgctcaggtaagaagatttttgtcagtttcccaccaaaatatggactgggaacaccttgtaagcttctactcaaatgcctaatgaggattacttttttcataattggtcactgtagagatgaaaataattggctacctaatgttggttatctcctatctgtgtggcatccatgacttacatcagatgtatttctttttttgtgagaattattttcttaaatgtcttttctgatttttttttaaaaatgtgttaattacagaatttggcaaacattataaagtgcaaataacggtatgaaaatcatgcattattctaccattcagaggagtgcattgttaacattttagtattttttccatttggcttttgtttgaagattttaactgtttacatttgtgtatgttctgttgagtgttttcagtgatgccatttttcatcttgaatcaatatatagacaagtagtgtgattttggtagtgtccttttattttaaataagtaggttttaatactgctgagtgattacatatggaggttatttctggttgggcttataagattccatataaaagttataattaatttccttccttaaaccaagggctaattgattttccattgcactcattaaaaatagatacttagcttttcagaagattgtctcagaaacccaaggcagggcccaggccctctgggatgccatcaactgaccattccatcagtcctagaattgtgaccctcctacttgtcagaactgaagtatttatcccatttcccagcagataaacatttgcaaggcaaataataaattagccattaatcagaagaatgtttgcattcgatgaactctgaatggagtggagatgtcaggtagatagacaaggtaaatcaacatggcagaatcaatcacaaggaagagccagccataatttagaaagcattgacccaaatatttaacgactttggaaggtaagaacattttgtaaaggaagaaagctatttagaaaaaggtgtgggtagattttaataatagatagcaattaagttttaaacatttaaggcttcagcctaatgatagacatttggaagtttgatttgaaaaaagagacactgtcaaatatttatttttaaaggcccgtgtgttcaaataattttttctttcccaggagtgctctcatgaaatgtacccacattataattttttttcaaaaaaacaatttagcaagtatattgttttaaaagcaagaagtgaccttgttatgttggtgttctttgattcctaattgtgtttgccccttcatgtgtatgatgcaaagactttcagattgagagtctgaaagtcccatgtgttgagctttgcttggccacttaataatcatgtggtcctggggaagtaacttaaccttttatgacccgcaatttcctcatttgtaaaataggtcttggcaccattcatttttttacgtagaagacatatgtgtgttgtataaatttattctaaggcattattcatattttaaaattcttaaaaaaatcagttattgttacatatcttgttctcatgtctaatcagttagtgcatatcttgtttctgaaaatgttatacctaaagggattaaaaggctcagtggttataaaaaacaatattatttctcctaattctcatgaggttagaaactacaacctttgttttcttagaactgaccatcagggaaattgcttttgactccaaacacctaccatctggcatatcctatcttctcattataatatgtgatgcctaaatttgtgagacatcctggactctccacatgtgtgtttttcatttcttgaccccaacgtagaagaaaggatggaagtaaatggaataaacataattctcaccgttgctttcctagttcttcatttctcacctactcactttcttcccatgagtacaattctatcccccagttaggttgtgcagatgaggtatcttttcaagtaatgacacctttaaaccaaaacattaactgagtcctgggtgtccccctccccatagctttgcttgactaagaaaattcttctaatccgaaattttaaatgaaaacatgtaatgttgattaacattgcctgaagcacagagtacgattaaaatgttttgagattttagaatatataaatcactcatgcaaaaaaaaaagagttttctttatacaatctagaaacaattatattagcccgtattaataggcttcaaatgaaaaacattgaagccaatacatttcaactgggtgttcatgctacttgctgtggggttttttaaaaatttatttctagttaataccccttatccccatgccatctttgtctttctgtcttagcaggtaactttaacctaaatttcctgaagaaataggaagttattgtatgtgaattatttattgcttacctcaaaatttctccaaatcttcatttatcatttcctatttctgttctgatactcatgtctgtgactaacaaacctatctgcttatgtttatgattttcatttactccagtcgaaacctgtcaaatagctactttttcagtctcattctttattaattcttccttacaatataagcatacccagttctcctccatcttaaacacaggagagtatagataaaaagaaaaattctataagatttcatggagaaaaggaattatgtttagctttggatttcaaaaaggcttcataaaagaaatggcatttaaaaatatcctgaaacactaatattataaagcctgttttaacataaatactacttactgtcaccatacggtttttgtttttaaagttgctcacttctaatacctgaggctacaataaggcacataatcttcctaacagtttcaatttataactcatatttttcatgacaaccctgtcaggtaagttgtattactattctcattctgccgatgtggaaactgagtcaaagaaagattaaacaacctacctgaaactatatatttagtagtaattgttagaaccagagtttgtacctggttggctccaggttctgtgcctggccactattcttattgcttctccacatagtacttgcatatatgattaaccatgaagctgttggctttagaagtcttgcaaatccattttcagaattagtttgggtttttgggttttttcggggttttatagagcatcaatagggaaatagcatgaaataggaacagaaatgtagattggaatgataatgtagaggtccttaaattctagactgaagaattctgacttaatttaattggcacacgatgaggaatcgctcaaaattttgaacatgaagtgatattgttggatctacgtgttagcaacagtggacagttggaggcaggaagtgtgtgaaatggataatcatttagaagctattgcaaccgtgtgggtgagaaaccaggaagcctaaatcaggaaggtgactggaaaggagatacatttgtgagaatggtttaggtagcatttacaggattggccaagctgggatagtcatagatcaaggcaagcagggagagaggtgactccaagattttaaatcataacttagaagataaggagctgctatctgaacactgatcaaatcagcctgaatatttattaataatttgggaaatatctgccttggtacatgttgactttgatatattaatggaaatttcagataacgttttggaaacgtcattctgtaagtagggagaaaaatcagagacagaagtataattttggaagtatctagccaaaggaagttgaaaccatttgagtagatggaataatgaaagaatgaagtatggaagctgaggtggagaaagcctgaaaaattagtctgtggtaggacctccattaaatcagcaaatagcaggaacagaaagaatgagctgggtaagaagagctccaaaagattgagggagaactagaataaggaagaatcataaacaataaaaggaaagggaattctaagaagcaagagagggtcaaaattcatttacttcagagctaattgagaaaaaaaaggtgtttaattcatccaaaatctctaaagaaaaccttctgttggccattattacagataacctttaacaatgataaatgtacagtaactacttacatatgaatgagtcagtgaaaatactcggacggatttttccctttcggtgcattcagggtctgtgtggaagaattaatgctttcagaatatttgtttgtaaacacaccatctctaaagaaaattttagggtttctattgattttttgatcaggtgttcacatatgtttaaaattataatggaagtcaatagataaacgtgacttggtgtacaatatttacctatacatggcattctagaagcatatatcattagaaagatcacaacatagtttgttccattttatgaattgattcttatttatctctgctgccaaaaacttgtggatctcactagagccacacatgcttaaacttaaaaaacaaaaatattttagattagtgaaatccaaaatttacattttacattttttaggaataaactgcattatattaaaactgtatcactggtttgcttgctagatcagaataaattttgatccagaagtctgtgacctcttgtttggatcaagggttgtttcttatataaaacttacaagttcaatactgagactgaacaaagccaggaaacaaaaatataaatttgatatggtctgtttgtagaaaagacaataaaaatgttgagtacttatttacaaagcatgtcttcaaatttttctttaaagaatctgtaggtaatctgtattgtggattcattaagtttttgacttaaaaaaatggaaaaaacacaaaagtaggaaaaagagatttctaaaaggttattgttaccactggttacttgtaaacctacagttcactttgcactaaaactttggatatgtctcattgattagaattttataatataaaaatgcagccaaaatattttgagttttgcattttaacaaaatttcaagtccaaaacctctgaagatgttttttctcattgaactaggcaagtcggaaacatactcttaatcctgtcaatggttctgagagcctctctgctttaaatatatgataatactttgtttcatgtcatcttattattggtagtacagtcatccctcagcatctgtgagagattgcttccaggacctccaggggatatcaacatccatggaggctcaagtctcttctttaaaaaaagactttaaaagtactgtttgcatacaatcttgtgcatcctccttcatactttaaattatttctaaatcacttataatatctaatgtaatataaatgctatgtaactggttgttatactatatttttttatttgtattacctttaattgttgtatggctattcttaaattttttgccaaatatttttatctgagcttgattgaatccacagatgggggccattggatatggagagccaactgtggtttacagtctagttttctatttttctagttaaatatataagtagaaaattaaatttttaatcaataggcaaaagagagcaaggccatatactttacaaagaccatgaatgatttgtgaagtagatctctttcccccttcatgttttccaataagtcaacacaaatctctcttccatttataattatgtacgtatatgtgctaaataaatattatgcttcccattcatacttctgcaactccttcattattttctatttccttcattcagctaatatttttctgaatatttatgtgtctagaagtgtttaggttcaaagagagagcagtagacaataaagacaaagccctgtctctactgaacttcctggggaaagagctcgattgaaggcaaatctataaacaacataaaatttaagattaagtagacagtaaagacaacatcacagaagataaggggtagaacatgctgttgaggtatgggcgcgctacaaggtaggatagatgaagacaatggagaagagcaatgtgttgcatactatttccatgccatataatccagatttatcttacccctccattgatcgttttgccctgtagatctgaagtttccaatgcacaaagatacagtggcagaatacctcaaatctctctcaaatctctgccatttagaactttttgttgatgcctagatggttggctttgtttcttaaagggaaaaagtactctttcagtgtgtttgctctcaactcatgctcaacagcaatgatctcaaatctccaacacttgctcatcaaaaaatatatgctcgcgaatagatttcagtgcttcagattaatgaaaaaatacccatccttactaaacaggtgagaatgcaagctcaagagagccagcaaagagaacattttaaaaaatgttaggcactaataacactttgaataagtgtcattttttgaaataaattttataccccccacagtgtgtatataattatatattgccatgtacatattttaaaaaataatttacataggacatatttgactcagattgcacttaaatattctcttaaatatactcctgaagacattcttatttttagtgctttacagaaatattttgaaaataggaaggctactattagtaagagcaaattgaatttgagtttgatttgttaagaaatacttacgctgttctctctagtcttagtgtggtttcagcattagtcttactcgaggcagttgaatactgatatgattgcagataacttggcaatctgctaatggttccaggaggttcattttgatgtatttagtgaatcttaggtaggtaggtatgtactaacatatcatagtatgtggtacttactatatatattcctcttatttacagctagctacaaaatattgcttagaaacactgaaaatgaaaggctatttttttttaaaaatctgtcttttcctaataaaaattcaagagctttaatatttagtaactgcctttaggtttagtttgtcagtgcccttcacgcgcttaataataggcttcaaaactcctggtcacttgctaataactcttcacttctcgggagattgaattgctataggccagttttcctaataagcctgcaaaaaaaaaaaagttaaattgaagactcatgtacgtatttccttttcagctattttttatacattgccatgcaaatatatttcattttttcatatagctcatgaatgtgcatgaatacatacatatgcacttaacaagaattttgttttgaaaaaaaatactgtggtatatgagaaaaattgtaatattttaaatgaagatattagtaccagagaaatagctaatcaaatgtaagaggcaagaaaaaaaaggccacacattaaacttgtgcatcatcaagatttaaaaaattaataacattaaaaacagttggttaacattcttttcttttgctatctatgtcccgtttcttttaaaccttgaatgtaacatataacatttaatctcctataaaattgtaattattttccaccaaaacacaaatgagtaaacataaacaaaacagaaacaaagattggcctttatggaggaattacatgtgactacaagaagagattttaaacaactgctagggtgcggttaaactgtctcttacaagttgcggttctggatgtactctgttaaggagatagtttcatgaacaggagcccgtttgtaattagataaggaaaactgacagcagcagttgagttagtggctcccatggaatgacaggtattgactgaaccctgggctgtgtttgagatggggagggagtcgataaaagcatcagggcttgtttggagtaacactgccagcaatgctttaatttgccgcctggaaaagagccacagacattcttcccccatgtttagtgttgatgagatctaacacttacatttaatcttctgtttaccactaaaaacacttgtaagtggtatatggcaccacaaagaggaaatagaacagggaagcacattttgtataaattctatgttgcagcccaagtctagaaaaaaacacctcatttgaatcattgaatcaagtgtggaaggaaaagtttaacaacaacaaaaaatcagtttagaacaaatgttttaactgattttgaagaagagatagggagtagaaaatgtttctaaactaccttttgaattctctctctctctctctctctctctctctatatatatatatatgtatttttttttttttttttttgagacagagtctcactgtgtcgccctggctagagtgcagtgggatgatctcggctcactgcaaccttcacctcctgggttcaagcgattctcctgcctcagtctcccaagtagctgggactacacaaattctttatctatttttctatataccatattggtttaatgaaaaaaagactgtaaatggaaaagctgtgatgttcatagacacattagggatgtattattatctctacataatttaaagattcaattttgtactctgtttaaaagcaaatgtattcttattaaatacttcccagatatttttgaaatgtcttacataaaaacatatgtatatataaattctatgataaaatattaatgtatagttttatatgtggtatacactttgacccataatatctacccataaaaatccacaaaagcacccagattttaatactgaccattagagaactcaagcaaaatgatttttgaaaaagagttacttctggaccagatccaacctagctgcatttaacttgctgccaaactcaacagacaccattataaaatttgcacctacttattattacaaattcaagtaatcccctaactgtgaccttcagtgcctaattaaataagggcagcatttaaaaatactagatgacttcaatcttacttagttgccagtgcttaatgcttcccacctgttgtaacacagaaaatgcccaaggtagactgcaatgcctttggttttgccaggaaatttcaaaagcttagggttttgtagtgaatccacactaaactcctgttaggctcaattagatgatgtactgagattatctgacttgttgtggagataattactgtaccagggatgagaggccacccatgcttccaggggaagctcattgaggaggctctttccctatttccatatatattccaaagctgtgtgtgtctgtggaaaatgaattcaccagtgactgagaatacggctctgaatttattaaaataggacttgctgtgctgaaagaattttatttcggtatataattttaagcatggaaaattaaagaaaatcaagagataagtataatagctagtactgtctcacacacgcctaggatcccttagatgtgtaaaatgtatccccccttctaaagtttctgcagaaattaaagagcagaggaattaggatttaaccaaataaaatgtttcgcttgaaaatgcattaatgaatactgtaactaaaagaaaatgatgctcaatattcttgcttttagtgtttttcagaatgtatcaataatgttggatcgcattattttagtatatgtaaattttcaaatatttaattatagtgaaaatattttaaaatgcgaagtctcatatcaattacgtaacatatttttgcaccaagtccaataaacttgattcagtcagccattacataagtagggacaactgttaacatctctcttactggtacaatgattgattgtagttaggataaccctgagtacttcacgtttcacaaaatcagtatgattttagctatatctatcctactgttatgaaagtttttagtcaccttctgatattttgtagatggttatttctttgtatacagttgtttcatgcatagagcttcattttatttctttgcaaagaaatatttaatttatatttgtcagcttttgtaaccatgattaacaagactaattgagattaaagtactgcctatcaaaaaatttccaacagttgggactgaatatttgggcaattcatatgaatttatatttatggtggtggaaaaagccaaataattcagaatttacttgttcattcaacaactaatgtttgagaaccatacttggggttaagctgggacaacaaaagtatacacaagttcctttcttaaaggatcgcttgtctaggaggagagaaagacatgtaaataaatgattgtagagtacagtgtgatcagcacagtaatagaggcatgtgcaagcttgaacagttattctgaaggagggagcaattaattctgtctgagatgggacaggggaaggattgaattcgagcccgttcttttgaataatacatgaaagagcactagtccatcctcctaaattgagtagtttagccaaagagagctgccaacctatcgatcaactgatgagaagacagaacttagacctagcaggcctaaatgaatagtgagctgacacaagcaggtatcagtgccatttgtagctttatccctgaaactgcaatgagttggtgctctcaacaatctctccatagagactctgtgttcccacagctgaagaaactttatacaaaggtgttaagtaaagactgtggagagatgcaggtaactaggtggataaatggtattatatgagacctcctgaatgcaaaaacttttcataaaatacaagtcaccaaatctctttgaatgaaaattttatttaagcatttctgtatgtttggtaaggtattctccctatcttagggaatagaaggaataaacaaaatgaaacaaacaaacaaaaaacctttacttgattttgttctctgcctcaggtcattataatctacccggtcaggctccagactgtctctgtaatttcatactctgtaattcactgatgctggctcctgttttatcactaagccattaagctttctcaaaaataaaacaaaaaacaaaaaattgtatttgttctagcctccaaagctgaaacgttctttcctttatcttctcccccataagctttaaaaatttcaggaaatctagaattccacattctccaatgttgctgtagggattaccttctcaactggacatatgcctgggtggtctataatacttatgggctgagttatttcctcacaaacttcgaatgttaaaattctaaaccctagtgtctcagaatgtaactggatttggagacagggtctttagagaagtaattaagttaaaatgaggtcatcagggtgggccctagactaatgcaacgggtgccctcataagcagaagaaattagaacacaaacacacacagtggaaagaccatgtaaggtcataggaataagatggccatcaagggcagaggccttagaaagaaccaaccctgctgaccccttgatcttgaacttctaggatccagaattgtgaaacaatatatttcttttgtgtcggccacccagaatgtggtattgtgttatggcatccccagccaactactacaatagagatgacaggtattgtttgtgtatttcatcagttcattagcattgatgttttgttccaactggagtttcttaatcacctcttgtgaacatcatacagattactgttcccagagtaagcaccaatacattgctgttgaattgattaactttcttttcatgttttcaaatgatatgccacaattcacaagttgatttgcactgtgctgcttatcacattagcacacagcgtcaatttttctgctgtctttaaccaccatatatttcacattaggttgcatatgagcttagtatcttttcccttctgatcctggacatcattagataccatgaaacaactgaacctccaggataaaaatatttatagctctgctcattgaatgaagaggagcatgtttataagatggttttaatgaatgaaggctctggaggttttcttactgctggacaacataacctgaatctccagagctggttttcactaattacaaagtgtatgcgttttctccttataaatcttgcatcagctttatttttaaattctgagatttgtgaaatactgggtcttttaaatcaaaaatgcaaaactagaaatacagtcattcatttaccaaaaaattttgaagcagctatgcgtgaagcactgtgggagatagaaagatgaattagaagtggactttgccattaataactttacattatgataaagggaatattatatgcaaaaaaggaattatgagtgagtggaaaaatatatgatccagaagtgatgcagacagaatgtgaagaggtcaaaggatcacttctgtttatgggaaccaaataatgacttctggaaagttggtgattgattttagcatgcctaaaacagaggatggggtttgggtttgcacatcagggagatagaagagagaaaatttcaggatggtgggacaatgtgagcaaaaggtaagaaaatatatgtattttcaatccttatctggatttaaagaaaacattgaaataagtttgcttaacattagttaatccttcagtgttagctttaagaaattataggaagtaaaaatacatctactgtttctgagtatgggtttcacatgaaaatgtgctgcgtcttttatgtatacaatgaattatgaagaaaagctttggataatatttcaggacctataattggacaagtaagactgagatgatataatgcttatttttgcatcctcagattctagcatcatagatggcatgtagtagcttacagaacttcttgatgaattcgttgtaatttcagcttgaaatagctaagtagccatagaaatagagtataatgcatggagcagatatctgaaaacagatttggcaaaatttgacaagtctctgggttcagcgctgccataaacagaattgtcaaatatgattttaaggcttgaagctgggatgagaggtagaatgatagttccatcaaaaatgaggacaggagtcagtttattgaaagataatgacttcatttggtgatctgctgttggaaatataggatagtggataggcatcttagattcagatatagataaagtggagaattatctctttggaatggttgttacagacagattactgaaggggaaagtatagagagtcaaaggtgatgctgaagagcaggtttttagtgaatgagtatttttgaaggagagaagaaacggaagcatagaaggaaagaaggcagtagtcagacaaatagaaggtacatcaaaacgtcagtaacaaaaccacaatgtaataccacgttagtcctgcaagaatggccataatcaaaaaatcaaaaagtaatagatgttggtgtggatgcagtgaacagggaacattgctggtgggaatgtaaactagtacacccattatggaaaacagtgtggagagtccttaaagaactaaaagtagaaccaccatttgatccggtgatctcactactgggtgtctacccagaggaaaagaagtgattatatgaaaaagataactgcatgcacatgtgtatagcagcacacttcacaattacagaaaggtgcaacctacccaaatgcccatcaatcaacgagtgaataaataaactgtgatacacacatatatatatatgtatatatatgatggaatactagtcagccataaaaaggaatgaattaatagcatttgcagcaacctggatgagattggagattattgttctaagtgaagtagctcaggagcggaaaaccagacatcgtatgttctcactcacaagtggttgctaagctatgaggatgcaaaggcataagaatgacacaatggactttgggaatttagggggaaaggatggaaaggggatgaaggataaaagactacaaattgggtgcagtgtgtactgctcgggtgatgggtgcacccaaatctcaccatcaccgtgaaataacttgctcatgtaaccgaacaccatctcttcccaaataacctatggaaataagtttttttttttaagtcagtgtcataggaataggaggttagaagtagacaaaaatgtttaatgtcatggggagattaaaatgaagttagtggggaaagacctttggttttgaagaccagaagctttactggtgatcttgtaaagagcaaattctatagattaataactttagattctaactggtaacagagttaagaaataaatgagagattattaataaagtaggaggtgatggtttacaggatcagcaagatgagaagaaaggccctttggaatcaagggagagcatgcaggcaaggctgaggaattgaagtaataatagaaagctagtcagtgaagcagtactttagtcaaatgcaaaagagattatacggagcacagagggcagtctaggacttttacaaaactaaggatgttgatttttcccccatattgagagaattgcttttaatagtcatctctttaagtgtgttaacaatccttgaaggctgatattaataatttcattttagacatcaaaactgagatttttttttgagagtaagcaatgtgattccaaagatataacctggctttaaaacctgcagcctttctactattaccatcttgttttttaatgtttgtcctgactgattagctaattttaaaaatgctttaacttcctttgattaggcaatattatttatagattgaactggcttgctgaattgttacatgttacgtaatgtaatatgaaccatgtcaatgtcagctgattataactcacacttgcggtattcaagaggcaggaagtgaaagctataagttttctgtaatcattgtcacaaatgtaatcgcagctattgtttcttctgtaagattctcattgaagtaaatgaaaatgaagacaaatgaaaacgaagacatcaataagactgatccttcattgtaaaaagctaaaacaggaaagcagtatcaggattaaataagacatctatattaaaatatttcttctatgaagtggataggttagaagaatatgaaattattattagatcctcttaagctaacttatctatctagattaacttgaaactggccattcagcaaagtgcaaactattaataacacattcaggttaaaatgaaatatacctaagatttgtttttgccattcttaggcatccaaaagttctgattggtatcccaaaggcccaacatcccaattgtaccaaaactttgaatacagttcaaaataagtacacttaaaattagcaaagtctatgtcaaaacagtaaaatatccttatatttatgatgattgctttttatctctatagttgtttttggtctcgtttttacaggcaggtgaatataatgacttgttgcacttataaaatacttcagtcccactgcagaatctgtggatcatccttacagtcgctgcctcatgagcaatgctacatattagtattttttgaaaagactttaggcaatctcttcaattttatttattttggcacttggaatctctcttcatattaaattgtagaaaaagcagctctgtaattattttcagtccccaaaagttcagtcttttcaagaataaaaaagtgtattatgtttaaaatgaatgtatagaagtataattagtatatttgtattttctttcatcatagaccattgaaataagtagcagaaaatgactttgcttttttactttaaaactcagtaagggatgaaagttggtaggtaataaaacatattaaatgtaatcaagaatactgactgtctaaatgtacgctataaataaaattatttccaacctctctattaccataaactattagaatagtattttcaaagaaggtgaatgagtaagaccataatttttgtaacattaaacataagaagtcctagatctattatgtcttgcttatgtatcaattatctttgatattatgtggattcttcttctgaattatcagtgttactaaaaaaaagaaagagacagaaagatttgaaatgaagtaggcttatttacttatatattatttgctctgaagggtaaaagccaactaaatggacttacaaacatacggaaaaattaatgtataggatatttttccaaccaaaggattaaataatatgaaagagaaacactaatattagtcaaacagagctacctttaccctagagagttattaaagtctagatgtgttttatatgcaaaatggcctgtcaggattatggaaaaaaattctgacacctgcttctcatcagtgccccagaaacaaaggtgaagaaatgggtttctgagcatgggactgcattgcttcctgggtttgtcttaaaaatacatgtgtttttatgtggcattttcatacttatgtatgagtctttcattcgtttaaggcagaaaaagtgccagtaaaagtaaatgtctagtgctaaaacaaaatacacccttttcaggataaaactggcaacaagcattttattatgttgtaagagaacatttttactgttttctcatatactgttacatctctctacattctgtgttcaccaaaaatttaaaaatcactagtcctgaaattatgaaaatcggccactagaatatttgactaatatatttttagaattatagtcttacatagagccaaatagcagactagaataaaagggattattttaatatattttcaaacaatgcttggtaggaaatgataacatttctagttcaagatcaaatatttgaaacttgaagccagattacttttgtaatcttgtgtgtgtgtgtgtgtgtgagagagagagagagagagagagagaaagagagagacttggctttctgattcaaaatacagaactttttcttatataaaatacgtgtttaagtagacatactgtgtcagacactattaaaaaatgactgagattattccagctgaattagaacccttctcacagattatcacagtgatttggcccccgatgaaatttctgagaattttatacttgtgatgtaacaaattttgtaaatgattattgtactactttgttttggtttgaaattttaaactcttacaactaggtatgatagggttaacatgtggaacatcttgaagattatatggaaactgaagaagttacaggtttgctgagacaagaacactgaagataagatttgtaacactccctcttagaaatgaccatggaaagatgataaatgatatttacctcatatgtcatgataactgttttttaaagaagatatctgtgccctctgttatcaggggtatgggaacatgcatcacttacaaacactcaatcaccgtgacataaagaaatagcaaaccttgaacatgtcagaacagtgcctgttcaatctacttctgtttcttgaacaccgagtttattctcaatattgtatccccaaaacaagtggtctttagaatatgatgtttactttctggtgagacttttgtgaaacatgtaagcgggtatatgagtatacacagtatgtaacaatttaataaaaatatattttagaggcaaaaactatttcgatagaacagcaatgtatctgtagttgtatctttacttaaactgttaatatttattgaatgctttctatatgccagatgctttgctaagagctcatattaaacacaggctggtactgtttttactcccattttacagatacaaaaactgaggcataaagagattaaggagttcaaggtttcccagatgtagttctaccttaagtataatttaccacattatttgaattttctgatactaaattcaattggcttaggttactggtgttagcactcttgtccgtgatctttataaagtatacacttttcatctccatgaaaaagaggaagtagtttgggttgatttaacattgactttgaaatgacgtatttgttcttctgtagtaatatagtatttttctgggggaaaatttgacccttgtttctaaagaatgcatgaaatttctgcaaagatcctatctatattaaacatgggttgtattccaaacatttatgaaagactagtgtacaagtaaaattggatagttatctcaaagttactagaaaattctagctgtgctcagaaaaagtcttgttttgtaggtatttgcaactttttcagagttgcattatctgtgtgtaaaatataaacaagaattctgacctctattcttaactgttgcaccagatgtttctcaaaataaacgatattgtctgagtgctctataaacagattccaacctgaatgcctccttttagcgtccctcccaatttaacacataaatatgaactctattttcttttcagacaaaacctgtatagtgtaactttttttacgagaaaacagtgaaatgtagcattataatctgtgaaaaacaagcaggatcttggcaggcagagtctagcaaggaagtcttgtgttttggctgaacatactctggacttttatcttggctaaagctttttttaaaagaacatgccttaaaataatttgtttctgctgctctatgctagattttgaagagttttatttagtgcctggactcctggtctatgaggaatgtgaagtctgtatacaaaaccattatactgatgacactttaaggaacttctaagatggtagtaaatttgtgttctttatataaattatagaatgatgtacaagaatggttaggtaacctttttaaaaggtgaatagtcctgctggcaagaaacataaatatgaacctcagaaaaaaatgcatcacagaagtccatttttaaataggtgctcctggaaatatttcaaatgttgtaagcaaaaaatcaaaacacagaacttcaggaagataaaaacgaattaacaaccttgctttttgactatagactcccattaaatgctaaataaacacattatacatgtgtgggatatttatctaagttcttatggtcagttaatagtaatagaatacactgtaatactagctacatgtattaatgacttactgggtgacagacattttgcttcgagtatattatttcatttaatcctgaaataaccctaatcggtattgtaagtttaccatgaaaacagattaatgtgagcaccttaattttttgacctgttgtgccactggttagtccagtagagagccataaattgagcagagagccttaattgctcagggactcggtgataggcctaaatagtcatgagggatttcactagatcattcaactctttaaaattgtggcctaagacagataggaactgtgatctctagggataagaggctaatacattaaacttgtataccatcttgcttttggcatttaccatttcgcccttgtattccattttatctaataaaattcaaggcacttggagttttttaaacgtggatattgctgaaagtttcatctaactgggcaaaggctacaagttatgatttagttgttaattagacttaaagaacaaagctaatgctgttccatttagtgagaaaggcctctgaggacctgagaactgaccaatattggttctcctgctgggaaaacactatgcataaacaagtccccagggcttcattactgggccttttacacaaacacaaaatgcatcttagtttatttgaaaatccttacaatgaagctttattgcatatctataaatttttcacgttgacatgtcaaagacttgtaaaagtatactggcgagagaacgataaacattataaataacactttccctttaaatgtaagatgattgtagatagtacacagcatggtcataaaatgaatacagttctgtttggggaagcaattgtgggaatgagtagtaatgtctaaacaggatggcaaactctttattgagaaagtaagcaatgtaacattatttagcgaagttggatatgcaatttttgaagattaggagacaaggtatgtcattttatttggtgattttattaaaagacagttcaaaaataaattttaaatgtcaatatattctcaatgatattattctatctttgcaagtatttttagtgttctgccttatgtgtatgttttaatatgctgaacatgattctttatttaaaaaaagggaaagtacattttcctaagaatttaaaatgtaattccttcatttcataaagtccgtgggtcatactactacaaatttctctactttgccatgttttttatacatatttcttaggaccaattcctatagaataagtataactttaaatgttgaatgtagctattcaagtttggtcatcattggaatgttagtatttctatttatctaccaactaatttgaaccactgagtaaacattcttagctaaaaattgtttcagttattttctactggtcatgcagatatcaaatgtggggctctaaactcagttatttctcattaaatttggaaaatcttttccattttatgaacaaacacaattcctttttttttttttttttttttgagacagagtctcacccaggttggagtgcagtggtgcaatcttggctcactgcaacctctgcctcctgggttcaagcaactctggtgcctcagccccccaagtagctgggactatgggactgtgccacctcacctggcttatttttgtatttttgtattttaagtagagatggggcttcaccatgttggccaggctggtctcaaactcctggcctcaagtgatccacctgcctcagtctccaaaagtgctgggattacaggcatgagccaccaagcccggcccacatttccatttttaatatatactgtgctttacaaatattataatatgttttaaaatatgttcacagaagcacctggtctgtgaatggcatgccagcattaaaaaaaataagcattctttgaatatatatttagttttttaatgtggtaggaaaatcaaagccagagggagtagaaacaaaatttgtgattttctaaatacttcttggctgcagggaagaaaccacgtcccaggcgaagtcctacctaatttgatgataaaattacatggaagggattcttgttggcatgaggacctaccaagatggtcaacagataattcaaaaaaaaaaaaaatttagagataaggtcttgttctgttgtccagaccaggttgtagtgcagtggctctatcatagctcactgcagctttgaacacctgggctcaagcgatcctcctacctcagcctcctgagtagctgggaatacaatagtacaccaccatgcccagctaagttttttttttttttaaagacagggtcttgctatgttgcctaggctggtctcagacttctatctaacctcaagtgattccaacagataacttttgatgaatgtgagaacctttgtaatcttctatgtacttacattaaccaagtaatttcacagacaaatttccttctttttgctaattgggccatgaccttggagtagcaaagggtgaggacaggtcatgacctaatcagcacagggaaataaaattatatcatccctctggtttaagaatttgcaccatagggaattgctctttgaacaagttcttgttctgactgatgcaaaacccctgatgtttcttaaaatttatacaaatttttccagtttccataaaactggaagaaaaaaaagaataaagtgaagcctaccccctcctttttgaagttctgcatactaagtatagtgctactaggaattatttatttgacaaataagtattcatctgttttttaatgtgaaaatcaggaactatattttcagatatttagattaattttatattctgttttgtttttcccacacaactgtcaaaatcaaaagcaaataaaagcaaagtaacatgttgtgtgagatgacagttgatgacagacaccaatgggcatgaatattgattcaaatattttgtttttattatttcacatccaacccagaaacatttgtataataagctagttcttatagttacagttgacagtaggatcagtggcagcttaatccaatcaatcaatttacagacttgctccagattctctgggggtctctccactgaagatctcttcttgtcattggccccattcctgctaattaatgcctagttgtcctgtggtccctggacctactgttctttacgtaagttcacttatgccaaacttaacatggctattagttacctttggcagctcctttctttggctgttacttaatctcacttccatactttctggttacttcagactccttcttacattaaaatcttctgattacatatactagatttgtatttaagatttattttagtgactgcagaaaaatgagttcatttattcaactcaacaagttgaattcattacttgaattcattactgggaattcattaattgacatatgtatattcattgggtaaatcttgtttataaatctctttttaccaatttgaaaaagaactctaaaattttctggaatcagtgttaggttaactgtgattattagtttattctgtctttgacctgttttattgtttaaaactttgcctgaaatgattgatttttggccattaggacaaaatagaaaatataaaattgcattattgggttattagaaatatggcattggatgaaggaatagttatagtataaagcttgatttgtaatattttatttctatcacaaatgcatttttatagtaatcattgtattagtataaatatttaatttccattgttggaaattaaatattacatggctcttggaagaaagaatttcataatataggggcaatgtaattaggattttgcatgttggaaatggcagtaaaatctatcaatatattcccttttataaatctcaacccatgagagaaatgtggtgttgcttcctttcagtgcctaaccaccccttcaaatatgtttttctcctagtttcattacattcaggtaaataggacgctatacagagtataaatctaatattcttttttccccgttaaatttgccatatgagcaatttgtcattgcatctttttatattatatctgacttgtttacaaaatgtagaacattttattatcttgatttttacatgtccaatactttggtgaaatggagaattacaggaagtcaatcaatgaaatattaagcagttataaacagaatgatgtaaacatttttcaaaggaaattttatttaagttaggtttatatagctttttctctttcaaatgaaggtaaatgcactgatgagcagttcaagaaaaaaaatctaaactgacagtaaaattgcaaatgaaattaaggaaaaaggaacagataacacaaaataattttaaagattctcttctttttaacaattggacatttaaagttcctggaagtatagttcacagcaaacattttaaatctgtcttatctatattaataaaacattctaggcttgctttataagaaaactttttagaacgaaatataagcagttttagacttccagatatagcttataataattgtctgtacttgccttgcaaaattatattacaagaagaagcacacttgttatagaagtgctgaattgtatggaacctaaatctgtcaagttacctgtctttcaggtccgtctccccacctaccagacctcattatattatcccgaaaagaacacgatctctttaaggctaggcaagtattgcgctgatgagccagggactgcccaccaattggcaggcccattgggtgataaatgtccaaggacctctaggctgacgacacatttttcatcattaatccagcctattgtaaccagggccactcacattgattcggactagggggcatcatctgctgttaagagggtgatgactcgctaaaaatgaaggcctgaaactaatcaaatatatttagagccttccctggcaacttgctgggagagcagcagtagacagctaataggggagccccagacaggtagcgcggtgctcaccatgctttgtatgggaatgtgagaaatccatttggaagcctgttgtgtaattccagctattatacattgtagtacgaatgtctgtaggattagtccaatactacggtatttgaatgttgcattaaaaatgtagttgagaaataccctgctttttttttttttttttaacctggaactcaattacaaagaacagagaattcgcaaacccagatctctttggaattgctaaattgtttttgtgtttttgaaagtttgcaacagatggtttgagacatatgcttaatatttattttactgaagttgcaaaatttgatgaggagggcatcttttttttttccatttgcagaactcaacaaatagttatgttttgctcttttatactttttaaaacctaattaatgtgtacttaatcagaatatacttaaatacattgtggcagttcaagggcatatgtacatgttatttattgatttttattattaattcatgcatatatattcattttagataaatctttattattttaatttgcattaataaaaaatggcttgagttaagtcataggtggagttgcaaacttgtttgccttaggcaaatgtagaaaaatatgttctttatttcctgcttacacctgattaagcaaaatcaggtacaagtaggaaatagatttaactgattagactcgttcaatggaaaatttcacttatatattgagcctaatatatcaaaaaagggcaaaatatgagaacaatttggcttaattaaaaaaaaggagacctaatgaaattgcttttgataaagaagaaggtagagaaaaaaaaaacaagaaaaagaaaaagtaaaatgaataatgcagaccctccaattgttcaagcagtcctaatgttctacacaggaaaccactatcttctaaaatattttatggaatcatgaaaaaatatttctgctgggtgggaaggcttccgtgtgatttctcttgaagaaagtcttcaatcccattttgaaatctcaattcctccaaattccaaagctgaaatttcacacctttcatgtttgcaagttttaatgagaattatatgtatacttaggtatcaactgcttctagtgttggatgagcttaggtggaaagcttcattaatgagcaatagacaacctcactgaatctacttcgcaatgaatattcagtctggagttcatcttaactgggtccatgaggcacactgccaaaaagcaacttgctattaagcatcaggtaggagcagaaaagagactgggtaaaataattacgttctttaaaaaacaagtttgattatggaatctatttaggtcctgttggttctagtgaagttgagtcagggctagtaagaaaatgtctggaaaaagaggaactgatttgaacactgctgacctttatgcttctgccatcagaaagggggtgagacttcaacagccaatgcaaaggaagctgagaaaaaatcaatttagctttctctgctagacagaataaaggtctctaaagatatccatgttctaattcccagaaaccgtgaactgttattttatggctcaaaagggattgtacagatttgatttaattagggccttgaaatgggaggttatctcaggttatctgggtgtggccagtctagttacatgcacctagaatgtggagaaccttccccttttgtattcaaagggagatgtaattatggaaggcaggtcagagagatacaacattgctctctttgaagatgggggtgagggggaatgagctaagtctatttgtgtatttgtactccaggccctagctagaatgccagcttcacaggggccagaattttgtcctattcacatttgtatcactggcacccagtacagtgcctgacacatagtaggtgcttcataaatatttgattgaataagtgaactagtgaacaaatgaatcgattactacgggcacagtttttcaaattttgataacccataagcataaagaaattgcatgatctccttgttacttacattctttatttataaataatgtctattcatcatacattaaagcaaggggtgattgatagagaatagcaggaaggcctggtcagggtggtcagcactgagaaggaaacatttaagttgaaactcaaggatgagaaagactcagtcttataaagacctaggggaaggaaattttagacagcaaaaaccacctgcttaaacttcctgagatgaaaaagcagttggctgatttaaagcaatgaaagaaggtccggtggctggagagcagtgaacaaaggctagagttaactaatgggaggttagaaggtcattgtggcaatgtcccaatagtgggacacttgaggaccaaaggaatgagttcagattgtacatggctttttcagccgggccccaaaatatttcttagaaagacattttatttacggccaggcgcagtagctcatgcccgtaatcccagcagtttgggaggcccaggtgggcggatcatctgaggtcaggaattctagactagcctagccaatatggtgaaaccctgtctctattaaagatacaaaaaaattagccagacatggtgctgtgtgcctgcaatcccagctactcgggaggctgaggcaggagaatcgcttgaacccgggaggtggaggttgcagtgagctgagattgcaccattgcactccagcctgggcaacagggcgagactctgtcctaaaaaaaaagaaaaaagaaaaaagaaagacattttattttaccaagtattttgtaaaaatatgctctatgttaatgtccttggcattcaatggtccctaccctcaaagattccagactcaagggagacaagtgtgtaaacagataaataaaatacagggtgatacatacaaatgacattgtaaccaacagcaatgattcccagcaggataatattcagtggaagataaagtgtttgctcctctggtgaaagatattttatcatctcatgcaagattccttcctggatttttatctctttgaggcagtacccactccttcactttttcatgcaattgttttccctcttattttgccataccttggagtttttatctaacaagtcttaaatcatcattgcctgtttcccttggaaaccaaggagaacctggttgaacaccagttggggaaatagggatgttgcctgagcttgcagatggtaggagcagacacagtcagccaccagtctttaaatgacggtggtcaggaggtgaccagggagccaccacaagcatattcagagaaaaatcatataggcaagttcagctgtttttattacaggttgaaagtcagtgatttcttagccaaaatggttgatgtcttgttctttagctgattcatctattcatagcggacactcagtgactgaggctgtttttattctgatggactcagtcaccattttttttttttttttttttttgtgacagattctcactgtctcctcaggtctgagtgcagtggtacaattacggcccactgcacctcagcctcctgtgctcaagcaatcctcccacctcagcctcctgagtaggtgggacaacacgcttgtgccaccgtacctcgctaatttttttttttgttgtttatagagatgatgaccccactatgttgccaaggctggtcttgaactcctgtgctcaagtgatcctcctgtctcagcctcccaaagtgttgggattacaggcatgagccactgcacctggcctaattagttattctttatattccattgaaatatactcttagagatattgtaatggaaatattcttattacatattattgcatgcaacaagtaagtgaataaaagagcaggattttatttatataaatttaaaaattatacacttttagatgtataagtatgtataaaaacgacattagaaggagacacacaaagctatctactatttgaaagaagattgcatttggaaggtgttatgaatgactttccttctaacaatgtttttccaacattttaaaatgtagtagtaaagaaatatatgctaataatttgtgtgtatgtatatcctaactaacatattttatatatatatatatatatatatatatatatatatatatatatatatatatatattttagtttctataggtaaagggaataaagcaggaaacatttgaaagattccaaatctggttacttttggtaggtgtcgttattattaaatcaattttagagccacgaagaaaaacacaataaatgcaacttttaaaaatttcaaaaattaaatgggtatcaccccctcatcagtcatacaaaagttttccaaaaacaatatttatattgtgttatgtgcaggctgagggtcccatgaacagttcttttgtcttgcataaagacgatgctcctagtctacaggcagaccagctgttctttccattgtaaagctttatcagaagggctatagttcagctcctttcttagtcaccatatgactttggacaatgaaaatgaaaacaatcacaatgagaatgttcttaaaaggagaaatacctaaaagccattttattttctgagatggtatatggtgtgttagttaccagtaactggagggctgatatggttaagcacattgtgtctgaataacataccaactggcaagcgagggttaccacagacaccataggccaggcacaccttttgcccaccaaggcctcaaattccaggcaatgcataagtacacagtagcacaagtcttttggctgaaaggattatatataattcgaatgcaattattaaacttgctacctctgtcattgctcctgttctttctagttatcatatatgaagctcctactaggtgttcatcattatcactgacctaactagtgaagctatatgacttcattattcttataacaactttgtagggtaagatagtattaacctccttatgctcagtgtggaaaaccaaagctacagagattttatgtaacttgctcaaggtcacactgctcataaaatagaacaacctggagttgaacccagaactttctagattttgtgctctttctacaacttcacattctttttctttttagtgagggaatacctgaccatttcgccactaagaagttttataaatgttataggataatgtaagtggaaaatctttccagaaagcagcaaactccattgcagcgatttgtgcttaactgggaacttgagcacataataacaattacagtttaatttttcttattttttaagttatatttatgatgttactctttgtgcctctaaattgatttaataacaaggccgctgaacctttgaagaccaaggaacatgataaaatattttagaaactcatatatttttacatttgaagatataatatcaatttttcatatttaagttttacataaaagtatgttggtctgtttcctttcactgtatgtgacattgcaatagggcatttatttctgtgtgtcttagcatgtgcatattgaactgaacttgtgcatattcattgtatttgttgcctaaaatttatataatagctggatcttgattttgaagtcatgggtattatttccatgaggggaaaaaacacaaaaaactagacttgtattctaaaatctacagtaagaaacggtgagatataactgccaacaaccagcttcctaaatattgtttatctttagatttttgccttgatcttcaaggacaaaacaagttatgggtggcctaatgggttttactaacttaaaaattgtacatttagattactcacaaattcctaggattaaaacaaattatatatacaagctatttagagctaattgaggagtgtgtatgtttctcaatctacatttttaattaaagcaatagctttaattcctgcatgcctagataggtatgcacattttagaagtcaaagaaagagtcaagaatagtatcaacgatcagagggaagccatccaactgtgaaactactggtcattgagttttttctgagttttaaccatatgtgttaatagcatttgttatacaaaatgttgatcattgtgactgtacaaaatggtatcaacacattttctgcagtgcacaacacttctacctcatgatactttattctaatttgctttatctgattacatctacattttagagtgatagagaaatgctgaatggtttgaagaaagtcaaattaatgatacttctggaggggtgatatagtaacaactactagtgtttttaatatacatctgtcatccttttcattaaaacttagggaaatgagctgggaggaggttgttctgaaatatagttatttctgtccttgtaacttcatcatttgctttaaaaattattattcatagataatttgttttttcttagcatgagtaatgaaatctaagaaatctaagacagccctcaacttattacttgactccccgacttcattcttttccatcttccttcctctattctctctttccccattcccttccctccttccttcttcctcacattcttcttctctttctttcttctttatttccttcattcatcaaatatttattatagtgcctatcaggtgcctccctgggtgatggtagcagcttcatgaaatgaaatttttcaccttctcaagatcacatgaccaagtttaaggcaaaggccttaggacagaaaatactcatccaggacagtttctagcagagctgtggttccgaacttttccagcagagatgcccttatccacagtgtattttagcatgtaggaaaacataatctcagccactcacaggaatgtagctggattggttggcagcagagagctttcaatatcaagtcatggtgtaaagtcagttgggatttgaagggaggtatgtctccctatcatgacgttttgttttatgtccagcgaatcaataaaacaagtaatttattgttccagttccaaatatgcttaaagaataaaagcactgcacataaatgtgctaccctaattgtgtgaaggatttatgtgatttgtaaaatattttttgctagatcactttatccacacttctgattgtgttgactaacaaaattaagtaatctttgatgcaaacatgtcttgagggtgattgatcacactcagttcttgggggtggggtactgttacggcatattgagaatttgcaaataatcttaggttaagcatctgtttttttcttagactgcttactgtgtaaaaataaatcaggttttatatctttgggaaggaaaacctgaataaggaagattgatgtgtaaccgagttatcggaagccaatgatggtgctgaaatttaaaatgtcagttttacagtgtttgaatatagtttctctgtaaaagttactgaatcagacttgtctttttcaagaaaccaaatgccaatttattattcacatagatttcattttttcgtcccttatactacttcacatttttattgaaagaggcttcgaggcttctctttacaagacattttgataatgattgtgttgatagtggcggctgaaactgccgctgttggaattgatttagcagtattttctcattcagtttttgctgcaactctatgagacaggaactttattcacaccgattttgcagataagcaaactgaagtacaagtgaattatggatgtcttcaaggccacacagcttccaaaacttatgcccttaattatgatgcaaagttgcctctctgcatggaaaaagtaactttaataaaagtaaggcctctcttttggcaactatctcttttaggataaaatacagcccacaatttggcctggccttaacctcatgaacacaacttacagaggagataaatgtgctttatagtagaaagtaaataagaatgactcaccatcttggttatgtaaaatatattgaggtctattttgagttagggctcccagcaaaacctggtttaattcttcagtatcctaggaggaactagagatgtaggttcagcaacccagcacaactccatttttacctctgaacctgcttcctcacaatcaatagtaattccctgatcataacatggcattcagtgcatgcaactaaaatatgttactttttttttagcaaaatatgctacttttattttgttcacattatccaaactgtaagaatttttactttaaataaattatatttgatgcttaattgatagatgataaagaattaaggttcagctttttttgtccctcaacaaatatgtgaaatcatttttatgatgcatttatggcaagagttttgtagctttaagtgccatgtttttttgttaggcttttataattttaaaaatctatatgtttaagtttgtattttgaaactttttagacttctaggcctcccttcatttctaataaacatagaaaaatagttaataatttttctagaatatgcaattttcatccttccttttagaggtccaattgactatccagtgggccacctgacagcatgttttataatttagtgttttctctcgaattgtaaatgtgtccaccacaacaaaaacatacgcttcaagacagattatccatgttgttttgttgaaaggtgtaatactgcccaattaaattaactaaaatttaggtagggagataggaatgggtcaagattcgtatcagcagttcaactgaaacgcgacagtccactgattccccttgcggggcctgtgacaggggtgtagctcccctgttcagttgctgcggctgctcagacccctgacgggaggggagcacagaccggcaggtgcaggagccgggcggggcaagtgctctgggctgcagccccgtggtaggtagtatctaggagtggatgcctggggctccagtgttgcaatgctcttttagcctttctgtccgcagacagcttaagtgttaaccagctcagtggaaccattaccttttcaccagggcagagggctagtgtgacagctttctgtatcctgaattcttgtccagtgtcccagaaggatcgggtcacacatgggcttgaaggatgaatttattgagtggcggaggtagctctcagtggggagctgggcgggggcaatggactgggaagatgatcctcccctaaagtttggctgtccagcggccaaactcctctctgagcacccccagcagaactcagctttgtgttcacactccttctcttctctctctttctctgccgtgccgttctgctgttcatctgcttgtctctccatctccttgcctccttctctgctcctggagcctggggttgggagtttatgtgggtacaggatggggggacatggcaggccaaaaggcaactttttgggcttgaaaacagaaatgcctattccccctaagggcagcaggtatccagacttgagggtggggcctttgcatgggaaccttcctcttctaccgtatttccctgtctcctctccatatcacatgcacatgtagtcttaaaccagcttaataagttgcactattgtagaaacaattttacttttttaatgtatgggcaaaaataatactgccgattatatttcaaagataaggaactcactttgagtgaagataaggcaaatattgaaatatatagaaaggttctcacttgaaacatgcgtaagatcagggttacagggaataagaatgtgttagtttcctagggtgactgtaacaatttactacgaaatgagtggcttaaaacaacagaaatgcattatcttacagttttgggggactggaaatttgaaatcaagggacacactccctctgaatgccctgaggaaggatccttctttgtgtctccattttctggtgccctcaggcattccttggttgggctgcgtaactccggtctctgccttctcttcacatgctgtcttcgctttttttctgtcttaacatggtgctcttcctgcatctctctctctctctctgtttttttcttattttattttattttgagacagaattttgctcttgttgctcaggctagagtgcaatggcgcgatctcagctcactgcaacctccacctcccgggttcaagcgattgtcctgcctcagcctcccaactagttgggattacaggtgcccgccaccaagcctggctaatttttgcatttttggtggagacgggtttttaccacactggccaggctggtctcgaattcctgaccttgtgatccgcctgctgtggcctcctatagtgctgggatgacagggtgagccaccgtgcccagacctttcttactataagactccagtcttattgtattaaagaaccacctacccaagtatgacttcatcttaacttgattatgcctgcaaagactctataccgaacgtggtcacatttataggtactgggatttagaatttcaatatatctttttgaggaacacagtctcactcataaagaagataatatatatttttaaaatttttatattatttctttttggaataaggtaattttaatgctagccttttttgcatgaaattaatttagtagtactctcatcagaaaataattacttggcatttttaagtttttgatggacattctaaataacgttgcaatattcttgaattgatagagaattcaagaattctgtaatccattgatgaaaccattcaagaattccagaatccattgatgaaagaagaaaaacatagacaaacagctcaaaccaaggctatgcattatgtgggaccagctcgttaatggtacacagtattttttctgctttcattaatggattggtgatttcaaggacactaactaacctttgcatcataaacattttgtacctataaactacaaataaagaatatagtttaaacaatcgtatgcaaatatgggcataatattaattgaattgatttatttggcaacgcaaactatagttataaataatataaagactatttttatttatgttttgtttttctcacttaccacttatctgcttctctaatcgtctctcttataagagatctaaaattttgaaggagtttgggatatgggagcatttaactggacaattatttctttttctatctattttagttagaatcattctaaaataggataaactttatatgataccaaaaatccattcggacagtcacatttttcatagtaagcgtcaatttaaactaactcttctatatgacataagtcagaattaaagttttgatctgaattatgtatttagatgcttaaatgcctctcattaacttaaggtttttgctaatgcttctatcttttgttcacttagccatcattttatctttaaaatatgcataggaatgtacataagtggagtcataacatcatttttagataaaagttaaaaatgagactgtaattcatttttaacatatttgtatgttgtggctgtacaaaatccaaaagtattttcactctccaatggggatgatgtgcagctcccaaaatggaaatagaggtaacgttccagtgatcataaaaggacagtcataagcttttagtgtgcagcagttttaagactatcctcagttaatgtgaggcaattgcagattcactgcatctgagtttaaacctctcactactttgagtgaagtctattaatgatatgccttccatgcagctgacattttaagatccttgctgcttttcaaaacgcgtgggcactaaagatgtcttcttgctcttgagaattgatttcatacacaacaggagcttgtgatggattcgctcccactgtgggaattgtccgtgagtatccgagggcaggaattggctcagataaaggatctatcctgagcgctctcctgtaaagagtaagatgtgcgcattagaactagctgatgccgagtttaattcccagtctcttttgtgattctaaaccatttgacaagcctctgcctagtgtgagcagattgatcaggaaatttattcatttcatgaccttgtctactcatttatagctcttaaaaaagtacctcacctggaactcaaagctccctaagaatttaaaagttatgaatatatttctttcatctataaaactacattttgctttggataaaatatctagcatttgaggagaatttcatgttagcgcaattgattaggctctatgttacatagatacatcataaattgcttttataataaatttatgttttcttttgttttaaaggacatggggattgagttgcaaccaatagatacagttacacaagccggcatggtcaatagcatgtggatagctgataacaaacagtactagaattgtcagtgtgttttcattgactcctgacctgttaaaacttagctcctgaagacccattagactggacaaaatatacccatttgaatggacagaactaacaggcagatactattattataaagccataaatgagcaatcagtctcatatgtgtttgaagatagactatagattatggttctatgccttatgatacaattactgggttatttgtgtaatttgaaatttgggttttaagaaaaccatattttcttatttcttgaggagaagaaagaaaaccgatatggttggtcatagtaggtaatgagaaaaatggcagaagatgagttcagagagaaaggcatgtccagatgacattgggctgtgtaggttaaaaccttagtacttggacttcattttatctgccaaaagaaccactggagtgctttaaataataacctgatatgtttcatatatttttgagagatcattatggcttatgtattacaaaaaattctgcttcatttctgacaatttataaaatgatttcaagaaacagatctcacatgtgattctttgaaaagcaggcacgatcttctaaagtaaataaagatttttgtacagatattcatctattatctattaaaaactttattccagaattatctggtaatgttaatttcacacagccaatataaacagtaatgaagaaaatggaactcagttatttttgtttcatgatctatgaatctaagaccaaataaattataaaaaataactattcatttgccttagataatcaaaaaacatctctgttgctgattatcaaaatatttatattacaaaaaggttaatggattagtgtcacataaaaacatcttaactgaaggcaaaattgcataacagtattttacttttgcaatgccatctaattttcaatacgttcaaggtaaaaaaaagcaataaaatggaaatggcaataaacataattcattaggcacacactccactttatgagatgatgcaatgaatgtcattagacaatcaatttcttccctggttggtcatttaatggtagaaccagtgggccgattataacgtgggtatgccatattgacaaccgaggcaaattaatatagtggaaaggacactcgtttgagatttaggaagccttgatcagcctattcaactaaagagttgcacaaaaaccatgtttgtggagttagtttcctaatctacaaaattagaggattgaagtagatagtagatccaaaatgctggtccaaggatgaatgtcaggctggccttatcagaattattaggataacttttaaatacaattgattcccagattcttcactcagaaatacttacttattgtgtccagagtggggtctggacagagatttgtaaaaatcacccaggtgattctaatgtgtggggatcttttacaacagatggaatgtatgaccccaaaacatctttctttttgaaagaaaaatctttgaattctgtgtttctctaggctgtttccaagaatctttacattataaattaggctacattacatttgtggatttggtactaaagctcaagatttttttcttctgctttggaggtaagcttatgctttttctatagttagcagcatcctgcacagacatttgtacaaatatctcaattttccttcttcattgtggaaaattgagacatttgtacaaatatctcaattttcctccttcattgcagaaaatggcctaaaaatttgcatgcattttagcctagccattttcttctagtaattattcctaaattatgttcaaaaatgtatgcataattaatgttcttcaacatattttgtaatagtaattaatttaaaacattacaaatatctacaaacaagacataggttaaaaagaattttatgataataatataatattgttaaaaattgtcatataacaatacaatataccctacaggacttaaaatttctgttctagaacaatatttattgacataaaaagtattcaccatatattgctcggtaaagaaacatcaaatggtattcccctatgtttctaaagatgaaaaataaaatctcacaaataatttttttattatactttaagttttagggtacatgtgcacaacgtgcaggtttgttacatatgtatacatgtgccatgttggtgtgctgcacccattaactggtcatttaacattaggtatatctcctaatgctatccctcccccttccccccaccccacaacaggccccagtgtgtgatgttccccttcctgtgtccatgagttctcattgttcaattcccacctatgagtgagaacacgtggtgtttggttgtctgatcttgtgatagtttactgagaatgatgatttccagcctcatccatgtccctacaaaggacatgaacttatcattttttatggctgcatagtattccatggtgtatatgtgccacattttcttaatccagtctatcattgttggacatttgggttggttccaagtctttgctatcgtgaatagtgccgcaataaacatatgtgtgtgtgtgtctttatagcagcatgttttgtaatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctctagcacctgttgttgcctgactttttaatgatcaccattctaactggtgtgcgatggtatctcattgtggttttgctttgcatttctgtgatggccagtgatgatgagcattttttcatgtgtcttttggctgcataaatgtcttcttttgagaagtgtctcttcatatcctttgcccactttttgatggggttgtttctttcttgtaaatttgtttgagttcattgtagattctggatattagccctttgtcagatgagtagattgcaaaatttttctcccattctgttcactctgatggtagttccttttgctgtgcagaagctctttagtttaattagatcccatttgtcaattttggcttttgttaccattgcttttggtgttttagacatgaagtccttgcccatgcctatgtcctgaatggtaatgcctaggttttcttctagggtttttatggttttaggtctaacatttaagtctttaatccctcttgaattaatttttgtataaagtgtaaggaagggatccagtttcagctttctacatatggctacccagtttccccagcaccatttattaaatagggaatcctttccccattgcttgtttttgtcaggtttgtcaaagatcagatagttgtagatatgtggcattatttctgagggctctgttctgttccattggtctataactctgttttggtaccagtaccatgctgttttggttactgtagccttgtagtatagtttgatgtcaggtagcgtgatgcctccagctttgttcttttggcttaggattgacttggcactgcaggctcttttttggttccatatgagcttgaaagtagttttttccaattctgtgaagaaagtcattggtagcttgatggggatggcattgaatctgtaaattaccttgggcagtatggccattttcacgacattgattcttcctacccatgagcatggaatgttcttccatttgtttgtatcgtcttttatttcactgagcagtgctttgtagttctctttgaagaggtccttcacatcccttgtaagttggattcctaagtattttattctctttgaagcaattgtgaatgggagttcactcatgatttggctctctgtttgtctcttattggtgtataagaatgcttgtgatttttggacattgattttgtatcctgagactttgctgaagttgcctaccagcttaaggagatttggggctgagacgatggggttttctagatatacaatcatgtcatctgcaaacagggacaatttgatttcctcttttcctaatcaaatcccctttatttccttctcctgcctgattgccctggccagaacttccaacactatgttgaataggagtggtgagagagggcatcctgtcttgtgccagttttcaaagggaatgcttccagtttttgcccattcagtatgatattggctgtgggtttgtcataaatagctcttattattttgagatacatcccatcaatacctgatttattgagagtttttagcatgaagtgttgttgaattttgtcaaaggccttttctgcatctattgagataatcatatgttttttgtctttggttctgtttgtatgctggattacgtttattgatttgcatatgttgaaccagccttgcatcccagggatgaagcccacttgatcatggtggataagctttttgatgtgctgctggattcagttggccagtattttgttgaggatttttgcatcaatgttcatcagggatattggtctaaaattctcttttttttgttgtgtctctgccgggctttggtatcaggataatgctggcctcataaaataagttagagatgattccctctttttctgttgattggaatagtttcagaaggaatggtaccagctcctccttgtacctctggtagaatttggctgtgaatccatctggttctggactttttttttggttgttaagctattaattattgcttcaatttcagagcctgttattggtctattcagagattcaacttcttcctggtttagtcttgggagggcgtatgtgtccaggaatttatacatttcttctagattttctagtttatttgcatagagttgtttgtagtattctctgatggtagtttgtatttctatgggatcggtggtgatatcccctttatcattttttattgcatctatttgattcttctctcttttcttttttattagtcctgctagcggtctatcaattttgttgattatttcaaaaaaccaactcctggattcattgattttttgaagggttttttgtgtctctattcccttcagttctgctctgatcttagttatttcttgccttctgctagcttttgaatgtgtttgctcttgcttctctagttcttttcattgtgattttagggtgtcaattttagatctttcctgctttctcttgtgggcatttagtgctataaatttccctctacacactgctttgaatgtgtcccagagattctggtatgttgtgtctttgttctcgttggtttcaaagaacatctttatttctgccttcatttcattatgtacccagtagtcattcaggagcaggttgtttggtttccatgtagttgagcggttttgagtaagtttcttaatcctgagttctagtttgattgcactgtggtctgagagacagtttgttatcatttctgtttttttacatttgctgaggagtgctttacttccaactatgtggtcaattttggaataggtgtggtgtggtgctgaaaagaatgtatattctgttgattttgggtggagagttctgtagatgtctattaagtctgcttggtgcagagctgagttcagtttctggatatccttgttaactttctgtctcgtttatctgtctaatgttgacagtggggtgttaaagtctcccattattattgtgtgggattctaagtctctttgtaggtctctaaggacttcctttacgagtctgggtgctcctgtattgggtgcatatatatttaggacagttagctcttcttgttgaattgatccctttcccattatgtaatggccttctttgtctcttttgatctttgttggtttaaagtctgtttaagcagagactaggattgcaacccctgcctttttttgttttccatttgcttggtggatcttcctccatccttttattttgagcctatttgtgtcgctgcacatgagatcagtttcctgaatacagcacactgatgggtcttgactctttatcgaatttgccagtctgtgccttttatttggagcatttagcccctttacatttaaggttagtattgttatgtgtgaatttgaacctgtcattatgatgttagctggttattttgctcattagttgatgcagtttcttcctagcctcaatggtctttacaatttggcatgtttttgcagtggctggtaccagttattcctttccatgtttagtgcttccttcaggagctcttttagggcaggcctggtggtgacaaaatctctcagcatttgctcgtctgtaaagtattttattcctccttcacttatgaagcttagtttggctggatatgaaagtctgggttgaaaattcttttctttaagaatgttgaatattggcccccactctcttctggcttgtagagtgtctgccgagagatcagctgttagtctgatgggcttccctttgtgggtaacccgacctttctctctggctgcccttaacattttttccttcatttcaactttggtgaatctgacaattatgtgtcttggagttgctcttctcaaggagtatctttgtggcgttctctgtatttcctgaatttgaatgttggcctgccttgctgggttggggaagttctcctggataatatcctgcagagtgttttccaacttggttccattctccccgtcactttcaggtacaccaattaaacatagatttggtcttttcacatagtcccatatttcttggaggctttgttcatttctttttattcttttttctctaaacttctcttcttgcttcatttcattcatttggtcttccatcactgataccctttcttccagttgatcgcattggctactgaggcttgtgcattcatcatgtagttctcgtgccgtggatttcagctccatcaggtcctttaaggacttctctgcactggttattctagttagccatttgtctaattttttttcaaggtttttaacttctttgccatgggtttacacttcctcctttagctcagagtatttgatcatctgaagccttcctctctcaactcgtcaaagtcattctctgtccagctttgttccattgctggtgaggagctgcgttcctttggaggaggagaggtgctctgatttttagagtttccagtttttctgctctgtttttttccccatctttgtggttttatctaccattggtctttgatgatggtgacgtacagatggggttttggtgtggatgtcctttctgtttgttagtttttcttctaacagtcaggaccctcagctgcaggtctgttggagtttgctggaggtccactccagaccctgtttgcctaggtatcagcagcggaggctgcagaacagcagatattggtgaacagcaaatgttgctgcctgatcgttcctctggaacttttgtttcagaggagtacccagccgtgtgaggtgtcagtctgccactactggggggtgcctcccagttaggctactcgggggtcagggacccacttgaggaggcagtctatctgttctcagatctccagctgcatgctgggagaacgactactctcttcaaagctgtcagacagggacatttaagtctgcagaggtttctgctgccttttgtctgtgccctgtccccagaggtggggtctacagaggcacacaggcctccttgagctacagtgggctccacgcagttcgaacttcctggccgctttgtttacctactcaagcctcggcaatggcgggcgcccctcccccagcctcactgccgccttgcagtttgacctcagactgctgtgctagcaatgagcaagactccgtgggcataggaccctctgagccaggcacaagatataatctcctggtgcgccgtttactaagaccattggaaaaatgcagtattagggtgggagtgacccaattttccaggtgccatctgtcacccctttctctgactaggaaagggaactccctgaccccttgtgcttcctgggtgaggcgatgcctcgccctgcttcagctcatgctcagtgcactgcactcactgtcctgcacccactgtccgacattccccagtgagatgaacccggtacctcagttggaaatgcagaaatcactcgtcttctgcgtcactcatgctcagagctgtagactggagctgttcctattcggccatcttggctccaccccacaaataatttttttaaacaacctaatgcaaaagtaatttaatattaagctacttctatctctaaagaggtggaattacaaaatattattttgtttttatttagaatgccatatttttttcaaaatatatatttattgcttatattactgtatttaaaaaaaatcactcttatcaagtgtgtcagatagattagggagaccagggcataaagccacttttattcttctcaacctgaaaatgtaaagatccatttcaagacaccaagtaattgatgttagagcttcaagggacaggacagagcttgtcaagggaaaattagagtggtaaagctgacacccatacatgcaaggcccttaatctttctttctttctttctttcttttttctccttccttccttccttcttcttttcttttctttcctttttttcttttcttttctggagtctcactctgttgcccaggctggagtgcagtggtgcgatctcagctcactgcaacctctgcctcctgggttcaaacaattctcctacctcagcctcccaagtagctaagaccacaggtgcacatcaccacgcctggctactttttgtatttttagtagagatggggtttcaccatgttggctaggctagtctcaaactcctggcctcaggtgatctacctgcctcggcctcccaaagtgctgggattacaggcatgggccaccatgcctggccgatttttctactgtcaacttgaaaataagcatacttaatgtcagcatggacctgatttagccatgtaacatttggctgctgaaaaagcatgatgatgtgttttttgctcctggtcatcttctgtcaatagttctttattttgtcctagtttcatgttgtaattaatggaattatatttgaagagctcaaaatgaaatgcttaattatattcagctgcaattacagtgattaattgatccaaacttattagcatgacacctaaaggaaaccagttatataaaaattgtaggaggcaatactttgagtatgacactcatgtgagctagctatctagattaattctattttattaaattgtctaagttttacagcttctggaattcatattggaaacccagggtctagactaaactgttatttcataaacaaggacaaaagaaccgaaaaaagtaaatgaaatattacagacaggagtagttctccctcaaatgagattatctcattattttgaaattatttatatgtttcccagtttggatacattgtcagctcctgattatccatgccaaagatagctttaaatctccaaaaagagattttatcaaatctatatgcatttcccaaatcccaagaaaattatgagtcatagtttagagcatagacatcctgtttcagttaatgctttgtagggtctaatcatcatgtatggatgtgttcaatccccttgctctggatgctttcactggactgggtattaaaaagcaaattcttcaaactctgtacttccaccatgcctgcccacctcatttctttaatatgccaacctccttctcatactaatgtattttgtacatttctgcctggaatttttctcgatccttaggcttttcttgtttaattcctaccatccttcatagctcagctgaaattatacttttttttttttttttgaaatggagtctcactctgtaacctaagcttgagtgcagtggcgtgatcttggctcacgcaaactccacctcctgggttcaagcagttctctgcctcagcctctcaagtagctggtattacaggcacccacaagcatgcctggctaatttttgtattttttagtagagatggggttttaccatcttggccaggctggtcttgaactcttgaccttttgatccacccaccttggccttccaaagtgctgggattacaggagtgagctaccgtgcccggcctgaaattatactttcctgtagaggaagtataattaggttatcatgtcaccctcttcttttccattataagtattctgcagtcgtagtgacacatttatttgtgactgactaatgcgtctgacttttcctttacaatggaagtgctacagtatcaagagctgcacattttcattgacactctacatccagaatccaacacagaacacagcacattgaaagtattttattaaatgttcttgaatgagtggaattttcatttttctaatatcttttagcagtatgtttgatcgatttttgtttgttgtttgtttgttgagatggagtcttgctcttgtctcccgggctggattgcagtggtgcaatctccgctcactgcaacctttgccttctgggttcaagtgattctcctgcctcagcctcctgagtagctgggattacaggtgcctaccagcacgccccgctaatttttgtatttttagtagagatgggggtttcaccatgttggcaaggctggtctcgaactcagcacctcaagtcatctgcccgcctcagcctcccacagtgctgagattacagacaggcgtgagccaccgcactgggcctcgacttctttttagatagagtgcccattgttgctccttttcatccatctagtagttctccttcttttgcaatttggttaaatgattataaccaaacttattaagctttattttatgtgtaaaattttgagagaatcatcttgactgtgtgtatgtgtgtgtatatatatatatatatatatatatgtatctgtgtatatatatatatataatctgtatatatatatatatatatatatatctgtgtgtgtgtatatatatatatgtcacctgagtgctttcttttgggggtaaagtatttgactgagacactaaagatttgaattgttgttctgcattttactattgaccatgggccttaaggaagtcatttagctcctgttagcatcagtttgctgatttgtaaaatggttaaacagtagtatttgccgtctacaagtcacaaagctattgtgaagatcaaatcacatatgacattcaaaaatgctttgcaaatgttagccctttactaatttcagtccatatcaaaaatccacattgtgtagaaaatttgtagatctttgaaattacataatcttaaaaatatttgtgaaatacgagatgtagatctgaatttctttaagacaaagttctttagtaatatggaaacaatgacatatccaagcagaagcatagatggcaatagaatttgttcagaacatggcttcagaaaacatactaatagttctgtttttttgtttgtcttgttttgctttgagatggagtctcactctgttgcccaggctggagtgcagtggtgcgatctcagctcactgcaacctccgcctcttgggttcaagtgattctcctgcctcagcctcccaagtagctcggactacaggcacgtgccaccacgcctggctaatttttgtaatttttagtacagatagggtttcaccatattgtccaggctggtctcgaactcctgacctcatgatccgcccaccttggcctcccaaagtgctgagattacaggcatgagccactgcgcctggccgagaaaacatactatagcttttcacagacaaattggcaacttctccatacataaaaattacattttaactgcaaatgaaaatatagacatactaagagtaggtaaaaaattgattattaatttaaaattaatcattttaactcaatgctttacatatattaaaaagtattcatttatatatgtcattttttatacgaataaaatatttaaatattataatctctattattttaatatagttcaattagattccttgtggaaattataaatgattctctaaaaaaataaagtcattattctgtcaagatgattaaatggacattttcctaatcttctagttgaaccattgagtcttccagtgatgtatacttaaaatcatgtaagttataaataaactttcatggtaggtgtaactaacttcatctgactcatgaagagagattagtatctcttttatcatttagacgttaatgaactttcagtcctacgcagcaaagttacccattcatctttttgaaaaaaagatgaattattgttgaactcacctcctaagtattgctatgttgtataatagtagaaataatagtagaataatagtagaaaccatactttttctattataaaaaaatagaggaaatagattggaaaatataatctgaatgaagtcaaagttagcattgagtgttaaataccattgtcagtgtcctttacatatgtaatggtaaagctttccaatgcatcttgggttgcgtgagctaaatacttttggcaaggaaaacatcagttatatgaacactgcagacccacataggcctggtgtacagctttgtctttccatggctctagtggttcatacctctgctgcacttgttcttgactgggcaccctctgccagtgctgtgtgagctccccaattccttgctgtccttatgtggttccgtaagctgacatttcatcattcagaccaagtagatagaaggtgttgcttactcttttaaaatgagttgtataggattacattgttttatttgataaccttttggtaaatacagcagaaatacaacttcagccagtttaaattaaaaagaggcttttgttttaaagctagtaagggtgacactgatcgaatgtgaaagaaggaagcagaggctaatattgggattcaggctcaatccagtcttttgtgtatctcatatctacacctcccacaaatatttgttgtccgccccctcttctctctctctctgttttggtctctccctagattgatcttcttatatatcttcttgtcatgcatcttacctagtgttccccaaatgaaaataactcaatgactattctacgtcaagtgcccatccattcaccagttcaccaagatatgtaaaaacttggcagtttggaaaagatctataaaataacaattcccaaaagaaggggatttctgtgaagatacacaatagttgtccaaaaaaatatgctatatatttgttttaaaaaattgatagcccaatggactttttcttttttcttttctttttctttttctttttttttttttttttgagacagagtcttgctctgtcaccagtctgtactgcagtggcacgatctcggctcactacaacctccgcctcccagattcaagccattctcttacctcagcctccagagtagctgggactatagccacccgccactactcccagctaatttttgcgtttttagtagagatggagtttcaccatgttggccaggaggctctcgatctcttgaccttgtgatccacccacctcggcctcccaaagtgctgggattacaggcatgagccaccgtgcccggcccaatggactctcaatacactatcttactttaccctcctgtccaaaagcactaggtggaaaagagatgttacatttatttttaaaagttgagatatagatcatatccaaaacctgctatagaaatatactacattgtcaatatgaataattaggtatagagaatggcacctgcttaaaatcctttaatctcactgatttggtgtgtgttgtttccccagtgggttacatgttaccgataacctgtcagaatttgaatatcgcagaggattttcaaagtcagaagaactgagtaataaggagatgaaagactttttcagaagacttttttttaaatggaaacttatttttaaatatagaggaatgtaagaacttgcaagtaagagtgaattggtttgcaaagtagattctgttttcccttcatgtgagctttattggtttatattctcttcaaattttcttcatgtcatttggaaacaactgctgttcaaaaactatatcttcatatgcaagcatttactataaaacttttctttaatgtgtttaaagcatttctttttcacttaaacatttttcctttattttaagctagtgataagacagaatggtgatatgtccatttgcttcatttgatatgcacatttgttctatgggaaaatgtggtctactcctaatttcattttcgtttcctaaataagaagacccattaaaaagcagacatctggtgtacaaagcacttaaagctgtagctcccaaggagtgctttcttccctctttaaatatgcatgaactgttgttttggtaatccacttcaccctgtcaaaatagaatcaaatagaatatatgtgtgacctcttccccttctatcctgggaaaatgagtttcaagatcactgaggtgtacagtattccgaagccttcactttccgttttattcaccctgaaagctcttacagttacagaagcttaaagtttagctgaaatctactttaataatagctacactgttttagttatgaagaatgactctatgaactttaaatatttgaatcataaagaatgaatgtagactttcaaaaaataggctttgaaaggagtttaagaatatctgtaccttcattgatttttttatatcagttagagctcaaggtttttaatacagttacctcaaaaattctgtgtgcaaaatagttacatttaacggatattgaaactaaatatggttaacttattttcctaggagaagagaacaactaaaacaggcgcaataaacatttttctttttcagttgatgcacatttaatgtcagtttgcttccttgaaatttagacccacattccccaagattgagtcctgtagaatattaactttccatattcacctactctgttccatgcaaaaggatgacatgatcaaatggtacataccttgctttctcctatagattcataattgaaatttggatattatactttctaacaatgcttttagtaaatatatctgtgctagcttggttcacccaatttgcctaagtatatttaacacctaaacattaaagaaaaatcacttttgaaatctgtgacctagattatgtttatgtgcagattatatcagaaaatagtacaaaactttatgaagacaagagaagtatctcattttttcttccttctggtttggattgtttattttaataaaattatatcagtctgatttggttagcttggaatattgttttgttattgttctataagtagctgcattatccataatagttcatatatatcttatttgtgtgtgtcatcctcaatactgttcaaatattttaagggagacaaatggatacttttgcttttagaatctatttacaagttttattcttctaaatttcagtaaatgagtctgtgccacttctatgttttaaggtatttttggatttagagtacttctaaccaatgatcatgaaagtagtagtctattaattttaaatcatattttctaacattgtctattaatgtgtttttgacaaatgtgatgcctatgagaagacagcttcttcactagaggaaagtaaaaggagtttttgaaccttgatccaaatctctgaatttatttaccatgttgtcccaatcgaaaggcattgaacatagtttttcacaagccacaaatgtttgagtatcagagctgaaagattgcctaactaagtaaaatacagtatttacaggatgcttggggaaaagatatctggctaatttaaaattatgccagtgatattctttgcttatccatttgtgacaaatccttatcagccttagaaaatgcacataataaagtacagagaacaacatttgcttattctttaaacttatagtcttgtaatgctgcagtgctatcacaacgggtattaatgatcgttgtatttattgtatatttgagttaaatccatattaatcctagggtttatcttaaaattgtgtgtgtttctttgtttgtttgtttgatttatttggaaggtgttttttgtttttgttttattttagaactaaactcctcaaatgactttatttactagcttgaggtgtctttctcctaaaacaacagaaaaagtcatgatgaagggctgggcagaagaatcttgatagtttgaatttcaaagctacacagattatagataagatatactttatgttattagacatttatttttccctagataagaccgctgatagtggatgataagactgatgaataatatttgattagtcaagtttccatcaaatataggaaaagttttaaattgtagctataggtttaacataaatagccaaatttatcattatatgatttttttacttttattgtgaaaatttttaaacatagagtattagaaaaaagtagcataatgattgatacataatcatgagctagatataatcataagtaatattttcccacaatttttatctatccctcctgttctttactgtgaagtacattaaagcattcatttcactgctatatacttcattgttcacaaaatatatacagacctcttcccacaaaattattaaaatttattgtaggcactttgttttttaagtgggagataaaaaataattggaattactatgctcatgttgtttcattgtactgaaagcaaaaatggatttttttcaaagatatttcctcccattttacttttattaatagattctaattccgtcaactttgcgtaatatagaatgatgaaaaagccccttttcattccttctgatagcttttggattccattgctcagagaaagcttgtcttcaacaatatgctggaattgtgtgaagtcttgttatttttttttctccctgttcttcaaagtacaatttcttgaatgtacctgcagccgtgcattatcaggcaacctattttataaattccataataaattaaataagcacctctgtgggtcatttttgattaacctgatttaaaataaaatgatttactaaagatttagagggaggaaatactatgtgcttctaaatcaattctatgcatattcactgtcaaacaattgcatgtaatagtgtattaaatacacttaatagtgtaaaaaaagactcactgcaattgaattaacacttgcaagcttataataatgtttaaaagccacaaacattgaagtaaaattcatttttatccagaaatagaatttgtacatatgacttcctgctatggagattttatcacaggaagatgttcaagatgtttaatttaggacagcatttcttctaagttcagattataaggaggagcattttaattagaatagtatcatgagactcatgtaagcatatgatattacacatcggtattttccctatagtctggaacattactggaatgaaaatttagagatgcatttttacttctccagcacatgcaagaaataatacaacatgaatccttttttattttaggaatgttatacccacaaaacattgaagtatgttttaagttaagcaaacaacaagttttgaccaagaaaattagaaaattaaggttttcttagaaaacaaacaaaattatggcaagaaattactgtcctagtaaaataagatgaccctatatggaccgttgtacgtgaatatttatgtccttttttttttcagtttcacgtatattctttaatgaacacgagaatacagttttagttttcatttgatggcagttttcttcactctccatttcttcaccacctcctcctattttcttccccttttttctgctattcctccactcttcattacacctacatggcttagagttgctggtagattttggtgcccatgctaaaatttgaacagaaggaacagtataaagatgagctgaagtaaatcttgaacacctactattttgccttcttatatcatctcaattgacaaagtcaagattgcagactgccttgacttatgatggggttatgtcctgataaactcaaggtaagctggaaatattgtaagtcaaaaaggcatttaatatacctaacctacccaacatcatagcttagtctatcttaaacatgctcagaacacttccattagcctgcagttgggcaaaatcatctcacacaaagcctacaataaagtgttaaatatctcataaaatttaccaaatactgtactggaaagtgaaaaccagaacggttgtacaggtgctcaaatacagttgctactgaatatgtattacttttgcaccattgtgaagtcaaaaaatcataagtcggtgactgtgctcggttaaaaagtagtggttgctgaccaacttcatttttctttaacagcttcaattgtgatgtcaaagtaaatgtaacttttttcaacaaatttttgtcctttaatacaacaaaaatgttgcatcttaaaagcattttttaatgaaaagaattttaggcttacaattttcttgtaacagtggaaaatataggctctgattttcttttttttgtagtgcacaaaggtaccttttcttagtagttaagttgttttaactacctcaaaatataagttaaaaaataaaagcaagaaacatgggctaaaaatgatattgcaggtggtcataaaccgcagttaaaacatatgtctttaaaatattcacataagattcagacatagcattatacaactttttcattttgccttttacctccaattccatttagaacaattaagaaaaataccttcaactatattatttttatggcataaatgaatttgaacaagatatttcaaaaggtaaatattgaaaaaactctactgcaatgcattttgactcctaaaataggattgtgataaaataattaaattttgatattttaatgcacttgaagaaacacccagcacagcccatttctaaggaaagaacaagttaaggataacataaaatgaagttgactttttgtaaaggtgatcttttcacttttaaaacagcactcaatgattctgccagagacagtgtctacaagtgaaaacttgtttgtatgtgatgggtttgactgacaggttggatcaagttgaggtggggaattggggtggacaaaggagaggaaacaggttatgctattcactcaagtcaatcaaataacctgattgttctttcaactgccttactctgtcattgactgtcaagtcagtcaaaatagtgaaactagttttcgcatgtatgcagagatttattttatgacgctattacctcacccttgtaaacacagacataacaaatatctaagtccacatgttgaaaattatacacaaatattgcagatgtttatgggtgcagaggtatgtagaagagaaaacatgctgaacttaaagccaacactgtaatttcctaatgtttgacttcctatttgacagagactgatataattgatcaagcatacactaagatgcttctttagagaaacattcagcagtatttttctgtattatagtatccaaactagtaatatttacaggaattttatttttatttttgtttctttttttgagacagaggtttgctgtatcacccaggctggagtgcagtggcatgatcacagcttaatgcagccttgaactcccgggctcaagggatcctcccacctcagcctctggagtagctgggactacaggcaaacacaaacacacagctaatttttctatttattacaggaatattacagagagtttgcattaaatagctcagaaaacaaacagatattgtattacatgcacaaacacacacacacacacacacaccctttttttttaatttcaaaaattactttgcccactttttgatgtggttgtttgtttttttcttgtaaatttgtttcagttccctgttgaacaatgagaacatatgggcagagggaggggaacatcacacactgggacctgtccacctgtcccagggttggggaaaggggaggggtagcattaggagaaatacctaatgtagatgacccgttgatgggtgcagcaaaccaacatggcacatgtatacctatgtaacaaacctgcacgttctgcacatgtatcccagaacttaagtataataataaaaaaaaaacttgcaagattaaaaagaaaatcttaacaaaatccaaaaacactaaagtgagtcaataagaagacccaattatgtctgatctcttgaagttactctgctgaaatgctcaagtccaggttaacctcatcaatctaaatggattagcttaattcatttaaacttagaaatagttgaactactcatttttaggtctcatgcaatttacctgtgtgactcaacatcaaatctgtctgctaggttcatttggcatgttttgtccctaagatatctgccaaaccaatgcaatcaacctctcagaagcttttttcatatttaagaactgcttttaatttctaagccttcgccatggtttctgtcatgtatttctcacaaatgacagctactgatatggcagcagctattggttattgggagggagatgggactcaatgttatatagctatgtatcgttttgagattattatatgtacattacctaattctctcttcagaaacatcccgagagtattattactactattactatactccccagagtagtattaatactatactattaataacagtgtactataatgctaatattattactatactatgaacagataaatcagtggaggcttaaggacattaaaggaatggaccacattgcgccaggtgtggtggctcatgcctgtaatcttagcactttgggaggccgaggcaggtggatcacctgaggataaaattattcttttattctactaaaaattaaaaaaaaatatagccaggtgtggtggtgggctcttgtaattccagccacttgggaggctgaggcaggaggatcgcttgaacccaggaggtagaggttgcagtgagctgagattgtgccactgcaccccagcccaggcaacagagtaagggtaagactgtctccaaaaaaaaaaaaagagagagaatggaccaaattggactagctcatcatggtgacagaataggaaggggagaccagtgcttgctgcagtctggggcaccgccattctctccctgtgctgccaatttttcttccttctaggtgatatttatttcaacccgttgaaatcaagaggttattatttttactgacaatttattattgagattccctccatgaagaaagatcaagtttttacttcaaagggatggtaaaaaaataaaaattgtttaaccatccttgtcttaggcttgatggtgaaagtataaattaaagtaaactactgttttatctggtgaataaaaagcttgagctttattaagtgattttctcttggtattgggaagtgtatcttttactctagggttgttacttgaatcacccatgctagacagtttttttttttgagacagaatctctctgtcacccaggctggagtgcagtggcataagctcatctcactgcagcctggatctcctatactcaagggatcctcccacttcagcctcctgaggagctgggactaaaggcatgcaccacctggctaattttgtttcctttttgtagagacagggtctcactatgttgcccagattgatctctaactccagagctcaagggatcctcctcccttggcctcctaaattgctgggattacagacgtgagccaccacacctggcttacatagctttttttaaatacaagagcaacaacaataatataaacgaaagttattcttcaaacgtaacattaacctagatttatttgaagctgaaagtgaatgcaattgggtgtgccaaaggcaatgtgggaaaaacaattaattcctttttgttagaattggacatatgtattcgcaccaaatggaaccattgttagggcatattacttttctattagtttacttttctattagaatcattcaagcaaatctcaaagtttttatctgaaaattgttttgtttcaaatttctttaatgaaaatactgtaaggttggcttccacattaactacacggaaactaaagttactagaaaagacaggttagttattaaattgagaaagacattgaacacttgatggtaaggaattatgcaaacaagatccgggttttcctaaaattagacttttttaatgcaaaattactcttttgcgatctttttatgaaaataattaacttagcctttagcgtatctagattttgattttatgcattatttttagcaagtttctaagatactaccttcataggcaaattgatttttagttaaaaaagaaaacaatttgtgtgattgaacatgtgcttggaagttagtaaaaagaaaaatattgctttatttagaactgggatctactttctcactagttaagaatccttctaggcccattgcggtagcttacacctgtaattccagcactttgggaggccgaggtgggcggatcatttgagtccaggagttcgagacccacctgacccatggtgaaacttcatctctacaaaaaatacaaaaattaaccagttgtggtggtgggcacctgtaattccagctactctggaggctgagacacaagaatcgcttgaacctgggaggaagaggctgcagtgagccaagatcacgccactgtactccagcctgggcagcagtgagtgagactccatccaaaaaaaaaaaaaaaaaaaaaagacactaagctaaaagacactaagctaaaataaaagcctcatattatcttaaaaagtggggaaggatacacacttaggacccctgatgaggtccccttatcctttattgggtgctttaattatatgccttactttattctttgagtttttaaaacctcacctcctactttactaagaaaatagaggtggccacgctggaatcttttttcacctgtaagttcttaatacattacattattattttttttccttaaaatctcaggacagacttgactctactgttttaccccgccgaaaatcccgaattggtgtttctatttctcatcctgtcagccttctctggagtgttattttgtcgtttttgactttgatacctctatttgttttctctccacggattctttgtctccactcacaatctttgatcagcaaaaagtagattattccagtcttttaaattttaagaatctggcctctatccttgaggctctactgaaaccactctctccaacgtcctttaatgttttacccagtccttgttttctgtagctttcaaattattgactatcctgtcatctttggatatttttctttctttgaattcagtaatattatacactctaggttctcttcctatcatcaactttgctgtattgtttcttcttgccgaaattccatttcttttcatcgctatttattacatacctgctatgagtcgagtacttttagtgaagctggggatacaaaagtgactaagaaaatgtcctgctattataaagttgcattctggtgaaagagaaataaagtcaattaggaaacataaataatataatttaagttggtggttaaattctatgggaaagtattataaattaatggagtaggtggccagggagagctatttagctggagtggtcaggaatttcctttcttggtgagtggcatttaaatggagacccttttggcctctcttagaggctgttctataaagtcctgagtagagaaactagtggaagaaaacagaaccagtggaaagagtgagagacaagaatggtgaatctgataaaaatggattctttgatttgtaggagaatggtttgaggacatgggaaatgaaaaggtggagaccatgagttaactgtttctaaaagcaggctctgatatgcttgagatatgcgatattaaaaatgcggatattgtgacacatttgtatgctacatggaattacccaggattgagggaggcattacctgtgcagaaagggatggtaattgttggagtgaactccagcaatgttggtgctcttggtattttgttggttgtttttgtcaataatgtgatggtgatggtctaacttgtactttggtaagttatatgtatgtctatgtctttcagtagattaaaattaaaatatttcttactcttctttgtcctgcccatgattgccttttctaacatctagtgcagtgctcaaaagtgtctgtagattttggttgcctcatcattttcaaaatgtttctgggtttaagcctaaaattatatatgatttcatttaatgtgaacaatggccttcaaattaccaataccagttgcatctgaggcatattgaagagctttaaatccaagttattgtgtatgaaactagtgcttacaatataagcaggtggaatacatttagtctacttatatggaaaagctaaaggggaaaaaagtccacaaccgagtcatataatagtttttaacctaacttcctggtcagttttcagctctgcatagctactctgattgattgttgccccatcaactaatatgtttgaaaattcaaagtgaataataccatgaacaattcagtaatatcaataaggtgaagcctgattgtattatttttggaatatgattaaaataatgcaaaagaaataatccttgcccccccctccactttttttatttttgtcttcagcagttctgtggtttacaggtagcacatctgaagctgttatgcactggtaaaaccaatgtggattacaagaatacactattaggccctggtgacaggagacaaaagcaacatctgcttcctaggctttctgtgttacagaagagaaggcctgcccatcactatatgtaaaatcactgtattatccagtgcctggaatactcatattaggatctagaagctagttgggatttaattgtatttcaaattttagtataatactagtataatacttttatatcagtatcccatgttaactgtatatgcactttattattttaatatttaataattgaaatcaagtcttatgtatttatgtaaatttttatatgttacattcatatactgatgtttatatcaatttagaaaagaaaatgtgagcaattaattcttattaattaccttatatctggttttcgctcaagaaaataatacttaaatgaaatgaaatttatttgcttctaatgtctacataaaagacaaaatatccactagtgaatccacacagcatacaaatatatatgttaaaatttgcacaacttaaaaatatgcatactgtatttgtgtttctgttttctaaaataaaaaccttgggatttataaatattcctgaagaaattccttgtatttcctagctgaattagttctgagtttggcatttgctctttacagcctaaccagggagtggaccattagttttcctggagctttgggactttgggtttttgcctttggaaattaaatatgtaatattgctttgtctgggctggcttaggacaggatcctcccttcattccagggcaacgtcaaaattcacagaagagcaacagttcatattgtctattgaaatcaaatctgattcttccccctcccatctcccacgcctgcccttgggattgtgacatcattaccatctcaagaacccctagggttgttttccctgttaaaatgaagtgagattagggttctaggagagagcagtcaaatatttgagcactaatcatgcctggatgtcttttactaattttcaggcagtggaattcttttggtttcaagattacaccacagtcgtttaatgtaaatgtggacagaaaagaatacaattaggtgaatcgcacagacaatctgcttttttttcagcaatccttgaaatgaaagatgcatatattagaaggttatctggcatatgaaagggacatttatcccccaaggagagaaggaaactacttaaaagaaataaggttttattaatatttttcaattaaatgttgcactttctttatccttttgtaattttcatgttgacctatgtaagtgctttgttcatgtagcattcactctttcttggcaagtcatcagatggagcaagtttattgaaaaagaaacagaattaaaaattcaatgacaaaaattcaaatagtgtctgtttagagcttatcttcttaatgttagggcttttatggttattggttggggacttttgggagtgtttcttaatgctcaggtgggtgatgccagtatcaagggaagcaatggcgttactttaattccaagggttttgatgattgcattatgtttaagcattgtgaagatatatatataattttagcgtacaaaagtgaagcagttttgtgattgaattatttaaattagaaaagacagaatagcacaatcatacaaaatgaaaggtgctttctttatatcttctcccaaaatatggttaatggaaaaacaattactttttattatattttggtcaattttgtaatctatggtgataaacaatattcgataacctttattaaaatacatatttgggagaatatcatacatagaattatgactaatcatgaaaggctgaacagcattcaatgctattgtttttaaatctataaaatgaagaattgctgcctgacctgcaagatttcatccagctctaaaatcttatgcattctataatatgagaggagaatatttttttttttttttgagacggagtttcgctctgtcgcccaggctggagtgcagtggcgcgatctcgactcactgcaagctctgcctcccgggttcacgccagagaggagaatattttaatgatgtcaacagaatttacctaaacataaaatatgaatgtgaacctattatacctttatacattcctttttaatgaattactcaaaattgtgatatcatatatcagcaaaataataaattcaactatatattaaagagaaagtctcagatatttcagaatacttatttaaaaatatttctaccatgctttctgccaaaaatgaaatgtaattcaaaagcatccattggaaaaattaaacctctttctgccagaataatctagtgttagcatttcatgccttcttaaaaacagattttatttttcaaatcagtttgaagtttacagtgaaattgagaaggtatagagatttcccatatcctcttccccctagacatacataggccccctcactatcaacatcccacactgacgtggtacatttgttacaactgatggacttacattgacaaatcattttcacccaaagtccacagctgatgttagggtgttgaccaaaagagtcaaactctgtaaaatatttgaagagatttattctgagccaaatatgagtgaccaatgacctgtgacacagccctcaggagaccctgagaacatgtgtccaaggtggtcagggcactgtctagttttatacattttagaaaaacatgagacattaatcaaatacctgtaagacgtacattggcagttctgtctggaaagtaggggcaacttaaacgttttctaattggcaactggctgaaagagctaagctattatctagagacctggaatcagttgaaagaaatgcctgggttaccatgataagataagagttgtagagaccaaagttttatcaggcagataaaccctctaggttgcaggcttcacagagaacagacggtaaatgttcatcggacttaaggtctgtgccagtgctaatgctggtcagcttttcctgaaatctgaaagagaggagggaatgatgacgcatgtccaactctcgcttcccatcatggcctgagccagtttttcagggtaacgttggaatgccctggccaagagaaggggtccaaccagatggttgggggtccttaaaattttatttttggtttacatgggtacactattggttggtaggcattctatggacttggataaatgcataatgatatttatttactcttctggtatcatacagaataattccactgtcctaaaaattctgttctccatctattatccatcctttccactaacccttgccccctgaaaaccactgatcttttttaactgtctccatagttttatcttttccacaatgtcagacagtatggaatcatatagggtagccttttcagattgacttcttcagtaatatacatttaagtttattccatatttcattgtggcttgataaccattcctttgagacaaggtattgctttgttgcctagattgcctaggctggagtgcagtggtgcagtcacagctcacagcagcctcaacctcctgggctcaagcaatcccccaactccagacactggagtagctaggactacaggcacatgccaccatgcccagtgctttttaaattttgtatagagtcactgtctcatcactttggccaggctcttctccaattcctgacctcaagcaattctcctgccttagactcccaaagtgctgggcttataggagtgaccatcatgcctggccacttgacctttcttttttttttttttttttcatttttcttttgtgtttttgagagtgtcttgctctgtcttccagggtggatggcagtggtgtgaccacagctcactgcagtctcaacttcccagcctcaagcaacctcccatctcagtcccccaagtagcagggaccatactgtacgccaccatacctagcttttcttttctttttttttctttttcctgtttttgttttgttttgttttgtgtgtgtgtgtgtgtgtgtgtgtgtgtgtgtggtggtgataaggtctcactatcttgcccaagctgatcttgaactcgtgatctccaatgatcctcccaccttgggctcccaaaatgttgagattataggcatgaaccactgcacctggtgatagctcctttttaagtgctgaataatattacattggatgtaacacaagtccatatagtgtatctatctattcacctattgacatgtcagttacttcgtagttttggcaacattatgaataaagctgctataaacatctgtgtgcagttttgttgttgttgttgcttttcagctcctttaggtaaatgccaaacagtggaatttctacattgcatcataaaagtatgtttagttttgaaaggaactgccagactgcctttccaagtggctgtaccattttatcttctccccaacagtgaatgacagttcctgttgatccacatccttgtcagcatttggtggtggtgttgttctgtattttgcccagtctaatagatgtgcaacggtatctcattgttttgatttgcatttacctgacgacatatgatatggagcatcttttcatatgcttatttgccatgtacacatcttctttgataagatgtttgtgaaagtctctgacacaatttctaatcagatttttttttgctgttgagattttagggttctttatatacttgcataacagtcctttatctagtagatcttttacaaatattttctctcagcccgtgtttgtctattcattcgctagacatctatcatgtagcatatagtttttattttaacaaagtccattttatcaattttttatttcctagatcttgcctttgatgccatatctaaaaagtcattgacaaatccaaattcatctagattttctcttgtgccgttttctggaagttttatatttttatgttttacatttaggtctgtaattaattttgaggtaacttttctgaaggaaatctggtgttagcattccatgcctttttgataccatttatccctgaaaataaagtctacatcattattattttccattttgccaatttgattgggaattcttatgatttaaaattttcttaatagctttctattaaaatagatttgaatgaaaaaatatttctatgaggaacatttacatttctaaatatttgttttaatataactccaagtatattttaaatctaattttcttttttagaaacagagttcatttagtaggctaaagctactttcctaatactatggtaatatttaatttttttataaatataatttgtatgagtttgggcctttttaggcaaacagaccaccttggtcctctacatatactttctcccagtgtatattcagtatccgctatgtacatggcatcatagtgacgtagatgtttacactggagcaattctgttttctcctctacttgcagatagaggaggtggcagatatcttgagcaattatcattcatttccttgtgtctctaaggatgcacaatcatcccttggttccaggaccgcccacctccccaagaataccaaaatctgcagatgctcaagtcctgcagtcagccctgtggaatccacagacacaaaaagtcagtcccccatgtccttgggatcctcatccctctgtgtctggaattggtgggttcttggtctcgctgacttcaagaatgaagccacggaccctcacggtgagtgttacagttcttaaaggtggtgtgtccgcagtttgttccttctgatggtaggacgtgttcggagtttcttccttctgttgggttcgtggtctcgctgacttcaggagtgaagctgcagacctttgccgtgagtgttgcagctcttaaggcagcgcgtctagagttgttcgttcctcccgtccagagttgttcattcctcccggtgggcttgtggtctccctggcctcaggagtgaagctgcagacctttgcagtgagtgttacaactcataaaggcagtgcggacccaaagggtgagcagcagcaagatttattgcaaagggtgaaagaacaaagcttccacactgtggaaagggaccccagcgccttcccactgctggctcaggcagcctacttttattcccttatctgaccccacccacatcttgctgactggcccattttacagagagctgattggtccattttgacagggtgccgattggtgcgtttacaatccctgagctagacacagagtgctgattggtgtatttacaatcctctagctagatgtaaaagttctccaagtccccactagattacctagacgcagagcactgattggtgcgtttacaaaccttgagctagacacagggtgctgactggtgtgtttacaaaccttgagctagacacagagtgctgattggtgcatttacaatcctttagctagatgtaaaagttctccaagtcctcaccagattagctagatacggagggctgattggtgcatccaggaatcccaagctagacacagagtgctgattggtgcatatacaatcctctagctagagataaaagttctccaagtccccacctgactcaggagcccagttggctttgcctagtggatcccatgccagggccataggcggagctgccagccagtcccatgctgcgctcctgcactcctcaacccttgggaggtcgatgggactgggggccatggagcatggggcggcgcccgtcggggaggctcgggccacgcaggagcccaccacagtggcactcgggcatggcaggctgcaggtcctgagccctgccccgcagggaggcagctgagacccggcaagaattcgagtgtggcgcgggtgggctggcagtgctgggggacccggcgctccctctgcagctgctggcccaggtgctaagcccctcactgcccggagccgtcagtgccagtcgcccgctccgagtgggcccgccgagcccacgcccacccggaactcacgctggcctgcgattgccgcacacagcccgggttcctgcccgcgcctctccctccacacctccctgcaagcagagggagccggctccagcctcggccagcccagagaggggctcccacactgcagcagcgggctgaagggctcctcaagcgtggccagagcggacaccgtggccgaggaggcactgagagtgagcaagggccaccagcacgttgtcacctctcacctcgaatactgtatttttgacccactgttagctgaatccagtgatgtggaacccatggatatggagagccaactgtatagttatttgattaaatttatacttctttactgcctttcagaaaagttgacatttctgctgaaaagaagctgctaatctttacccagatagaacagagaaaatcagagttgaagggacatgtttagggaaacttgtacaatctaactttataaagcagcccaagtgtcacatgaaagtgaaaacacacaatgaaaatgagcatcagcctccagtaattctaaattttatctacaagtgtattcacaacttactttttgttattttttctgatgattagccaaaggtcagggatgattggcaggtacaacagttcaaatagaagtagttcacaaactgcctgtaagcctttcttgataaacagttttgatgaattagtaaataaagtgttttattttatacagaaatctctgtactttttcatatttgatcatttgtgcgtccagtgacatattgtagacatatacattcactgaacttattactggttgccaagatagtaatagcaaaatctcaaaagctgcatgacaggaattattcaaatagttctatatactgataaatcaaggtttaactatacaacaccctctagtccaatgaaagtagaaattacctgtgaaaattacaatttattttgaatgttcacaaataatcttatctttttatttgtaagtttgactcaaactataaactacacaaataaaaaagtaaaataattatagtaagtagccaaattttattctagttttcttgtttcattcaaattcagtttgtgctccttaatgataacactattgtcaataaaactttacactttaagtgactttccacagttttcccatctgataagaatggtactgataaataaaaaacaacatgcactatccatcttactttcatagactagagataaatcattatgaaccccaattggcagaggagaaaattcgggtgcagacaagttaagtcaggtggcagattcacacaggaaataaatagtggctatgctcgtataaaaacatcaatcttctgacctctaattcagggcttttccagcactgcagtatgattaatcaataccaggaagcaaactaagtatcaagaaaagatcatccatttgtatcagtctttcctttatgtggttggaatctaaaacaccaagtgcataaaggaatcaaaagtcggaagctttgaccatttgtgaacaatcttttctgtattattaacaggtctgatgataaacacagacatttactaggcccaaattgtgaaaaactttgtagacattttgctaatatgcgggaaataagctctttcttttagcaacttactttgattttcttttatttttatgctgctaagaaagcactcagatgcatgctgaaatatgtattaccttatggattgcagctggcagggactattagtgttaaagattcacacatttgaagtaagattggatacatttatatttgtgtcaggaaaaaaataataatagaatttaagaatttaaaatgtaaccaaaaggcagaatcatggcttttggctgaagagattagcagcattcttctctgttccctttttttctgaagcttagttttctagctaagttttggcaaacaaaattcttttctgtggtatgtattctattttaacatcttccactgaaaagaaaagataatgatataaataaagcaatttaaatcaagtctaaggtataggaaggtatttaagaaagaagcaaacattctctagatgttgttatccaaaatatattctcttttgcagtttactgaaataatttcttcagtgtgtgggaatttcctttgcatccagctttactatagagatgacatcacaccaacagtgacacgacttgtttacaagagggtggtataaacagcaaatgttcttccttaaaacagatttcttgttgaacttcaacagaaaaagaagcgtaaatgtagaaggaagaacaggagatagtctttaacatgtagggtaaaatctaaggtagaggagagagcagctgataatgtttttatgtgtttgctactttattaggaagtctacttccttcttttccatatctagtagagtcttcaagttgtacattgtctttatattaatatataatggcctattgtactatgtcttaatagtttcatatcttccctggtttacatgaattaaatgagagcggtaacatcagaaaaggaaagagagagagagtgaatatgtgtgtgtgtgcatgtgtgcgtgcgtgtttgtgtatgtgtttctgtgtctatgagagagagagagaaaagacagacaatgaaaatgaaaataaatatcttctccaacctatcttagccaactttctgatctaggatgttaggacagtcactcactgaaggaattttagttatagcaaagcgtcatccatctttttcaactgtgttaactttaatttcccataaataataatagtttgcagaatacatctcagattgtacctgaccatattgcaaaataataatttgcttcttgtgtaagaatcattatttaagactaaataaaactaggtataagtaaaataaattaaattcagccctttgaataatcatttagatcatgactgctaactgtagtctagtactaattaaagacctacatggttatttttcttagaacgtgagaagtcttaggagcaactgtttgaacaccctgatctggagggaggagtccttaccaggagatttctggagctgggtgtggagggtagttcagtttccacacattagcccataagagaaaatcatctgggtaaaatagggtgactattctggacacggtcatggctttgctactatagtcccctccatttttcttgggagatgcattggtgcttcgcaaagctgtgcagtcattgaaggtgctcagcactggtttttgtcattaaaatacttgagcttgaaacccagcactgtcaatttagtgagcgcggccttacacaaagttatctaatttctctaagtttcagtgttatgatctatgacacaggttagtaatccctcctttataggaatgtttaacattaaataatgcattaaaagcactttagatactattaatctcaaggcaaatgtcatgttatgtggtatggggcatataagtttccctggcattctcaaaacctgaaccctacactccagctcaaagctccttatagacaaggaccatattatgaaattctgttgtgtttttcatagtataggatgtacacattgtgggatttcaaaattggattgcttcttggtatcaagtatccaaattgctcagagccatagtagtaaaacaatggagaaacagtagtgactgtatcattataatatacgtaagtgttcatgttagtttgcttaacatttattgaattcctgatacataaaaggcctcaggctaaattttgtcaattatataaaagtaccttttcctcaataaaggcaacttactggaagaatcatgttttagtgggggaaattaacatataggctttataaacaaatgaattaagtgctaaagagatgaacaagacacatattgtaagatatcagaaggagaaatgataggggaagacagtagttgtcaggaaaacatggtaaaaatacaactgttggacttaggaaggatttcagtagtttaagagacaaaaagataggaaaacgtttagcatgcgcaaagtcaaagtcagggatccataaatatcattgggtgtgtaatgaattgttagtagttggatgggggatgctaaaatataaagtgagagatccttcatatattttcgtttcctacccttagttccagatattgatagagatattttagaaaatcccaacttaaggccaggcgcggtggctcatgcctgtaatcccagcagtttgggaggccgaggtgggaggatcacaaggtcaggagatcgagaccatcctggccaatatggtgaaaccccatctctactaaaatacagaaaattagccagatgtggtggtgcgcacctgcagtcccagctactcgggaggctgaggcaggggaatcgcttgaacctgggaggcggagcttgcagtgagccgagatcctgccattgcactccagcctgggtgacagagtgaaacttagtctcaaaaaaaaaaaaaagaaaaaaagaaagaaaagaaaagaaaatcccaactgaagtatatgtgaacaaatgaacagctttttttttttatcaaaaaagcaaaggtctttgaaataattttattcagattttgctcacaaatattatatttccatttttatttaaaattatgaggatgatggctaaaagtaaaatgaaccaagttttgtgcatgctgcattttaacaagttgggtgtctcattggaatgcactgccttcttgttccacatttatttttggaatttaataaggcgcctgtcatatctgcctcaaggctaaaaaacatcatgggggagaaatccaaagtactgtcatgtttgagtgacatggagccaattttattttatttccttttcatggggggtggctcaaattagccaggctcacttctgaaaacgcattgctacatcatctgttctaaaggccttgtgctggttaacgggtaatgacattgcccagtgacatttgttaggtagatttgactcagaaaaccaggggaggattttcattaaaaaattaattctgtgcattttactgcaaagctcattctcatgatagattctggtacagtgccacatatctccagaattgggtctggttacgtgagaaactttggaaggtaataacttctttatttcttctttgtgctcccagagcacataattaacgtactgactcatttagctcaactctccaaaggatgaagctgtgtggatacaagggagattcagagaaactggcaaacaagtatggtttctgattctcattcgagtgagggaaaaactctgccattttcttcttctttcttttaagttgatgtttagtacaatgtgactgtgtttagcagaacataatatgttaggattacaatggaaccatcatatttttaggaagtttaagtgagacttgggatagatgtcacagaatgatgttgccatggctgagttagtcataaaattagaaatcacagtaagctgaaggatgtctgaggcataaaaataaaccatgtaccatgtaatgggtgtgttattgtaataactaagataagcatttcaaatgttttactgattaaatcagaattaagtcctgtgttttttagtagtgactatcaggaagtagattgtttaaataacatgaacttaaaacatgtaaacatagtaatttttatgttaaaaatatatagtgtagacaaaatcaataatttgtagctagaaagctctttctaccttcatttaggacttcctgcctcatgggtaaatggaaaaggaatagtaaatctaagcaactttttcatgagtttataccttcttaggcacaaagagaaatctgtgatctcttccctgtatcctagaagacctctgcgacaggagtgagaattgaatttggttacaaactactgagagtgtatgtgtatgtgtgtgtgtgtgtgtgtgtgtgtgtgtgtgttttgcatgttggctaagtatggaggaagggaatcattgtaggaaaatttaatcctgagattttgtggctacactcactttaaacccaaatatgtgggttggatcaatccttggttatatatgggagatcacttagtggtcaggccaggtctaaaccattaggtattgagccactatggagcaaacaaagagaaacatgagacttcaaaatgagcccacccccatgttaaacgtgctctacacttcagcatgctccagggactgtgaatcagaaaaagtcaactgcattttgaagtgtcggcacgtaacattttcttttcctttgttatggaattccaaaactatactgtacagattacctaatatattctgaaagctatcaagcaagcaatgtaacactttttttgtggacaatgattttaattaaataaatgccatttcttggagacaatttacctcttgagtatagctggtcttcatcttattttacacaagctatctcttgggggcataaatttccaggcaaggaaacaggaaaatttattggctatttgatttacatgtttattgggctctccaaaggctttactatttaactggtcattgaaagtagaacaggggtggggtggattatattcaatttaatggaagatttaggtaaagtcttttgaaggaaaaaatatgggtcaacttttaaaatatttcactttcagtaaacaattgtatctattattttagtggctatctaccaagagctgaatcattctgtacagactgaattctttagtccatgtctcgagttttaagttttccatgctaagaagtgctttaacttaaatgtgtcaataatgatgctgctgtggaattgtgtcatactattcccacgagcagcccagaatagctcccaggcttggagtctaatctttattcctggaggtggcaagagtaggttgtcatggagctagtggagaaatcagcagactctatttatgtggcgagggagaggatacagtctttcttctgtaaaattttagaatgaggctgttccgcaaggacattagtctgagtgctttaaaaaaagagcgtgtactctacacgtggaggctcaataaagtttgtttacagtgctgagagtgattccatattcacatcccaaatataaggccagttgccatccttcaattattctctcacaaatacagtggctcctcctctcttcagtaagagtaattgtatcagttagagaatatttcctttactaccaggaattctgagaattagaatcctcttccttgacggaaaggcactagattgacaattttgcaaatgcacgtgctctctttttgctttaggttatcattcttgcggaccatttcccttagtatctcgaagcgtctgactgacagggtttgaatcccagatctgccacttacttactaatcctttgaaactaagcaagtaaaagaatgttattaaattcataatactgataggaacaggatgcagggagatcctgggcagaagacagtgggtctctggcgagggccccaccctcaagctgaaaagcctggaaccatggccaaaagtaagagcttgcatccctgttttcctgctcgaatgttgcctttccacccacagccccaccccacccccgtcctgtgcctgtaaaaaccccagagctcagccagcagagaggagaagcagctgaatgtcagagactgggatggatgttggagagaagtggtttgacttcagagggacagcttaacggtgtagcttcggagaggagtccggtggggatggcccgactctagaggaagatcaccttcttgctccatcccctcttcacctcccctttctgctgagagccactttcactggcaatgaaatcccctgcatttaccatctccagttagttcatgcaacctcattccttctggatgccagataagaactcgggtgccacgagtgtgggtgcaaaaactgtcacactgaccctccgctgagctgttaacactgaaaaactgtcacactgaccctccactgagctgttaacactgaaaaactgtcacactgaccctccgctgagctgctaacactgaagccatctgcagatggcaaagctcaaagggttttgtcatactccgtctggggcttcaggggtcgcgagcacccccctggaggctgtcgcggggcccacatggagttttgctcctgccagcacccaaaggtgctcaccccagctcctgcgctcgctcacctgcgccccctcccttgaggagtggaagtgagaccaaccgagtgagtccagcgcgaaagcagccagcgaggtccagggcctgtgaggtccagggcctgtgcgctccagttcccgcccacgaagggggcaggaaatagctgcttcaacatcacttgctcttttttttttttttttttgaaggaagaattcgtaaaataagtttggagatcacttgaacataaatattttggaatatgagcccactcataaatgtgaaagtcattacttttattttttaagacagggtgtcagtctgttacccaggctggagtgcagtggctcagtctcagctcactgcaacctccaccgcccgggttcaagcgatcctcctgcctcagcctcccgagtagctgggactaacttctgtgtttttagtagagaaggggtttctccatgttggccaggctggtctcaaactcccgacctcaggtgatccaccagcctctgctcccaaagttctgggattacaggcgtgagccaccgcccctgcccacatttttgttttaatttgggtttttgtcacagtgagaactggaaaaaaacaaaaacaacaaaacaaaacagaaaaacctctgctgaattacctgtaaacgaccttatgataaaatattctgttttgtcttctctgtatatatattttttacaattgctttagtttcagataatattctgtacaatttgtaatttagagataaataatcaaatattcatacatatatgaagcattaaagaaaaatttcaaaaactctgaaacgtcatggcatccagtaagaacaaagtttctgtaggaatttgcatagaaaaaggcagctggacttaacatagcatctcacggcacctttaagaggtccttagctatagcagccagccctatcttcatattgcaagagataattagtttcagctgaatactcccatccatcactttaaaatgagatattgactcaaattttagaagttacaactttttttttatttaaaaatgttatagttgcccaagtacttaaacatacaaaacttaaacctagttatatatttgctaacttaatttacatttaagtaatgtaaaacaaatatcagtcagaaatcagagtgtttcttttaaaacaattgtcttacaccaatcaaatttgaatatagctactatattttattattattattattatataggacccatatgcataaatactgaaaactaagacctggctataaagttactaagtgttagatttaatgggttttttttttcctgattttccatatgtataaaagttttacttgaagaactctgcatttaaggaagcatccaaagtaatttttttctataaaaacacagaaaaactgtgttatagcataccagtaatgcacaaggagaaagtcatattacagaattaaaatattgctattacataaaaaatgctataagattactttaaaacctcctacctagattgcttcaactgcaattcagaataacatattaatttaaatctagaaaggcctagaactgaattctgtctcagcttttgattgattcagttttcattcttggtcaagttatttaatattgctgaattttagctctcctcatctgtaaaatggagaccctaaggctacctggtaagatcattttgaggattccgtctggtattgtgaaagatgcctggtctgtgctattccatactgggcctccaacagatgtttagcctttttcccattgtctccatagtttcataaatggaaatgccttttcccttcccctttaatatccagcctccttcacaccttctcctgctggcgagacgttgttaggttccatatatccagccagtcaaagtctgtgtgtgccatgactgagttgtacacataaaatagcagctgaggcagacacggtctttttttccccggaatcacacatccatgtgttaactgactgtcttagtctcttgtgttttgctaaagcagaatacctgagactaagtaatttacaatgaagagaaattgatttggctcgcagttctggagtttggaaagaggagatgcatctggtgttggccttcttgctgcagcattccctggcaaaaaggtgggagggcaaacaagctcacatgagagatggagggtaagggggctgaactcatctttttatcaggaactgactcccactataactaagtcactccatcataatagcattaatccattcatgagggcggagtcttcatgacttaatctcttctgaaagatcctacttcccaacagtgttgtagtggagattaagtttctataacataaactttgggggtcattcaaacatttcacccctggctctccagggttgcagtctcatgtctgcagctttctcaggctgcagttgcaatctagtggccctgcagttccaggagctcaggggctgctccactctcaaggcttcactaggcattgccttagtagggaatctctgtgatgaacccacccctgtggcaagtctctgcctgggcccccaggctgtctgatacgtccttggaaatcttagtggagattgtggccattaaaccgtggccccacagctcttccattttagggacctgcagatttaatatgatgtggacatcgccaaggttttcagcttgtatcttctagagccatgggtcaagccacacacacctggactcgcttgaattacaagtgtggtggccaaagggtgctgttttggaattcagggagcagagttctagggcagtgcagggcagtgaatgctgtggtcttgcaggcacctctctcaaaacgttgctctcaacgccctagcttgcttagaagatctcagaattgcctgataagatacggtcattatctctttatcctgatgaagagaatctggctttcttctgtccatgttaattactttaggaaagggttgcttagccacacccttagtgatatggatttgttgcgtcccgacccgaatctcaccttgaattgtagctcccataattgttgttaggagggacctagggggagatgattgaatcacgggggcggtctcccccatactgttcttgtgttagtgaataagtctcacgagatctgatggttttacaaggggtttccactttcacttgactctctgtctgtctgccaccatgtaagatgtgctttcgccgtccaccctgattgtgcgggctccccagctgagtggaactgcgagtccgttaaacctttttctttatgaattacccagtctcaggtatgtcttcatcagtagcacgaaaatggactgacagacttttttattatttacatggccagcctggaaaatttcaaaatctatccattttgcttccaattataaattttatctttaaattattttttcttccctaattttattgtaagcagtcaaaagaagccatgtagcactttgaacactgtgctacttagatatttcctcagccagatatcctagtacattgctcatcagttttgcctttcagtcttacgacgtgaacattattctgtcaaatttttgcaactgtataataaggatttcctttactccattctccaacactttcttcctcatttttgtctgagatctcatcagaatggccttgaatattcatatttccagcaacattctgatcataaccacttaagtaatcccttacaaaatttaggctttccctatatctcttatcttcttatgagaagagaccactcttttttaaataaacaaacaaaaacaattactgactcagcaacaagatgtgtgcatagcttattcatgaatcaattcattccttttaaatgacacttgatgcatttgaaagagcattttatatatcattattaaattagaaatagaaccaggcgcagtggctcacacctgtaatcccagcactttgggaggccgaggcgggcagatcatgaggtcaggagatggagaccatcctggctaacacggtgaaaccccatctctactaaaaatacaaaaaaattagctgggcgtggtggcgggcgcctgtagtcccagctactccggaggctgaggcaggagaatggcgtgaatccgggaggcagagcttgcagtgagccgagatcgcgcccctgcactccagcctgggcagcagagcaagactccatctcaaaaaaaaaaaaaaaaaaaaaaaaatatatatatatatatatatgaaaaataaacagacggttttaataaatgaattccaacctgtttagaaagagtactctatttgataaaataatattaaattaatttgtatggctagctgtactaatttcaaattatgctcttttggaaaaaaatatggatgtcccaaagttaacattacaggtatttgtggggcattttaagatctaagttaaagagaactaggaagtgttctaagtaaatttctgagacaccacagggtaagggttctcagctagcatgtctcgtgttacttcagatggctgtcagatgctcatatctgattctgtaaaaagtggattatctctgaagtcatggtttcaacgtgcaaattttgattttactgagaatatttaaaagataattgtggttcctaagagacttttaaaaaatggatttagaaattaactgtaaaagttcaaggaagccaagcaagcatttctatgagttgaattatgtatttaaatatacttgtgtggaaggggtatgtaaagtcagatcagctagagaaaaatgacttctcaagaagttattcacataaagacctatgtgacataacctgcaaagtttaatattcactaaaagctctattccaaaaataatattaaattttatcatcttttaaaaaaattaaatctggtattcttaatctattatgaggtgtctgtcccaatgtgaaacaaagttttccctaggtgggaggactctacatctgcttgggcaatggaaatcatatgatttgagtgatgggcctggatgagtttaaaatcatgaaaagcacaattattttcttctttgtcaatgagaaataccaataaatgtcatcagagaggcaatggcatattcttgtgttctaaatatttgggtcatttccataaaaaggctgcagttttcagagacaaatgtgaatcctgaactctagaaccagatcatattcataccactagaaatagaggtaaagaaatgacctagaattatgaatataaactgatattatttacgaacctctaatctgtaatatttgaaatattttgttcaaaataataaagaaaaagggtatatcttggacataatttttcttatgctattctgtttttatactttgcttgagcactgtaaggagactttggcaaagtagtcagcatttaattcatttgaaaaggtaatgaaaatatttttgtttttcctttaaagatatatagcctgggcaacttagcgagaccctatctctacaaaaataaataaatatgtaaattagccaggtatggtggtgcacctgtggtcttagctactcgctgaggtctgacaatggcttgagcccaggagcagttagaggctgcagtgaactgtgattgccactccactagagcctgagtgacagagaccctatctcaaaaagaaagaaaaaatagttttctgctcttctagtgaatagtgatttccacattaagtcaatgtattcattttttaattgaatcaatacaaagcctaatttgtctaatgcagtagatattttccagagagtaaacagaggaagcagctttacaatatattaagcaattaaaatacttctttttttttttttactttttgagagaatgatgattttggacccctctcctatggtggaaacttaacatctgaaaactgaagtacaaaatattctttttttagggtcttacatgatgttgaagttgaatacctttcggaactattagagaggtggagaaaattgttccactttttaaaatttggttttattataagttgtgtttattcttaataatctttagtttgttgtcaaacaagattgagaagttaaagcgattctgatatcacatttgttaaaggcccactctgttctaggcacttatttcacttacttttatttaaccattatttccatattgaaccagcattttctcttgacataaggggaaactgagagtcaaaggggttaagtgtcttgctccgagtcacccatcaaaaagtggcagaataaaaacaaggtcagatcttctgacacaaggtctaatgacttttccattcaacttcaattgccagttttgtgtgtaataggggcaggttcctctatctgtcttttctgagagggaaacgtattccgaaatgtaaagtttaaactgtgctgttaaaaggaagaactagagaaggtgagactttccactaagattccaaagatataggaaagtaaattttagattaacactggggagactggattttcttttggtaaagggacagagaaatgtaaggttacccagtgaaatatgaactcagaggaacaaaaatctatttggaggttttgaaatcaaattaagttacatgagtccaaaatgttgagcaagcctttcttaaaggcacctgtaaatgtaaagaaaaaagttggtaaagtgaaaatgataagaattcataaaatcagcattctgtaaagtgcgtgaagttttaaaaccaattcaactatgagtagatgtcatgtaggcagggaatatagtaaagccccattctttggagttgctaaccatgtgaccacaaatctccactgccaccttgtggtggtatgtatatttcagagacaggctctgaagaaaattgacctctgaagtgctgagaggtaaaataaaaggtgtctggtggtaaccaacctcccactttctgaactcaggaaccagacagatttggggaacacaggatccctcttttggagttactatccaaattcctaccatagcaatttaggagataccatagatttggagagcagggctattatacagacatcacaagggtgaaaaccttgagcaagagtaggaactgaattttctttcagattcttttgtgttcatggtggaggaagatattctattttcaagaggatcctaaatatccaatgcagttttcatctagaaaaaattttaatctattctgtataaagcaatgaggtaacattctcgtcaaaggaaatcctatgggtatgtgagaatggaaggcttccagtcacttctttacatttagttgcattcataaacgtgaccaatggtgtttctgtctagagcttaatgggttacttccgcttatacaccagttgtgctttcaactctgagcatgacatcaggaaatgtgtttgattccaaaatgatcaattacagaagcatgtgatagctaatgtgcctgtaaactcattaaccgaatgaagccacctaattgtcaacagttcaacagaattttgtctgcaggttatttgtttttaggtgtcagtggtattcctgttttaatttcgccagcagaagtgggattaatagatcaaaatagtattacagcacatgacaatagatgacaagcaaagacaaatctaaaattattctgattgatcattctataaatgtaataaaacatcagtacttaagtgtagtcatcatttattttattttttatagtgctcaaaaatatttataatgtatctgtgctaaaaacaagtctctaccaactgcataacatgtaatttgagcaaattatttaacctcttcccttttatgcacaatgaagataacattaacatcattaagaataaatgggtaataaaagtaaatcatgggacattctcaataactgtgtgtgtgtatgtgtgcatgtgaaaactataaacaaaaaaaaatctcttttattcagcagaaacatcttgacatcttatatcttaataaacctgcaagttaaataagaggagggcttaagcattagtacaaaaaactattatacagtgctttatttgtggagaatattgatggagaaaggaggaaagaggaaaagcctattcccaagagaggcttctgcgaagagcagagcatgaaaccaaggctctcgaggaacaccaaaacaaacaaactctggcagtgtctgagtaagccagccgtctttctctcaataatttttattgtgcacccagtgatttctcaggcaatttttagagccttttggaaagtggtctccaaattatgcactaatacaacactgctaatgaaagccctcattgcaactcattagctctcacttttttttgctaatccacaaattctgtcctatgtggtggacacctggcagtacacccctcagccccatatctcagcagagatgtaattgccaaggcctggagcgaggtttcatattacctagacgtgtggcttatgcaagctcttccatgagactgtctgttgtcaataattaagagctatcaaaacacttggctaatttacacttgataatctgaaatgagggcccctgtgatcaccagcttctgtcttattatttaaatacacatagtataaaaaaagcagaatggggccaaagcaagccgtatcagggaaaagaccggctttccagcaaacaagatatagcccagtggttgtaagcaagtacagcacaaggctgaacaaacatggcccagtgagtgctttttatggctgagaagcttcacagagcaggtgggattgtagaggatcttttgaacactgagatgtggggacctggcaaagtttaattggcaagctgttgtagtcaaatgcagagaccatgaaaatgggcatgcgttatggacatgagtagggagctcgcatggtatttcaaaaagagtgattgctagaaataataggaaataactatgtatgaacagaaaagaaataaaaccattaatttttaggaagtgcaaatagtcaaaataaagaagggcagtgcagtctgtatgtaaacagtgaaaaaccctttgcacagttgtacttgggttttcagcaacattagcttagcataggaatgactgcgtaactaatctcattatttgttcagaattcagggcatttctgattttctaattccaacttacaagataagagataagtggcgtaattgaagatgttgttaccagtatttttggttcgtattatgggttaaattcagcaatacatactgagaaaaaataatgtgtaataacaaggaacaaaaccttttgataataatatgtcaggatatgtcattttaacctatctgataaggaaagtgctttgttataatgccatttaaaccttttttagctaaaatgtcttgactagaatttggggaaaaataacttacattaaactctgctatactggaagtgtatgaaaaagagtattgattttataacctgttggtgagacacatttccttgtgaatgaaaatacagtgggctgtaaagtttgaagtaaagtgtcaacgtgtcagagtaagggccacatgccgtgaaaaatgtgtataagagatttgaaaggcgcatgtagttcagattcacttgtataaagttcgagtgaaagtgtagctggaaattttaggtcaacactcaagttaaaagcaagattactgctggcttaagttataaccaaaataatgagaaaatatactaaataacctgtgagagagggaaatatgagtgctataaaagtttaagtctgttactttttacctaattgtatattcctccccaatatttttaagtttagaaattgagaaattatactcatttttgtcagaggaagagatagttttaaaagtccaggtaagattagctggccatggtggtacacacctgtaatcccagctgctcaggaggctgaggaacaagaatcgtttgaacccgggaggttaagacttcagtgagccgagatcgcaccactgcactccagcctgggtgacagacggagactttgtcttaaaaaaaaaaaaaaggaagaaaaaaaaagtccaattaagaatttcatgcctttcaacacttccttttgctgatcctcttcttttaaattccacctcatcttcaaagtctagcatcaaggcctccttaatgaccttctagctatgaataagctaaatatctcttctcaacttccaaataccattctttgggaatttatctatgtacaagaaggttgtcttggggacaaaatttcttttaattcatggatgctttgcaaggagtttccttacatacaaatccttcttgattggatggtgctggattctgtctttgcttctttctatattctcccacttcacattccagctctgctgaacagttgactgatctctgcacagtcagttctcttttcctggattgtcttttcctgcacgtctccttggctaatttcttctaagccttcagctttcatttaagatctcacttcctgatactctcctcgtattcacatccaatttaacgactctgcgctctgttctcagaaaattaccttctgctattaagattagtatttcacacacctgttattgcctgctttcttgtctgtctccttgaacagaatttcttctctctctgagatgagaatcataagattcatggtcagtgctaaaaaaaattaagaatgcatgtaagaattagcgttcatagaatgtaagcaccatagaagttgcgaatttgttttgcgtgtctctatatctctggtgcttggaaccatgcctggcccacagtatatcttcaataaaatagtggttgaatgaatcagtgaataaagaaataaaaatattatgtattttaaaaagaaaacaataggttactaagaggttgtgttataaataatgattacagctgaacgaaagtactaaaaatgtaaatgatgacaaaatgatagatgagagtaaatagaacttagtatttggaagtaaaataaagagcaggaacaaaaaaggatgattgcttactagctgctgttcttagacaaataaacccttattctctgaaagtttaccttagcatttcagcagctgacaataataaaaaggagtaagaggtatgaaaaattacatgtcgttttacaatcacttccgtgctttgtctgtttgctccattgtgatggttcagatggttccatttgaccccaacctctagctgttccaacctcagaaccaatatttattgccacatatgggctgcgcatggcagctgcaaaatccagatgccaagctttggaatgtatttttacggcagcaccatctggggctctggccagccttctttattgtctcttgaatgtttacactaatagctttgctgggctgtggcactacctgtgggacacgctgagggtcaggccgtttatgagctcatcttgtcattctagttagaatttccctttaaatgtctctcacctgctatcaacttattccttttaatgtatctacaatgtctgatgaaagtaataaaacaggtggtcatcgagactaggaaagaaaaggactgttttcacagcggtgggtccatgttattcatgggttctcagcagcccatttgtgagttttggggggaaataaaatactttttcaatttactgaatatattattttgcttatatttcattgaaatagaagatatacattattatagcccttaacccaacttactggagtagcatattgatctctaagggaggtgataatactccacagcacaaatgaacagtattttaattcctagggaaacttaaaaaaatagtttatttttagcaatcaatgagttgagttatttgaagattcacctgcaacttaggatggataaatgactatttgtgatccttagaaccatgatttagggaattcctcaaaggtgattcaagcagattcatggttttgaattgtgaggaacccgtcattctaaaggaactaatgcaacacgaagattcagctcaagtaataatttagcgtgttatatccagcaaagggaatcagctctgagagtttaaatgacttatccaaggtcccacaagcggtagatccagagtcaaagtgaagatgaagtttgtccaattattcgatgacagtaggacttgtcaggagagtcaatcctgatcatcgagcccccgaaatgatgaaatgacctgaatgattgtgcgacgtccctatttgctttcacggccccgacactcgttctgccccagtgggtaacctcaccttttgggggtggctttgtgggtggaggctgtggagcaggactgcagtcagacaaggaacatgaaggaaactgcgtttgtgtgacctcttggaagcctcctcctggtagctgggcttcctgggattgtcacagagagactgccatctcagaagtagtgacaaaattaggcattcccaggctcacggtttctaatcaatcagcctgtcacgtatctgaggagatatttcagagtgaagatagcgtatgggaaagcaatttccttggacttctgcctctgagttctatgtctggagtagaaatgaggtgcttagtgttaaacaaagccaagtagggagacagtgatgtgactcttatgcatgcctggaccaaaatggcaaatgtgtgcctggggaagccacaggaggctcccagaagcagccttccaggttctgcagacacttaagaaaacagccacaattaggtccaagggaagggtgatattctctccaaagacactttaaataagaaagagctgttaaagctttcctgtaggctgaggatagaccttttaaaatgatatttagtctcaggaaaaaagaagacatattgttataatgtgttgtcagttctctaaggaaatggcataaaaaggagattttattgtggcttaatcctttgttctggagaatctgcgcttttatatacagtatatattttaatgaaaaccatgacaagattactattcataaatcagcagtgaaatactaaggacatagatgctcacagctgcatgcatgtgtgcaggaggtgaggggggtggtgcatgtattttttcaaatgggttcattaccacaattggaagaaaatcaatgcaactatggcaaaacctcattgctttgttgccaaaggatttctgatttcatttttttttttttttttgtaagacagggtcttgctgtcactcaggctggagttcagtggcataatcatacctcactgcagcctcaaacccctgggctcaagcaatcttcccaccttggcctcccaaaacattgggattacaggcatgagccaccatacctggcttgatttcattctttgtgtgaaggagataggagaagggctttcagcactctgaagtatccttaaattgattgatgtattctcaaactctctgaaaaatagtggcttcaagttgcccgcctcataatttttgccacttcaaatttgtacattctatttctggttggaaaataaatacttcacaaaactattatagttggacacaaatatatcaacaactccatcatttcatacaatagctggaggatatctttgagatgaaggtcaagcaaacattctcaagtaaagccataggttatatgtggtgggtaatgtccagtgattggaaacacatcagaggagctactattttgtctttgtttggaaatctgttttgcagattgaaaaatgacagcatcgtgatacataaattactagagacttacaaggaattaagaaagtaagtagtaagataaatgatcaattggaacccaatttttcttgcatgaagtactcacaaatgagtacttgtgctgataggtgtactgggagttgtgtattcacaatgagaaagcataagtgtctttggatgggccttagctatacatccttgtaagtaatatattacaactgaagaaatccctgaggtacatctggcagggccccagcttcaagttgaacctgaagtagagagtgagcttacaactcttgcgcatgagtgcacacacacactcgcactccaaaaatatatgccaaaaaaagcttcccagaaaaaaataatttaaaaaaatccctgaaagctactggaaagtcatacatatgttaaatttggtcatttagcatcataaattgaagttggaatatcatgaaataggcagatctgatcctcccacattccccagcatttacaggaagtctgagacagcagaggttggatggcgatgatggtgatgatggtgatgagtatgatgaatgtgatgatgaaggtgacagctaacctttattgagttttgctataaactaaatgccactctaaatactttaattcataaaattctcacaacagtttattttacatctgagaacactgagacacaatgcttagattgtctgagtaacacagtaactaaatgcaagattctgttttctacgttgtagtgaaataccatcgatctcagtggaacaagttgcaaagtaatttgtagaaccattaagtcaattagggaatttaaaattctgaactatggtggtagaaaaaaagccacatttcaaatagacatgacttcagagaggcaaagctaaaatttaagccatttacttgccagtttttatttttattttaatatttttaagttttattttaagttcagggaaaatgtgcaggtttgttacataggtaaacttgtgtcatgagagtttgttgtacagattatttcatcacccaaatattaggcctagtacccattagtaatttttcctgatcctcttcttcctcccaccgtccattatctgataggcctcagtgtgtgttcttcccctccatgtgtccatgggtccatatcatttagctcccacttaggagtgagaacatgtggtatttggttttctgttcctgtgttagtttgctaatgataagagcctccagctccatccatgtccctacaaaggatataatcgcgttcttttatggctgcatagtattccatggtgtatatgcaccccattttctttatctagtctatcactgatgggcatttatgtggattccatgtctttgctgttgtgaattgagttgcagtgaacatgagtgaatgtgtctttataatagaataatttatattcctttgggtgtatacccagtaatgggattgctggtcaaatgttatttctgtctttaaagttagaatttcttaactttactatgaaccactcaaaatacttgaatttgcacatgtgcatgcacacacacacacatagttagtgttacttaatctaagcattgtgtcttggtgttctcagatgtaaaataaactgttgtgagaatttaatgaattaattatttagagtggcacttggttcatagcgaaactcaataaaggttagctatcaccttcatcatcacattcatcatattcaccaccatcatcatcaccatcatcgttatcaagttaccaacctcatctgccaatttttaaccccactgccatagatgccactctaaatactttgtaatttttaaattcagtgcttttaacaaatggaaaaaacagccgtgattttcttctaaaagatttttaaacaaaaattatataagtagttataaaaacaggagattgttcataaatcttgatctaggtaaaaacttaaaaagacccagagaaatttcacttttcacctttgttggtcttatttttttaacaactcctgactttgttcattgttcgccgaatccatctcggcttctttgatttcacaccacactggttttgtgcgattgccatttcacatgaacatctggattttttttctcctgtgcttgtgcacatttggagaaagatagtaattttcatccaaatttattctactttactcagccatcagaggaatgttaactgtacatgttcataatgtttttttttaattctaaaaaagatctatgtctgccaggaagagaaatatcctttagtttgtcaactggatccttctagaggagtcaatagtatttttgtttttgatatgatcttccatcaccattcacagacttctagaatcacagcttcatatgctggttaattctaccatatagatacatatatagtaagatggaggcatttctctcgagttcctttaacactctctgtttctttgatattcttcttagtcattgctgcacttctgacaagtctgaatagagagttgtctttttgttaattgttgaatagatgaagagtatagttaagatattatatttcaacatttttaaaagctataatgcggcctgttcctttaggtgtatcactatagaaaaatctctttattcttgttcctttagaaataccttgaacaattagaaaatttcctggattgatgattgcccattttgctacttaaacactaaatttggtcacatgatctgatggaattggaatatggtatcattaaatatctgttgcaactcagaaaccaatttcttctaatgtgctcctccaagggcttcatttacattgcctgattcatccttacatccctatgacataaaagaagggcaggtatcacattatccccattttccaattgaggcatctgcgaccagaaaatggaggcacttgcctatagttacacactatgtcagaggcaggagtaggcaaagatactacttttgttcactgccaatccacccttcttttcattagtcactagcctccttatttcgtaaggtgtaggccattagaagattgatcttgtggggaaaataacatctgttttaaaactcaatgccttttacaagtttatatgccttgatataattttaataggtgcatcattgcctgcttttctttatgagagatgatataaatatgaaaaaatacacttgcagaaatgaaatgaaaataataaataaagccctcttccatttccattattctaagtcatgctccttgagacttcaatctcaatatgatgttaatagaaccattagatatgattcatatcatacataagacattcctattgacaatttcatcttgaccaagggtcaatggatccattacaatgcaaatcttactgtatactttccatctaaatcaaaagaatttggtcttgtgtccattctaatatgtttcatgaagtagaatccaatctcagacatgaagtacacatctgtttctcatactaaatcatgcctgttcctatttgctctcaatttaaaagataattaattacgttttacatcaatagactactttggagtatttaaagaaatgcatagggtttatgggaatccaagtttgcctgtttaatacataccaacctgcaagaaaaattccttcatggatgtgcatctcttaattttggggggtgcatgtaaagctattctacgtatttggtaagatatgcagaatcaggacatgttccaaaagattacctaacccagtcttgtaaagtacaagaacacactgaggtttcaatcagtttttcagataagctgaagaatgtctcactaggcacaggattttttttaaaaaactttcgcttttccccatgctatttatttctactttttttttttttaatcttcatctcttattcctgcactcttgggcatctttcagaatccttctctattcagtgctctaagtagcttataaattgcaatctaaccttgatatggacaatcattgagcccatttctggccacctttaagtttcagggctctcctgatcacctgttatctcttccctttccttgtccgtattattttccttctagaactgtactactgcttctctctatttgtgcaccacaacagaaagacctgctgctgatgagggcttcctgttacagatgaggttaaagtagctgaggaatagctgaacaagaccttacgtaaaggccttttctcccctagggttccatgacattgcatccatactctggtctcaccatgctcctccatcttcctttcttctttcttggaacgttgggtagtgatgaactttggaccaggaagacttctgtataaatccctgatctactaattcttgcggtgtgatcttgggcaaatcctttaatcttgtctaatccttagttttgtcatccataaaataatgataataattatccacattggaagattgttgtgagaaggaaattaagtgatttatgtaagggtcacaatgcctgactcaaagtaggtatttaagcatgttgttgccttgctccctctttactctctctttttttcccatttctctccaaaatattcgattttgtgaaacaaaaaatgttgattttttcaagctttccattatccaattacatagctaccaactgatgagctgttccaatatttatttcttttcaaagcgctttacttcttgtgggttatcgacagctagacatattttttcctctttcagttatgaaagatattctcagactcacaaagctttaaattttattcaagacattgaaacataaaagttcagggattattcaatgatgttaactattgaatgtacacaaaaatgatcttacttgcaatctagtttgtatgctgtttcaaacatgcccaggactcccaagttcaaaggttctctctacacgtaagcggtagtcaaaaatattagttgttttattgcggacagccttaatttatataaatggaaaacatctaaaactgcaaagtacaatagtccagaaagttttcattagcaatccagttcttggacatcacagggaaactcggcagaaagaaatgataagttaattgttgaaatgtttcatattcccaggttcagtttcttacaggtattcgcacctgcctcacctgcacctctgttactctctgtgacatgttccaccaccctggacaagacaaatgtatatttgaaagaataagggtgcttgttagtgggtaggtgtgattatgggaggcaattctagtgaggaaaagatgggttggcgtatggggcagcagtgaagaaaaataaataaaacagtttatttgtagtgggactgatccctcttgctcatgcattagtgcttggctacaggagagtagtaatttattgatgcagatggctatgtaaagtgcatgcaatttgtgagggggcttgacccttgactgatgggccatatgttgtaaagccctaggggcgtcatttgcctccgctctcttcctctctctgtctctgcacctatggtccttattcaatcaccacatattgaactatagacttaccaactcccccaataaatctccaactaatggctcacaaaggccataacttaaccctttctacacaacagagcacattattttgcatcatgatcacactcagtgaaataaaagataaatattatatgacctgcctagaatagaaagcaaattgttgtaaaatgctgttccctgctgggtattcactgcatttggatgtagtagggttgctttgagcttgctgaattctatcgttatattctgccatgttataattacagcttactgttataacataattcttaaacactgttaatacaccacactagagaaacatttaatgttttttaattagcttcttttgtctgagtcttcttttttccctagtaaaatatggaacatatgctcaatgaaaaaatgcatatatttttattctcatgtagaagcaagtttttataaaatatattagggcatttgtatggaataacagaaaaaaagtacagtgtacgttttaaatactcactgtgctctgaattttctataggacccattccagcagaaagacttaatgaaattattcattctccactgaagcactgggatttccttataatgtgggctgtctgagtcctaaatgccacctgaaaaagagtttaggacaccaagactagaaaaaagtcattgctgcttatctattaacttcattttttcccatccaatagtaaaactgaataaatgatactaatcagtaatgtgcacatcagtacaatttctctaatattaggaataccagtcagttgccttatgcttattcccatcacttggataagggagcagaaggtgtcttccttggaatcttgagacaacatcactgcaagcaagaagcagacatctattgctaaactaaagttgaatttttgtatctactccttttccccttttctgggcatggctcttggtagatttagcagcaatttagagagcctgggggagtgtaggaagaccacaggtttcaccagtgcatagcccatctgtagaaatagttgtcagagctgagtatctctagttatattctatgtttgtaataattagcttcccagaaaacaatttgtcttttagatagcttgctagtacagtgttcacagcttgtgtgtgatatgttttatataatatctctgagcatcttaattcagtaggaatataatgtttgatttctaccagatcaggtttcatatcctgtgttggtataaaaaataggtttcataatttttttttcctaatgcataatttccttacactatagtgaaaatccagctttctgaaccaattaaaagaaagatgaaatttcatgtacacatatgctgtgtcaaaatgttcatttatgagtcactagtcttatcaacatggataactgatgtagaaaaaatattcaaatatacagaaaagaagaagtcattgtcttctgtcctaaacccagtagacctaacacatacaatgcaggcagaaaggaaatcagcataaataaaccatgcattcccaattgaatctcaataatttaaacataaatcctttaggctttggtaccttttttccacatgggcttttcttttggatttggcgttcctagcatcatttagaattcatctgcgagccacaagtaaatagagtttccataaaccttgaataaacaatcccctttgaggttatattccataatttaaggaattccaatgaaaacatggttggtaaggagttttccaagatgtgtgtgtatcaatatatttgcctataaaaaggaaccaacatgttaaagcataaattaccaactttcccgcatataccatatgcacaagggagggacatctataatatatgtatttctgagattgacaacaagaaaggatgaattgctaatattctgcttaccatgtattcaaaaagtctccatagttttcagaaaatgtggtgagaaaaacttttctctcttctgatgtattttctctctaattataatttggcatctagaatgtgttgtttcttttaaaaataaactaaactgcatagcaaactatattgattttaaaagccctctaattaaaatagcaacttaacagcaaatgaccatgaagtatttaaaataaaaaatgatgatgtaaattgaatgtgtcaactaaagttggtacaaatgaagattaagagaatagttaccttcatttactctatgtttcatattatgccttatcccagttcttcagttagttaatatagctataatgagttcatactccttagaagcagccaacagagaagcttttctttaagaacattctaaatggttcaaatcaataccatttcctaaataaaaactttcttggctcagatttaaaacacctatggctgttggcttattctttatgctagcccaacaaaatgccacgtaatcttgtaagtaagactctgccacattctgatatcaacattgtcaatgagaaaactctgtgtatatacattcagaaacattcaattataattcgcctcttaaagtcatataactatctggtattacattgagttatcactgaacatattaattaaaatgcctcagtattgaactcagtggttcaaactgtttgtgtaacccaaaaacccttaatcattgacatttgaagattgctgttggtttttttaactaataggacaaaatttatttttagtacaaaaataagatataagaatagttacttaggattgaaatggcatgttaaatactaaaggaaaattggaatttgttttgttttttagaatggtttctggccaggtgcagtagctcacacctgtaatcccagcactttgggaggccaaggtgggcagatcatgagctcaggagttcgagaccagcctggccaacatggtgaaaccccgtctctactaaaaacacaaaaagtagctgtgcatggtggcttgcgcctgtagtcccagctactcgggaggctgaggcagcagaatcacttgaacctggaaggcggagcttgcagtgagccaagtctgtgccattgtgcttcagcctgggcgacagagcaatactctgtctttttaaaaaaaaaaaaaaacggtttctatgtcattgttgaaagtgataataatttttatgtatatgattttatgagaaataatattttaccaatgcacatatagggtacatttttatattttttattcatgaggatttccacattttttgtgcaaacactatatgttatcattattttgtatcttctatgtaatatatacaataaatcaacaaatatttattgaacacctactccgtgctaggtgttagaatgataacattgaataatattatctcctctgccttgaagaactttcagtgtaagctaccataatatttacctgaggatttttcatgtttttctaacagtttataaaattcctatatttggaggctctccagaaacagacggaaagggactagtgaaattatagttgaaaggtacagtgtattttgggggacaaatatttatgttattgtatttgttttctatgatatttttaaaacatggcactattcccctgacagaagtgaatttgccaagcattagcctagggtgtttagaagtaacagctgaaggattaaggaaacatcagcattgagtgggaggaattcagcataaagtgtgattagagcctccacagtctgctattcttagctattcattccctgcaaaatcacatcagtaattttcagtgacatttttaattgtccctgtacaaaagataataaagtagaagaaaataaaatcaaaagtgagaaaattcaagtactactaagatgtaccctggtgtttgttggttgtgggtgccctaaattacgtattaacagagaactgccttgtagtaaaatttgatgcccccatgggccctgactttacctttatcatgtagtttcatcatttcaaggatctttccttatggttaaccccttttcatcttctgaacaggttcttacagccagagggttcgcgtgctatttttagcgtgcttctttgagtggtggatagtggttgggaatttctttgcctgctgcatgaatacacttccctgcagagtgtacaaagaagcacttaatttcgagcttttcattttggttagtgacactgcaaacatagcacaggtggctataattttacaccatgtgagtaaaaatactatttttctttccccgtcaaccttcttgtctgatcgtcttaaacccataagatggggaattacagaaactgatattttaaattgatgaactagtttaagatactctttgaaaaggaatccaaacttgctatgtaatctgtattagtctgttctcacactgctataaagaaatacctgagattgggtaattcataaagaaaagaggtttaactgtctcacagttccacaagctgtagaggcagcatggctgaggaggcctcaggaaacttacagtcgtggcagaaggtgaaggggaagcagacatgtcttacatggcaggagcaggaggaagagaagggcgggggggaggtgtcacacccttttaaccaaccagatttcatgaggactcactatcacaagaacagcaagggggaaatacgcccccatgttgcaatcacctcccaccaggccccacctcaaacacaaacactggggattacaatttatcatgagatttgagtgggaacacaaatccaaaccatatcataagcaaaatgtaaaattgttaaggatggggaaagatttataaatgtagggttcaagttagtgtaaaagcgatagcattgtccaccagtgactgttactgggcctgtatctttatcatagtggatcatagttccattattgtaattatgccatagttttgtaaaaacctttatctgttatttgagatataaaatgttgctatctggcaatttttaggttgtagtctcatcttttaggttagaaagtatccttattttataaaaaatctctctctatatatatttagattaatcttctattaaggactagatattcatgttcaaacattaggttttcctgataatccactttttagataatctcagtttttattttagatttaggggcacacattacaggtttgttacaggggtttactgcatgacaatgaagtttgggtatgaatgatcccattactcaggtagtgagcatagtacccaatacgtagtttttcagaccgtttcccttcctttttcccccgtctagtagcccccactgtccattgttcttatttttgtttccatgtgtgcacaatatttactttccacgtataagaaaatgtggcacatatacactatgggatatgtgcagctgtagaaaaagaacaaaatgcatatatgcagcaacatagatgtgctgcaggccattaccctaagcaaattgaggcaggaacagaaaactaaatgccacatgttctcacttagaaggtatctttgaatggcgttgtcagacaaactcaagcatggatccttgctgaagtaccagaatcttgactggttatggttcaaaaacaactgaatagtattcacggatctgagtcttagatacaaaaaatgaaagtaatctagccgttttatttagctggtactgaagtgtagatgatgtattgcataaaattatagcaagtcatacaatttcccttggctagttggtcattccctttctctttatggtttctattcttgtacagatttctaactagtgatacagaacaataacttggatgacttaaaaacattatgctaaataaaagaagacagactcaaatgactatatgcttaatggtttgcttcatataaactttttgaagaggtaaaactggattgttggaaagttgatcagtgctttgcaggggccagggttggggagggaattaactgcaaagaccagagggaactttttggtgtggtgacgatggtctgcatcaccatcgtgtcatgaatgtcaagactcatccaatcttttctaaactttattaattttttgcctgaaaattatatccaacaaaagatgttagaattccactttggtgtgaatctaacctagacaagttgatactttttcctgtttttttttcccataagttaaagctatactgagtttattaatgaagttattaataaaattatttataaccctaatatattcctggttctagctgactttacctgtagttactaggtatttgaatagagtcaattgaagtataaattttaaaccaaaactaaacacttttttcccaagaaacattcgtcacacaggtgcatataaaatacatgcttacatctgaatttgcatataaagtgttgtaggaaaattagaaagcatatggtcttttcttctttttcattgtctaagaagcactaaagccaaataacttggcatgattcttccagttttactctttttaaatagctttattgtcaggcagatggggagtgctagccacttattaaaattacacttgtacatatcgtaagaatgttttatatttattcatgaatataaaatttttagaattggcatttaaaaccaaaaaaaacctgtcatagagttgagtaacaactttatttgtcactttgaaaccactttgaaatatcttgcagcatggacggttgcctaattaatattccaagattcaggttctctttaatgatgtttttaaaagctctccatcttaggaagccaaagataatcatagagtagagattgaattacatggaaagaatgaactttaagatgtggcatctcttccaagttgtattaggaaaatatatatgggaaaacattatcgtatactttgtaataggtactttcccgccctctgtgaagagtttaaaaatcagtacttacactggatagttttcaagcatcattttgtgagtgaataatctgagccaaagagatgtaacatagtccatgaacaccagacagttaaaagattcttctactttagaggttttttaaagactgatttaaaattaaaaaacagatatctatttattcatcacaattttgtgctacaaatttgaagaagtagaggataacattcttttgggtacttaatgaatatttttcaaataaatatctgaattactaatacatctcttagattcatattgcagctagagaaataactgcatcatttgctgaagaacatttgaaaatgtagaatttcttatttgacacatgaaaatatattacataatttaatatatcaatgaagacaggtaaatacatagataactacatatatagatacaaaccagaatatgcaggtaattgactttgaaaatttgtcctgaagacaaaacttttagacagttttgaggagatactatgtgataaggcaaattttataaaactgaagtcaaaactaaaccttctgtcattcaaaactatcatatgtcaaaacgtttttaggtagaactttaatagaactttagcatcttataatgtcatatccctgataaacttgagtgtatgcagagaatctgccaaaatttaatgagcacatgtctgaacaaccattactttgtggctaaagatatttctttccaatttctctccccagtatggttactctgcctctttaatttatccttttaatatgtgcagcaagtgaagaaatagaaagcttgggggaaaatgaactgctataaaaatgcaagtatctccagggtttttctacattctcttttctttatccctctttatttctgttttatcaaataaaatctttttctcctcatagttgcagtatccaaattgtgttttttaacacgtgtatcaaatggataaagtttaatagtataaattgccaaacaaaattggcataagagtttctccaggaccacagtttggtgtacaatatgataccaaatatatcctaaaaattattttctcttaatttagttatagatgaaatgccaggtgttgtattgcaagggtgattaaaatcaacttagctccttggaatctttacctttgtctacataaagctgttaaaggaaactggaacccgctttttctcagtgatgacatccaattgttttcccttatatatagggctatgaaagtatgctatgagtttagcaaacctatctttgcaatgtgtatgtgttatgtagcttggatttgtttcaaaatctgtagagaggctgcaaaatttgtaaccaccttatagaaaagtcaggtgtactcccttccactgcccttcacattttcattgtatccatgctttcctttgcatgttcctctaagataagagttaataagttgtaaaaacaaacaaacaaaaaaaaaaaacaaaagaaaaaatgtctctgataccttagcatagtgtttctgaaccactttccattactgccccttaaaggagtcttttcaacaatttttcctaattgctattcccttgaaatgttactactacagataaactgtacatctgtttatatactgtatttgtgttttaatacataaaatacttgatttttggctcactcccctgaatctatttttgcccccttaaggttagcattgcctcccttgagaatgcaggctgtggcagtattagattgtccactctagtcaggtaggacacattgtcatgtgctgttctgtatgttccctcttttgacttccccttagaaatgctttaataattacattattcaaaggcatagccagccatggtggcactcacctttggttccagctactcgggaggcttaggcagggggatcacttgggctcaggagttcaagaccagcctgggcaactggagtctgttctcacgtggctaataaaaacatacccaagattgggtaatgtataaaggaaagaggtttaatggacccacagttccacatggctggggagacctcacaatcatggcagaagtcgaatgaggagcaaagtcacatattacatggtggcaggcaagagatcttgtgcaggggaacttgtatttataaaaccatcagatctcataagacgcatttactaccaccagaatagtatggggaaaactgccctcgtgattgaattatcttcacctggccctgcccttgactcatggggattattgcaattcaaggtgagatatgggtgcggacacagtcaaaccatatcagcaacatagtgaaaaccttgtattttaaaaagaaaaagagagagagagagaaataaaaatgcacccttccttccttcctttcttccttctttccttctttccttctttctttctttctttctttctttctttctttctttctttctttctttctttcttctttctttctttcttgtctttctttctttctttctttcttgtctttctgtctttcttttagagttcattgcattttttgtcttcaactattattttaagttcaggtgtacatgtgcaggatgtgcaggtttgttccataggtaaatgtgtgccatggtggtttgctgcacagatccacccatcacctaggtattaagcccagcagtcattagctattcttccagatgatgtcactcccaccaccctcccaactacaggccccagtgtgtgttgtttccccactatgtgtccatgtgttctcatcgttcatctctcacttataagtgagaacgtgtagtgtttggttttctgttcctgtgttagtttgctgaggataacaacttccagctccatttatgtccctgcaaaggacatgatcttgttcctttttatggctgcatagtattccatggtgtatatgtaccacattttctttatccggtctgtcactgtggacatttgggttgattccatgtctctgctgttgtgaatagtgctgcaatgagcatacatgtacatatatctttttgctagaatgatttatattcctttgggtatatacccagtaatgggattgccgggtcaaacaggattgtctttctggttctagatccctgaggaattgccacaccatcttccacaatgctggaaataatttacgttaccaccaacagtgtaaaaacatttctttttctctgcaaactcaccagcatctgttgtttcttaactttttaataatcaccattctgactggcatgagatagtatctcattgtggttttgatttgcaaggaaatgcagttttctttgtctatttcagaaagagcacaggggatgggaaaagatgagaataagctagccccctcctctctaaagagagaatttatattttggttcttatagatgacattcttagaattaatatatattccatgaatgagaagccatgtaaatctacttaaacagccatgctaaaggattaaggttgtttgccattatcatctccagtagctcccatagacttccactatgttaatgacaaataatatgtgtatcctccattcaatctctactctggccttcctgataacactgtaactcatatctttccaaaccctataaatagatgcatatttaggggttatgtcctggactgaggtacagtgttgctagaaaataaatataacacaaaacacataaaccaattttatgaattaggctaatttatgcaagatgatgatatgtgaatgatgagaaattatgaattattattacatatattaaatgcttattagaatccaggtacagtgttaaaaactttccatagattttctaatttttatcctcacaataaacctatagatacttttgttatttttactttatagataagaaaaataatatccaaagtgcattttaaatactggtttaaatagctaattttattgatggttataatgcgagaagagattataaaaatcagagttgactaatttttgcttcacttttttatggtggctttctgtcttgccagttgtggagatagtagcaataagtacaaaaataaaatagccaccaggaggaaaaaagacaaacaaaaatatgacttaaattcaaactcagactctaaaattggctgttttgaaactaacaattgttctaatcgtaatcatggtaacagctggcattagttaaccgcttactaaatcatcatcaccttcacagcagcattttcattttactgaagaggagacaaagggttagagatgctaatcatattccttagattctagacctcgatattttattagtgatggtctggattatttgttgttgtgagatgtgttaagggtaattaaatagccttctaagaaaactgaaaacgtctctttttttcacgtaaacaattatcacaatataaaatgagtagaatgtgccatttttttaaacgcctaaatttttagaatcgtatatattttctgaatataattgcccatgaccataaatttttttaactcttttgagtttaatacagtgtaccttttcttttgaaaattttcagtaacttaatgacggcattgcttatacgggaaacattatgcaaatgactcacaatgaagtctgtgagtttagttaagcttgagaaaaagtttgtaattaacaaattagcatttgaaaaagacatttgaatatgcatagtagaaaattccacttaacttgtggggtgtgttcataatgattatttcagaattcatgcatatgcatcttttaacatgcaaatattttaaaccttagtggactagtccagatctggctcatttctgttgtggttgttgttttagttaaatgttgaaaattgtaaataaggcatcatgaatacacatactaacatgtggagtcctctttacttctctttgatatagtctttttaattattaaagacacaatattaaatactttctatttattattacttcactgtggataaaaataacattaagaaaaaaaaatcttggtatctgacttttcctaccaaagtgtataatgtgtactagaatgctatagtcaggacttcatttacctttatgttcaattgtgctgttagaaattagagtttgatgtctcacatacacacacagacattacattattcataaaaagtggcaagaataccttgtgattacttttaaacctctcttatataatatattggcttcattgtaaagtatattttcttaacaattttttaggtaggtcataaccctcctctgtttaaaaaactctaccagttcttgattaattatcagatatgatctcagacctttagttcagcattgaggactgttctccaatacaaagcacctctctcacctacatctcttcacatgttccattctaatctggcctcgattctaattcttatgctttctataaatgcatgatcgctaacccatctaaatgtttagacaaaccgcttttctgccgttataccttactcaccttacttaggctacatgatattttcccttgatgaattcctacagtatttatagttcaactattatgttccctgcaaaatggttatgtggaaagttatagctaatttaaatctagggttgataaatatgtgaattctttgcctttctagatagagaaattatgtcttgttttggtttggccaacctcctaaaatccaataggcaactgaggacagaagattgggcttgacttggcttacacagaggatgggcatctgtttctaatgaactcgtaatttatgccccatcttgtagccaaaaggaattaatagacctacagacataaaaaatgaataaactattttttccacactagtttgtccataacacgacactagaaaataaggtcattacatggtctcatgaaacccctgccaatcctatgacttgatgtattttaggttctttcactttgctttatgtatttgttgtgactctttgacaatatctgatgtttaactttgccttcagaaatttgccatggttcaacttcctttcagtgctcctgccttccttttcagtttattgatagtttcccttgccctagacactcatgtggacactgattacacaaaaccaatcaaaatcgacattggaaaagcaaaataattaagaattaaaatcagccagttcctgacactagctccaaggactagacaggtgacacctgaacagagtggaaaatagttgttgggaagtattccaggcacaaggaacagaatatgcaagggcattcaataatcaatgtctctgaggacatcaagtggaatataaaactagctgtattatcagatatcagaaaggccttatgagccacgcttacactttgcaacatactagaaaaaaagtcattcaaaggttgtataatcaatcctagctgaagatgcttgcaattgttcattttcctataaacatgtatggacagtggataaatcccaaatttttactctgaagcttgtgttgtccagattagatttgctgtttaccttagttttatttcctgaccaattttcaatccttctttcgttacctcccagacacttgctttttaaaaaactatatttttacaaaaacaaaaggacaaaaggtttttctagacagtgttagtgcattcaatacagaaagtttccagttagacaagaattttactgtctctatatgaagacttcactttgcactaaatataagaaaaaatataaggaagaagaaatgtaagaaaaaaaaaaaccaccagaaatagtcttagaaatgcgtatgtttgtacattcatccctcagtatctgtgaggaatttgttccaggacctcccatggatgctcaagtctctgatataaaataacatattatttgcctatcacctatgtgcatccttctatatactttaaatcagatgtccccaacattttaggcaccagggactggttgtgtggaagatgatatttccatggatggtgcaggggaaggaaggatggtttcaggatgaaactgtttcacctcggtcatcaggtgttcaagcagtagattctcataaggagcaggcaacctagattcctcacatacgcagttcacaatagggtaagcacttctatgagaatctaatgccgctgctgatctgacaggaggcggagctcaggcggtaatgctcgctccctcctgctgtgcagcccgtttcctaccaggccacagaccagtatgagtccctggccccggggctgtggacccctgcttgaaatcatctctggattacttttaatatttactacaatgtaaatgctatgtaaatagttaatactgtattgcttagggaatcatgacaaggaaaaaatgtctctacatgttcagtgcagacataatcaaccatttttttctaaatacttttgatgcagtttgcagatatggagggttaatttaattttgcaagctcttataatcaactattgggattcatcattattttcagggtttttctcctccttttatgactgaatttatttttttaaataactgaattactgcataaaatataattattttcataacttataaggatgtatagactgtaattaggctgttgtatggtagctgacaggtactgctgatgaaattttactaagtgaccagaataataaaatttattacacaggttacttcctttagaggttctactttttggtcttcaatatctaacatgctttctttattattaatataaatataaaatagatcttaatggtagggacagatttctctctgtaaatagaagtacaaattttgtatgaaaagttgaagagaaataaatataatattcccaaatctatccacaaccattcatacttgataaaatgtaagtttactgtaaaatgaatgaattattgatgtacttagcaaaacattatatctgcacaaagtcataaattaaacaaactctaatacattttatgataagcataatttgacctgagtccttgttagcctcaaagcataatataatgatcagaaaaattgggggtctaatcaattaatttgaaaatctgcaatgagattattatttatctagagtgaacgctttactagcatacaaataaagtttttataaatgaaatagaataaatatctaattattggaacttttccattaaataactgatggcataaagaggcttctgcttttaaaaaaaaaaaaaatatttgctgatataaacctgagaatttaaatgtcaattatggcaaaaatattttctgtacaactttgttgttttttaaaacattattaatgtaacagctactacatcttattattttcatccattctgcaaatctggtgaatctatttagtctacatctagaacaactagaaaaatatgtataatatatgtatctaaaagggaaatgaagatgcatgaaaatatctaattgtgtaaatactgttaagctagagaattaaagatgataaccccttttcaccattcagccaagcgtgaaggagcaaaagagattcaaaacttcattaattgctctcacacaacgttacaggccacctgcacttcaaagaatttacattggagcagatggattgctgaatgcgatatcaaagaatttcagaatgtttgttttaaaaataacctggattctaaggcaagcaccagcaaagcatacaatttacaaagatgacaaagcttttcttattaaaacttctaaaacgtataagtgaaggcacatttttatctctaaaataagagtatacataccaactactctttaaaatgatcaaagttacatatttaaatatataaatgaaatatattcatgcattatttgaggcttttgaacatacctaactggtttcctttagtaactcctagatcagtgaaatctagctttttcccagtataagttttcacatctctctgattattcaatcttttgaataaagatggtccatatggaaaatgagatttttaaaaaagtttaagagtaactttttttgcagaaactcctttcacttgtcatttgattctgacttgagctcggtactttgattgataggtcctactcgcaatgcactgacagaatccacattggaatagctagttaagatgaatcagagctaatctaaatgcatcttggatcagattatgctttacttttggaacatattgtaatttttgtattttacagaagtttctatagctttacccacaaattaagttttacttggaatttgcatcacaatattttcattctttaaatattgatgtatcaggggtcagaaaacaacaacagctagagggctgaatctgaccttgtacctgtttttgggaaataagattttattttagcacagtcatacccattcaattacttattgtctgtggctgcttttgtgctacaacaatagagctgagtagtcacaatagacagtatggcttaccaagccctaagtgagatatttactatttgcctcttcacaggagaaatttactaaccctgatgtgctagcacatgttataaccttgggtaagttttcttaagctctctgagcattaggttcctcatctgtaatataaagacaccgatggtgtctacccagatgtccctgcgtgtggtaataataatggtacctagccgtgatgattaaatgggataatataagctgttaggaaaaggcctcgttcacaataggtctgatacaaatgtcacccaacatcaacatcactgtcattttctcaggaataatgctaggtcatggagactgagaagagggtttcaaactacattactgtagtctgttcatcttcactagtcaaacaataaagtgggtagcatggttttgtattatgatcatagaatttgaaggtggaagccctgggtatgatgacaatttgccttcttctttgctgtttaataagacctgcagtgagtaatgtaaacactctaatcctctctttcttacctgtaaaattataataatattattaataataatatcatcccccaataggctgtatattgtaaagggccaattaaattagaaatatgaagtagggtaacttgtaaggttgcaatacaaatcaaaggtttcactgcctcattaaccgtacctcacttccatgctttgaactttggggtaatgaatatgtgtaattatttagctaagagggctcaagattaacgcttttgtgtcgagtgttgccacacacatcaacatggatgatcttacaggctaatgagggaaagaagccagaagccgaaggccacagacagtattatcccctttatataaagttctacacctagaaaattaatctttggtgatagaaaagagaatcagttacctttcagggtgtgtggaaggggcatagggtattaatggtagagattgtaggaggcaggtgatgttaccggtcttcttgtgggtataggttacagggctatgttcactttctacgacttcattggccagaacacttatgatttgtacatttcactgtaggtgtaaaatgcttacaagaagaacgaaatattaaaacaaaaaaagagaaaatgaaagaaaacaacaaaagtgttaagtccatccactgatcctgctttcagagccataaaaaaaccgtctgctatacaatctatttacctcgtcctctcacttacaccaatctttctttccacagcaccataaaatctacctacatacatgtaagaaaatgggactctcctttagccagccttgtctcctataccaccttgaatacgtgatgtttgacagaaatgacgttttatttttctctttatataaatcctatgatctccacttttacccaaagccttttttaaactaaagcattatgaccttaatgagactcatagatcacgttcactctctatcttacatgtatcattgcgctattctccaaagttctgtttgaattttattttatatcactccttttcctaaactatgcacatgctcatgaagacaaggcaaaacaaaaagaaaaaataaacaaatgaacaaacaaaaaatccacaggtcttaatagagagataggtttgagtagcaagaaaatatagtttagaaaataaatgttatttatttttgaaaagataatgccctatataataccaaatgccctatataaataccaatgccctatataaaaccaaaaagtataaaagctatgaagagaaaatcaagtctctattttaccctaacctttaggaaacccattcccttctcagaggtaacacatgttgctgttattttgtgcaaactttcattatatctgtgaataatctgcgcatatgcatatagcagtgtgttttacaaaaatggaagcttgttgtagacattaccttatactctatttccataagtgaatcatgtatcttgaacatcttccatgttaataaatattgagtttaaaatacccccaaaagtaatggaagcctagaaacacaaaattatggagctttttttttttttttttttgagcttgagtctcgctctatcaccaggctggagtatattggcgtgatctctgctcactgcaacctccacctcccaagttcgaacgattcttttgcctcagccttccgagtagctgggactacaggcacatgccaccatgcccagctaatttttgtatttttagtaggatggggtttcaccatgttggccaggctggtctcgaattcctgacctcaagtgatccgaccgccttggcctcccaaactgctgggattacaggcgtgagtcactgcaccaggcctatggagcagttttttaaaagaactttgcaaatattataaaattgccttctttacatcatccatgtagaatattccttataaccacttttgtcagtctgagagcgctttttgttttatctatgtctgttaaaccatatgctgaaactgttttctgctttcttcatgaggctttcccttatccttcacagaactatattgaataaatatttagtctattactcttgaagtctacactgaaaaatacttgaaacattactacttttccttatttgtttgtggcattctggccacgagtttgtataaattatgtttcagaactttgggctttgccagatgttgagtaatacgctgctaagatgtaagtacaaatggtttcactcctgactcctttgtacaagtgaaagacaacttggaattctaaacagattagaaatggaggttgccattcgtttgagctctcttagaaaagaaggctctctttgacaaatccctctgcttattagacaaagtgcaaaaagcattacatctggagttcataagccattgttttatggaattgatccatcatacaatcccttacgctcttgaaataaacccatgagaatttaagatgctatatgcacacttactaacacattcactcatacatacacacccctctatgcacacatgctaccattagagacttgtgcccttgcaaaaaaatcttatagcgtagaattgcaacatgctttttaaattgatagttatttttttttaacatcgtttatctttcaaaagacttctgaattcagctacaggaattattcttattcctcgaaacttataaccccctattctttgtactcaaaatgttttgtaatacaacattttttttccattaaaaagagcaaaagtaaagctacaattatttttgaaacacaccatccccagatacttctgaatttattttccttcctcaaatcttgaagcacgtattatttctttcacatctttagaccgttaaaactcaattgttcattctgtgagaagaaaacttaaggaaacattcagcaagtagctttatatgtgggagatggatttttagaggattttaggtgtttgagaagagtttctcatagattctgttgctttcagaattcctcaggatgccattctaaaggatgactgcaattcagatcagcgaagtgctttgatgtcttattttttcttttgcagattgtactccacatgttcagaaagcctttccctagagtataatttaatgtaattgacagtcattgttcctcgaaagtttgaattaaattaacctgagcctgaatgaaactggtaaaataaccacgtacagatttcattttattttcctttaggatcagtgacaatattatgtataaaattggcagttggctattagatcttcattgaatcaccctagatttgattaaaagtagatatttcagtgtacagtaatttaggttcatgaaaaactcttaggtttctcatttagttattgggtttattgaggaacagggtattttatgtgtgtaatgatgaattttgttctttctctttttccactgagatcaaatacagactgcaaaattgaccgagcatgaaattgtttttagaaattgtgggagctagtttcgatggcaagaatcagaggaaccgttgttagtgaaaatgtgtttggaaaggatgatggtagtgggtaggagagaatagaggtagagaggtgttaacataaggcaaaaacattaaactgacaaacacttctctgtagagtagttgatgtgttaagccagcacacttaaaagcatacaagtttttggatagaaaagtcttcattgttctgactgtttttctggacatgtagctggaaaggagactcaaatcttcatatggattttgtgtcttatggtcactgacactgcaaagcaattagccttcatgatggctgtgcttatgcaatactaattaacatgcctgttgtgctgttttccctgtttgaccatgtgacagcccacaggtctgacactctctgtgaaccaacagctgaggaaatttccaacatggcagattttttttacaaaacacacccaaacaaaaatggaatcacacttttcctgaacaactgcattaacagaatgtgttacaacggatctacaattagaggattgcattcatatgtactggggaaaaaaaaggagacgagaccctactcaagcatacggatacaaattgattatacctgggtccagaatttcaaagtgtgataacactgtattatagtatcatggagaatataatttaccagtacaatcacatctagtaaaattatcattgaaagttagaagtaaagttgtcaatatatttacggcaccatgtgagacctctatattgaagggctaatttagtaaatttgtatgtgttatgactttaagagtttgggcattggtgagttttgtttctgtgtgtttgttcctgttgtgagtgggactggaatactatgattaacaaaatcatatacaggcacttgatatgtggattgtacagtctagtgggtgaagttggttgaagtttatttataggctctacaaataaatataaaattagcactgatgtgaggggaggtgcttgatactctgagattgttaatagcagtttttagccagattgtaaattgaggtaagttcctttggaagtgacaattgagaaagacataaagtaaaattgacggttaaatgggtaagctgaggctagagcaccaaagacataaagtaaaattgacggttaaacgggtaagctgagactagatcaccccagacataaagtaaaattgacgtttaaacggggacactgaggctagatcaccccagaaattaagtaaaattgatggttaaatgggaagttgaggctagagcactaaagatataaagtaaaattgacggttcaatgggtaagctgaggctagatcaccccagacataaagtaaaattgacagttaaacgggtaagctgaggctagatcaccaaagacataaagtaaaattgacggttaaacgggtaagctgaggctagatcaccaaagacataaagtaaaattaatggttaaatgggaagttgaggctagaacactaaagacataaagtaaaattgacggttaaacgggtaagctgaggctagatcactgaagacataaagtaaaattgatggttaaatgggtaagctgaggctagatcaccaaagacataaagtaaaattgacagttaaacaggtaagctgaggctaggtcaccaaagacataaagtaaaattaatggtaaaacgggaagttgagcctagatccctaaagacataaagtaaaattgatggttaaacgggtaagctgaggctagatcaccccagacattaagtaaaattgatggttaaacgggtaaactgaggctagatccctaaagacataaagtaaaattgacgattaaatgggtaagctgaggctagatcaccaaagacataaagtaaaattgacggttaaacggataagctgaggctagatcaccaaagacataaagtaaaattgatggttaaacgggtaagctgaggctagatcacccaagacacaaagtaaaattgatggttaaacgggtaatctgaggctagatcaccccagacataaagtaaaattgatggttaaacgggaagttgaggctagaacagtaaagacataaagtaaaattgatggttaaatgggtaagctgaggctagatcaccccagacataaagtaaaattgatggttaaacgggtaagctgaggctagatcactaaagacataaagtaaaattgacggttaaacgggtaagctgaggctagatcaccccagacataaagtagaattgatgtttaaatgggtaagctgaggctagagcactaaagacataaagtaaaattgacggttaaacgggtaatctgaggctagatcaccccagacatgaagtaaaattgatggttaaacgagtaagctgaggctagatcaccccagacgtaaagtaaaattgacgggtaaacgggtaagctgaggctagatcacccaagacacaaagtaaaattgatggttaaacgggtaatctgaggctagatcaccccagacataaagtaaaattgatggttaaacgggaagttgaggctagaacagtaaagacataaagtaaaattgatggttaaatgggtaagctgaggctagatcaccccagacataaagtaaaattgatggttaaacgggtaagctgaggctagatcactaaagacataaagtaaaattgacggttaaacgggtaagctgaggctagatcaccccagacataaagtagaattgatgtttaaatgggtaagctgaggctagagcactaaagacataaagtaaaattgacggttaaacgggtaagctgaggctagatcaccccagacatgaagtaaaattgatggttaaacgagtaagctgaggctagatcaccccagacgtaaagtaaaattgacgggtaaacgggtaagctgaggctagatcaccccagacataaagtaaaactgatggttaaacgggaagttgaggctagaacagtaaagacataaagtaaaattgatggttaaatgggtaagctgaggctagagcactaaagacataaagtaaaattgacggttaaacgggtaagctgaggctagatcaccccagacataaagcaaaattgacggttaaccgggaaggctgaggctagatcaccccagacgtaaagtaaaattgacggttaaatgggtaagctgaggctacatcaccccagacataaagtaaaattgatagttaaacgggtaagctgaggctagatcaccccagacatgaagtaaaattgatggttaaacgggtaggctgaggctagatcaccccagacataaagtaaaattgatggttaaaagggtaggctgaggctagatcaccccagacataaagtaaaattgatggttaaacgggaaggtgaggctagagcagtaaagacataaagtaaaattgacggttaaatgggtaagctgaggctagatcaccccagacataaagtaaaattgatggttaaatgggtaagctgaggctagatcactaaagacataaagtaaaattgacagttaaacgggtaagctgaggctagatcacccagacataaagtaaaattgaagattaaacgggaagttgaggctagaacagtaaaggcataaagtaaaattgatggttaaacgggtaagctgaggctagatcaccccagacataaagtaaaattgatggataaacgggtaagctgaggctagatcaccccagacgtgaagtaaaattgacggctaaaagtgtaagctgagactagatcaccccagacataaagtaaaattgatggttaaacgggtaagctgaggctagatcaccccagaaataaagtaaaattgacggcttaacgggtaagctgagactagttcaccccagacataaagtaaaattgacggttaaacgggtaagctgaggctagatcaccccagacataaagtaaaattgatggttaaacgggtaagctgaggctagatcacgccagacataaagtaaaattgatggttaaacgggtaagctgaggctagatcaccccagatgtaaagcaaaattgacggccaaacgggtaagctgaggctagatcacccagacataaagtaaaattgatggttaaataggaagttgaggctggaacagtaaagacataaagtaaaattgacggttaaatgggtaagctgaggctagatcaccaaagacataaagtaaaattgacggttaaacggataagctgaggctagatcaccaaagacataaagaaaaattgatgcttaaacgggtaaactgaggctagagcactaaagacataaagtaaaattgatggttaaatgggtaagctgaggctagatcacccaagacataaagtaaaattgatggttaaatgggtaagctgaggccagatcaccccagacataaagtaaaattgatggttaaacaggaagttgaggctagaacagtaaagacataaagtaaaattgacggttaaacgggtaagctgaggctagatcaccccagacataaagtaaaattgatggttaaacgggaagttgaggctagagcactaaagacataaagtaaatttgacggttaaacaggtaagctgaggctagatcaccccagatataaagtaaaactgacggttaaacgggtaagctgaggctagatcactaaagacataaagtaaaattgacgattaaacggtaagctgaggctagatcaccaaagacataaagtaaaattgacgattaaacggtaagctgaggctagatcaccaaagacattaagtaaaattgacggttaaacgggtaagctgaggctagatcaccaaagacataaagtaaaattgatggttaaatgggtaagctgaggctagagcactaaagacataaagtaaaattggcggttaaacgggtaagctgaggctagatcaccccagacataaagtaaaattgatggttaaatgggaagttgaggctagaacagtaaagacataaagtaaaattgacggttaaacgggtaagctgaggctagatcaccccagacataaagtaaaattgacggttatacaggtaagctgaggctagatcaccaaagacataaagtaaaattgatggttaaacgggaagttgaggctagaacagtaaagacataaagtaaaattgacgattaaacgggtaagctgaggctagatcaccccagacataaagtaaaattgatggttaaacgggtaagctgaggctagatcactaaagacataaagtaaaattgacggttaaatgggtaagctgaggctagatcaccccagacataaagtagaattgatgtttaaatgggtaagctgaggctagagcactaaagacataaagtaaaattgacgggtaaacgggtaagctgaggctagatcaccccagacacaaagtaaaattgacggttaaacgggtaagctgaggctagatcacccagacataaagtaaaattgatggttaaatgggaagttgaggctagaacagtaaagacataaagtaaaattgatggttaaacgggtaagctgaggctagatcaccccagacataaagtaaaattgatggttaaacgggaagttgaggctagaacagtaaagacataaagtagaattgatggttaaacgggtaggctgaggctagatcaccccagatgtaaagtaaaattgacggctaaacgagtaagctgcagctagatcaccccagacataaagtaaaattgatggttaaacgggtaagctgaggctagatcaccccagacataaagtaaaattgacggttaaacgggtacactgaggctagatcacccagacataaagtaaaattgaagattaaatgggaagttgaggctagaacagtaaagacataaagtaaaattgatggttaaacgggtaagctgaggctagatcaccccagacataaagtaaaattgatggttaaacgggtaagctgaggctagatcaccccagatgtgaagtaaaattgacggctaaaagggtaagctgagactagatcaccccggacataaagtaaaattgatggttaaacgggaagttgaggctagagcactaaagacataaagtaaaattgacggttaaacgggtaagctgaggctagatcaccaaagacataaagtaaaattgatggttaaacgggtaagctgaggctaggtcaccaaagacataaagtaaaattaatggtaaaacgggaagttgagcctagatccctaaagacataaagtaaaattgacgggtaaacgggtaagctgaggctagatcaccccagacattaagtaaaattgatggttaaacgggtaaactgaggctagatccctaaagacataaagtaaaattgacggttaaacaggtaagctgaggctagatcatcaaagacataaagtaaaattgacggttaaacgggtaagctgaggctagatcaccccagacataaagtaaaattgatggttaaacgggtaagctgaggctagatcaccaaagacatgaagtaaaattgatggttaaacgggtaagctgaggctagatcaccccagacacaaagtaaaattgacggttaaacgggtaagctgaggctagatcaccccagacataaagtaaaattaatggttaaacgggaagttgaggctagaacagtaaagacataaagtaaaattgacagttaaacaggtaagctgaggctagatcaccccagacataaagtaaaattgatggttaaacgagtaagctgaggctagatcaccaaagacataaagtaaaattgacggttaaacggataagctgaggctagatcaccaaagacttaaagaaaaattgatgcttaaacgggtaaactgaggctagagcactaaagacataaagtaaatttgacggttaaaaaggtaagctgaggctaggtcaccccagatataaagtaaaattgacggttaaacgggtaagctgaggctagatcactaaagacataaagtaaaattgacgattaaacggtaagctgaggctagatcaccaaagacataaagtaaaattgacgattaaacggtaagctgaggctagatcaccaaagacattaagtaaaattgacggctaaacgggtaagctgaggctagatcaccaaagacataaagtaaaattgatggttaaatgggtaagctgaggctagagcactaaagacataaagtaaaattgatggttaaatgggaagttgaggctagaacagtaaagacataaagtaaaattgacggttaaatgggtaagctgaggctagatcaccccagacataaagtaaattgacggttaaatgggtaagctgaggctagatcaccaaagtcataaagtaaaattgactgttaaacgggtaagctgaggctagatcaccccacacataaagtaaaattgacggttaaacgggtaagctgaggctagatcaccccagacataaagtaaaattgatggttaaacgggaagttgaggctagatcactaaagacataaagtgaaattgacggttaaacgggtaagctgaggctagatcaccccagacataaagtaaaattgatgtttaaatgggtaagctgaggctagagcactaaagacataaagtaaaattgacgggtaaacgggtaagctgaggctagatcaccccagacacaaagtaaaattgacggttaaacgggtaagctgaggctagatcacccaggcataaagtaaaattgatggttaaacgggtaagctgaggctagatcactccaggcataaagtaaaattgatggttaaacgggaagttgaggctagaacagtaaagacataaagtagaattgatggttaaacgggtaagctgaggctagatcaccccagatatgaagtaaaattgatggttaaacgggtaggctgagtctagatcaccccagatgtaaagtaaaattgacggctaaacgagtaagctgaggctagatcaccccagacataaagtaaaattgatggttaaacgggaagttgaggctagaacagtaaagacataaagtagaattgatggttaaacgggtaagctgaggctagatcaccccagacataaagtaaaattgatggttaaacgggcaagctgaggctagatcaccccagacataaagtaaaattgacggttaaacgggtacactgaggctagatcaccaaagacataaagtaaaattgacggctaaaccgtcaaactgaggctagggcacgaagtcacacactgctgcacattggacttgcctcagatgttggttttttgtttgtcttgttttcttttgttttgcttctgttctctttttttcctaaattactgatacccgagtcccatgtctagagtctaatttaattgttcagtgtattccctggacattgagacctttagagtatccccaggtgattgtgatgcatagcaatgtttgagaacaattgctcagaatattctaggccgatggaaaaggccttgtggtaagatgaatcatggcaaaatcttaagaaggctgaaaggttacttgctgctcctgcaggacaaaagaggagggacctgggagagaggcgtgtgcaacatgagactgaatagctggccaagaagaagcttctaggccattataccggtttggtgctttgctgattagcagcaagaagccattcaagtctttcagtggacatgtctttccaccacctcgtgtgaaaaatatggaagtgttgactgcttttctcgcatactttgacttattcgtctgtatgtacctttaaatggacaggattttttgaaattaagttgttcatggagaaactaaaaattttttttttttagtctggagttatcacaaagttggaaaatgtattttaaaaatctacgatggtccatagtcattagatcagtcttcaattctgggtcttccagccaccacaggtggatctgagatgagttgtactgcagtgggctttcaacttgggctacatgtgacagtgacctagggacatttttacaactactgatgttcaggctcaagttagtcaatttacgagtgatagttaagcataatttttgaggttccttaggtggttctaacatttagccagagttaataacaactcacctgctggataaatctttttggatttaattaaatttgggcatattgatcttagacatgaactagagtctcttgatttttgaaaacgaggggaagttaaaatgaacaccttgaggtatttgcttaagtgcactcccttcacagaatagagatgagtcctttacaggcagatctggttaaaggaaactccctccggaatgctgggtgatggacgaaatgagggaaaccttgcctcctctggaagcttgccattggctacatcagattttacatgttgcgttttcaaaagtcagtctctcggatctaactttaaagatatgtacttctaacagttggttctgattatttccccacagttgtgtcaagtccacacagttgtatcaatgcttctgcttttctagacgctagttaacactcagaggttttacatttaacggaagaagaaattgacaaacaaaggaagtaaaggaagtttatgtggaatagaaagggaaggaaacagaccttgaacatgtgtagaaaggaggaaacagactttgtccgggatagaaggcccattgacatgaggaggcatgctaacagaggtcagaaagagtagaaagagtcgttggacatgggccaagaaggttcaacaccaggtagcagctgaatgagtccatcagtggatgggctacctaagcgggtagggcattgtgcttgtgggttattctgcaaatcctcctcagccaacaatgagtgtcattggatccatcaaaggattcagtgaaaatgaagcttttttgggtgaagaattccaaggaaattctgaaggttgtgacttagatgaagaaaaattctcagcatgaattgaataatattcacacgaagtctgaaagttaaaacttagaataagtactgaaaccacaccaactaacaccaggaaacgcagagggccatttactaataactcttaggagttcaagcatggaaaatgattttctaaaggtcaaacttagaagattatgcctttcacctccatgaagtttcatagctggaaaggaactccaatcccaacccctcatttaacaaatgagaaaattgaagtgaaatgatttgccaaactaaggaattcttgagagcaatgcctagagtccagactctctcactcatgagtcttttgtattcttagtctgtcatgctgccttcagaccagggcaaaatatgagactgaactgaagtgggagaaggtttacttcagtcatgggaaaccaccattaagggttatttgttgctgggaaagtacactgttgtaatagctgcactgtaacaatcacagctgactaacagcaagttatcctcagcagagccgtgaacagaaaactttggttgggcttcaggagatgagtttaaattattctctgttacagacaaatttgttattcattccttcattcatctgtgcctcctgtgtgcatgggagtgtgcttggcactgtagaatagataaagcaatagaccctgccctgaaagttcttatagtcagtatggaagataagatatacgtgtacagaattataataaaacactgactgacaaaagtgtcgtgagatctggaacaaatcagtagccaggacatttcagaagatagaggggctatttttatcttctagggcaaacagaattgccagagtcaagattatttcatgaaaaaggtagaatttaaattagacattgaatgataagtaagatgtgcatgatgaggaacaggaagaaagcattttagaaagagggaaaaagagaagcatgaatgaaaaaaattagtgctttttaacaggatgtgaaacattttttaaaatataagttgagatggcaagttggaattagattctaaaatattagtctacatatgtttaaactgacatttaaattgaggacagaagaatggaatagataggtgtggtatcaggatgtgttttggtaaaagcaacttaagagagagcgaagactagtctggagataagaaggactgaaagcctagagatatattagtttgttctcacgctgctatgaagaaatacctgagactgggtaacttataaaggaaagaggtttaattgactcacagttgaacggggctggagaggcttcaggaaacttacaatcgtgatggaaggagaagcaaacacgtccttcttcacgtggcagcaggaaggaaaagtgctgagcaaaggggaaaaagccccttataaaaccatcagattccctgagaactcactcactatcatgagaacagcataggagtaactgcccccatgattccattacctcccactggttctcttccatgatacgtggggattatgggaactataattcaacatgagatttgggtgggggacacatcaggagacttcttagattatgattgcaaaatctcaggtcagactaattgaaaataggaatcagaggaacaacgataataatacagattacaacagagagggacgatagagtggtgagtggcaggcaatgtctgccaactggataaaagtaagagaatggaaatggagaccccaagttggtttcaaagattctaagcctgggtaacaggagggaagacagagtcatgaaaatcaatatgggattcaaatgtttccgtgtcactcatcatattctcatagtttggaaaaaaatacctcactctttctcccaaaaatatttaaatctgccatacatattatatattgtatatgtacaacaggtccataaatgcaaattttgtaactttaatcacttttgcaggttagcatagatttacagcaaaagggaaattgacatagaattaaataaattgtgcagtagggaaatgaatttttttttttttttttttactgctctttctcaaactctagactctgcctagagttttaccatttgctatgctgcctcacatattccaaaaattattctaagaaagagttatttggagagttgatttagtttatagagcagctactcagaattgaaaataatcaatagtaccttaagattcaggctctaactggatatttaggcaagaacccaaacagacagttactcctataacgacattgagtaaaatgtagagagcatgaatgtagcagcccaacccatctgttctttttttctaattttgaagaggttatttttatatcagtctttggaatttttagttctgtctctgctatgctacataaatactgatgctaacagactaaatttaaaaaaaaaataaattgttgataagaggaagaggaaattgcgagatataaacctagccattttcccatttaggtggtatttccttactttttaaataaactctatgacttttactttctcactatctcctctctgcatcagttttcttattaaagtctcaacatttctgataatgaatgtctctagaatttctttacaggagacatttaggggcagctacctaaaacaggagagttggggggcttattttaaacctaaactgaaataatagactatttatttatttatttatttatttatttatttatttatttatttggcagagtctcactctgtcacccaggctggagtgcagtggcatgatcttggccactaacatccacctcttgggttcaagcaattctcctgcctcagcctcccgagtagctgggattacaggcatacaccactatgtccagctaacttttgtatttttagtagagacagggtttcaccatgttggccaggctggtctcgaactcccgacctcagttgatccacccaccttggtctctcgaagtgctgggattacaggcatgaaccactgtgtccggcctaatagacatatttttaaattgaaaatatatattactgattttaaaaaataaagatttctaagatgattttattcaggctttacataagatttttaaagagtccaatttcctaatattattactaatattattatcagaataattattctgggggagactggtgttaaaacagttcccaccatagctgataatataataaattgcattggctaagtgtaatttatgaaacaatgtacagtggaggctcctaactacttatatgaagactccaatcacttctgaaattgcatatgcatgtattacaccaaaattatagaataatataaatatacagcagtctatatatttattcaattatcaattcattcacttatcaaatatttaaaatgttcctatcatacatataggtgtggatatctaaattcgcacatgagcaaagcaaaattaaatggcctatgccattcatctgaaaagttaggcataaacactccactgaaaaatccctttttctaagccctctttgttctcatcatagttaaaatgataccttctttttactttagaaactaacgttcaaatattgtaactcttttactaaattcacggtgtagtggttaaatgtatcactctggggttaagctccccaattttgttacatacttgctgtgtgtcctcagagaaattacttgaccttgctgagcttcaatttcctttttttttttcttttttaagttatttctttcttttttaagaaacagggtcttactctgtcacccagagtggagtgcagtggcacagtcatggctcactgcagccttgacctcctgggctcaagcaatcctcctgcctcagcctcccaagtagctgggactactggtgtgcatcaccacacctgactaactaaagaactttttttttccatagaaactaagtaaagacatttttttttttccatagaaatagcatctagccatgttgcccaggctggtctcaaactactggccttaaatgatcctcctgccttggcctcccaaagtgctgggattacaggtttgagccaccaaacctgacctgagtctgttttctcaataataaaaaaaaagatattaatcgtacctatctcatagggtggttgtaaagattgaactaatgaatacatataaactacttagaacagtgtcttgtttgtggtgcgcccttaatgcaagtttagtattcttctgactgaagccttatttgtcttcattaggtcttccacaggcttactttccttgtctcccataatcacccctaaacaattatgggccatactagctcagcaaataagatcattaaaccaataattgtacctgtgtgtatttctgtataattaatatgcgttcttggctagaaattcttaaaggttatactgatgtggacaccaaatctaagtgataatgccaaatttccagatttcttatttaacatgttccagctcactcgattattataagaggttttaaagtcaactgtaatttcaggtatctattggaaaatacaataaatatcctctaaatgataaaaagatagaataatgcattaatatagctgaaatatagacttggaaggcaacaacagcagctggctatgacctttttattgagaaagtgacccagaaaatggccgaggaaatttcatcatttatttcccacttctgaaccaaagtctcagatgcctttaaatccccataggataaagttggctttaggttgtatataaaatacaaattgagtaagggaatattttttctttactgctcagatgttttatcagctttgaatagaaaaacacactaatatttatttccttaatatgtgcacatcagctttaattataatcaatccttccatagacggatttcatgggatttaatgtgctaccaaatgcaaagatagaacttgctaattctctacaattacacatttatttctgggcatgtgggtataaccgcacctccatgccatgttctttctatattgctacaaagcactatggattaaattgtaggtatggagtaccatattaatttggaagtttgaatgtctagaatattttatatttaagtacagatcacacagagtggacactccctagttaagttgttgaatggttgaaacaggtcaagataaatgaagccgtacgataaactatggaagacaaaaataacctgtctgtaaatttgattttggggctaaggtaggtttcttttgatatcacatttattcctgtgtgaaatataagtattctgtgttcataacagagtgaaaatgtatacatttattcaaatgactaatattaagagcatctactgtgtggacttatgaaataatatatatttattgcattcacaatgcttatatttgagtagagaataaagacaaggcaattaaaatataggggtatcttataactgagtttgtacactttgaccatattttgtacataatgggtggtggtggttgtgttaattaatccaattgtattcatcattacacaatgtgtgtgtatatatatacataaaaataaaatcatcatgttgtacatcttgaatatattcaatctttatttgacaatgaaatattttatatacatatatatacatatatatatgcaagtgctagggataagcagaaatgtatctggggacatggaaggtggctctgtaggattactaaacattttgagaaaaatcacatttcaacttcacctttgtaagaggttgtgctgggcttcctttccaaatgaaatgcggtgtgacagaaaatagactcatgtagctctctttagtgggatagctttctttctcaacatcaactaacacatctcctaggtgtccttaaagtttcaacctataaatattctacctcattaagcataaggaccagccatggacatatgccgctagtgtccactttccttcagagatttagggtgatgagaagataaagggtctgcttaccagatggagcttgtcagattagcaattggagcagagtaaatatcgctgtcatattgttgttttgaagcacaaagaaccccttttgtataacgcatgtgcatatttaatagtttaaaacaaaaaaagctcagcagaaggttggctggtcgttgtacctctagcagagtggccattgcctgaaggcacggtgctgttttcctcataatagggaacattagcaaccagtggcttgagaaaggcagagtcaaatatgtctcttggggcccagtcggccacatgaagtgagagccgttagacgcagcaatgagattactgctccagaaagggtttgccacatatattactgcagaggcttttcagggctgccagcgcactcaacttacaaatgtcaaacatgatttaaaaggttattatactatcaagagggaaggagaatgattttccatcactgaaatttctatttcattctgtggcacataccgcatctcacgaaggccaatattgctaaataacctgcttttatctttaataagtgttttatggaccttaaattggaagaaccatttccactttatttgtattagaaaatttgatcttttctggttgaataacagcatgagagatacagtgtgtgtatctgtgtattgtgcttagcagattgttctttgaggggagtaaatttgtctgtgacgtgtcagttagggagagcgtacatacgtaagctgtagttttgataaatgcatttgtaagtctgcagtattttaagctaaaaatgaccaggtgcagttctctgtactgcattacttatttctctttgggctttattgtgactggtatttaaaacaacctgctttcaacctctctgacccctttgggaatatttatttgctcaataaggactctatttgttggcctcaatgagttaatttaagtacaattgtatttgaaaagttgctcaataaaagcagaagacgatttttcttttattttagggagattttcactcttgttttgtaacatttgaaaaataaataatcttcaagtgtggctgttaaaatgtgcaataaacaccttattgtcaatgtggaatttttaaacattgcctttgcagtcataaaagaggccaaaacaagggatttcaactgcccttttggtagcattcttcactctatttcctagcaaatcactgatggctttttctgagggtgagactgtaaaactgaaggttgcctacatttccaggtcccagaatgtgccatgcacagcaatacatcagcaatctaagctgacacatttgaggatggtgttctcaggtgggatgtaaaaaggacagaaggatacagtctatggtgttgagatattgtctgttccccctttatctgagactctgaagcattaaattaaaatctgtgaattcgcccatgttcacatgggcattgtcaaaattaaattaaagcttatggaaggaaaccttctcagcctgaagagtagcacctttcctccaagttctgcaccgattttgtcatttgccaaagtgcaagtcacaacaaaaggaaaagaaaacaaaccaaaaaaatctttgaattttgaaaaataatcagacttctttcatgggacaatagcactaaaaatttaaatttattcgacgttctccagatggagtatgaaattagctttctaacatttgaacaagagtgaacctgaatatctacataaggattaatatgtatgtctgtctgtgcccttttattcttttgaagactttctgtaatatatactgatttcaggtagcttctttattgttatataaacaaaaataacaaatctagagacacaaaaatatttccagtttaggaaataattagaacattctatttttcccccttcttttaaaaagtaacaatagaaagaaaaatcacttaaatattgaatgataataaatatgttttatcttagttttgaaatttgatgaaatagtaaattcattataataatgtattcatatattcagtaaccaatgacatatttatgtaagtcttgaatgttttaataatcctatttaaaaattttgaaacattattttttctaattggattaaaaactcccttttacaaatctctcacatggtttcttgtaattgaaaactcttatagtacatatgaaatacaattctattaataaaatatgcattcatatacacctttttaaagcattcaattatttgggcaaagcaacgcaaatgtataaactcaaagatataaactatgatggttaatttgatgaaatatatctcacattaaactgtaaaatgaaacaaaagtgtttcttctatagtaaaatcttagcttctcttaaaataaacacacatttttaaaaatcctgtgtgaccctgtcttaaagaggtaagttcactaatagaccagtgaactattttctagaaaccaaattcaattttgaattaaaatcatggtctaaaaagatggagacatataccacatagcataagtttctaaaacttatgtcagtccatatatgggagaaagttatctttctactatgattctacaataaaaatattcatttatatctcacaacttagtaaataaatcagaggaatgtttaatcttagaatggctgcagtgaactggacaatcattcaccccaacatttttttctagaattcttaaattgaaaattaaatgtcatgctaatagtgtttcgcttcctttagaaacaaaatcattgtttacaaaaggcactctctttgcatctgacaatacgcaatttcatttttcattctagttatccttaaaaaatttaataatgcattcttgccacctctttcccaatgccaaaatagataccttgtcaccttaaaatatttcacagaacaattacagcctttaacatgcagaacatagctgtctgagaaatagggcactttctggtgcttgtgatatataaacttcattggataagaaatcaagtgcctcctacatgcatcctggcctcgttaatttatgttgatggctggtatgaaaaagatagggaggtggcaaactggtgagttgtctctgaccaaaaagaattatttattttgttggaacaatgtaacctaacactaatattactttttatttaatattggaaaattatacattagataatgttttctagaaattaagctagctattttaaagtagagtttaccatcttggctaagggattgcaaacataaaagcatacaggggtgaagtgaatcaagtcaaagtgaatggctgcagtgaactggacaatctaagctatcaccaaggacatgtttctttcaacagtctactgacagccttccccagggctcccattgctggcttcttcacgaaggcctgccattctttatactacttatcaggctttttgaaaaagcaggggtgggggcaaggtgcggtagctcacacctgtaatcccagcactttgggaggctgaggctggtggatcaattgaggtcaggagttcaataccagcctggccaacatagcaaaacaccatctctactgaaaatagaaaaattagctgagcatggtggcgggcgcctgtaatcccagctactcgggaggctaaggcgggagaatcacttgaacccctgaggtggtggttgcagtgagctaagatcacaccagctactcaggaggccaaggcaggagaatcgctggaacccataaagcggtggttgcagtgggctgagatcgcaccactgcactccagcctgagcaacagaatgaaacttgtctcaaaaaaagaaaaaaaaagtaggagtagggatgtttttgtcaaatctaggaaatgtgaaatttcttctagaaaccacctgaattatattaaaaatattgacaatatatgagtttttaccttgatgaaaggagatatttctttttttttttttttactaaattgcttttatacaaagtctacaaattaaatctgcatataaggagagttaaatttaaatattaattttaagatttttggaaaatgcggcaatcgttcttttcatgtgagagataacaagtctaagccagatatttagtcatgttctatgtaggcaggaagatctcatctggattccctggccttcttggcattctgactcacaatgtcttcatcagttttctagtgatagatgaataaaagcataataaaagataaaccaagggcatcgtcaggtgttcaggggagcctaggcattagtctaggtgggagaaagaacctagacttcctaagtggcctgggactcccaacgttgtgtcagtgacgctggatatatccaaatagactgataggagagccctggcaggagaaacagaggagcatggatgctggatactagacatcaatactaaaatatatgttgaaaaatttaaatagtaccagttctgaacattcttgtggtttcataactttatagagctatgatatatactaaagataatcgccacttatcatcttcagtgaaacgagtggggccagggattttcatagctttccaaaatctaaaatgcctctattgtgcacagaatttgtaggttacttggacatactgtatttctctcagattctaactaattcttagagaattgtatttctctcagattctaacttgtacttagagaagttaaataactgactatatagatacatgtatagaaaatggttgatctgggatttaatccaaggtcaagattaagacttaaccaagattcagtcttgatccaaaacttttagtccaatattttctcgaccataaatcaagaggttaaatgaacattggattctaattctgactctactaatgatgggcataggtacccatattatagggctgagattcggctatttattgtttttttttttttttgctttattttgttttgttttaatcccaagtaatttcaatttatagctaggattgagaaccactggcttaaaatctaagaaaacttaatttattttccttttcctttactttcatatatattctaataaatgccagttgttactaagctttacatatatatactcacaatacataaatacgtaaatacataattcacagaaataagtttatgtgcttaattatccatctcaaaagcagatttagaggatttaggagaaatgcagcatgtgataccaattacaagaagaaatgggaaatattcttttgtagttggttgttcctaaattctggtgttttcatctggagggactgaagagaacttctatccattgattatctatgatgtgccttcatgcttatggagagatttattcattcagattctcctggaagaagccactgtgtgataatgaaagtctcataattagggttgccaagtttagtacataaaaatacttgtattaaatgtgtttatctggtaacactactactaagagcttggctctcaaattcatctctggtccaggtttttagctctcttcccagatgagtcatggcaactgccctgtctgcaaaggcaaaacatcatccttctcttctttagagacactgacctagctgaaatgtttctctggacaatccaagaggaatcaaacatttacatcagcaagaaccacatttgtgtctgtgatactgttgaagggtccatagagagataactgatttttaaagcagtggtacttgtaaaacagcaacagtaaggcttaaaataaattaatgccaaaagtgatttccttcattccttaatgtaaaatcttcctgcatgtaattcatagtaactgaaaatggaaagtaagtggtagttagacagtagctcttttttccattaaaaaagtttaaaagcttcaagtttgttttctatgtacggtctaacatggccatgcagatattcttcattcaaagttagatcccctcctagggtttcagtgactgaaagaggaaaatttcctcttattttacgtttcctttaatggatcacgtatcaaattttatgtacacataaactcaaattaagagcccgtttattgcgaaattgtccttaaaaagctaaatctaacattggtaaaatttagtccctatttgtagcctgatggtatctaaaaaaaagttttgggtaaaagtaaatctctacaccttcaaattgaatgttgcagccaattgagaacctatgagaaattaaattgagaaagatgtttttgaagacccatttcgggagaaatgaattcctgtgtcttgagaactctaaagcagataagaaagcaaggcaatggatctaattctgtttggagcataaaattcctgaaattgaggatatataagaaaagattgatcttgtgtctatttgtcttgaagttcagttcaaatctggttctggagaaaaagaaagatattaatttccagacagagcaattgtgtctttcagaaaaattgtgcatttcttcccaattgagatgtctcaaaattaaatggtatggtgcaaagcttcattatcttgtttctcttaagattcaagccttttttttcagaacagttatccaatatcctaatagatgaaacataatttagaacaaccctgtattataagacccagatttaccaatacaatatctatttaaatatagaattactatttaatatagaattcagtgtggatagtagttttgagctttaagtgaaaaaaaaaaaataaaagaacagaaactccataatggattaggtctaatacagccttttggtcatgagtgaagaggctaatgtaatatgagcactcatgagtaatcagatgtcttctgatgagtgaattgaaatgtcatagcagaagtaatccactatacattttattatgaatttttgtgggtaggtttaaatttattttctggctcatttaatttatttaatcaaaacaaaatctaagatgcatggaaaaatcaattttggtaataagagatttaccccaatatatttattcatttctaatgttttctttttctcattagttgactgggttataatttttgcttgtcattctttatagctttgtttctggtttttgctaaaggccacaaaactacatacatcaggtatttccaataatattgtactattgtatgtgcaccggaaatatcccggtgctttcggtagctccaatcaaatatgtcttatacatgatttgtcagattccacagataaactgtatatttgcaaaactggattttagaagatttagtcaattagaaatatatgtggctatgtaattggcttctattgttttgctcttaactcatctaagatctaatgctaagttcatcatatcatcatgatctttggtgagaatgtaattgctgaaaatgttttgaaaccactgggtcagtgattaagaacgaaagggattcagcgttaaatcaaagttcccatacgacagtcatcttgattcacaggaaatggggattgaactgggttcacttgaaaagtactgaacctcttaacttctcagggttcttgttgtatgttagtaggatatgctttaatgtggatcactaatctctttttcataatcatttgtttctaataaacaactgtctcattctttcgtcttttcatacatcactcaaaacaaatgactcagggccgggcgcagtgggtcacgcctgtaatcccaacactttgagaggccgaggtgggcagatcacttgaggtcaggagttggagactagacagaccaacaagatgaaaccccgtctctactaaaaatataaagatagctggatgtgacggtgcatacctgtaatcccagctactggggaggctgaggcaggagaactgcttgaacctgggaggcggaggttgcagtgagctgagatcaccccattgcactccagcctcggcgacacagcgagattacatctcaaaaaagaaaaaaaaatgattcagaaaattttaaaattttttaagtttttatccttcttgagcatatatatgtgacagccaggggaattccagatgtttttcagcttatttttatgtctgacaccagatactacataaataaaaacagttagaagttttgtttattgagtatttttgtgattacatatctagacaactttcaaaacaaccagtcagtggtttcaagtatgctttcatctccatcttgtatcatatcattcatatattgttggcaaatgatgagttttacctgtattatttggaagcattttatgaagccagttttagaagttcatttaaagaaacagaaaagctcatatgcctgtctctaaccaaggacacaagagcaagtgaatgagggtgttttaatttttattttttgtcttacttttcaattcacacataaaccaatatggaagtagtactatctaatgtggaagatagaaacctatatatttttaaatatttttgagtgagtgtgactagacaagtcagatagtttatcattttcattcttaggccataaagatccctctggcaaactgaagagtttaatgactacatattttcttaaactttaactgtcttgagtgaagggtacacatagtttgcactattggtgagtgaaaatgtctaccttaagcaaagagaaaacagtcctcctctgccatgagagtgaatagagacatacatgtcagaattcaatatggcagctactcatggaaattattcagcacacacattttaaaaactcagaaatcttaattatcaccaaatctaaaaaatctgtgtcctttatttaccttttctgttggcttttagactcatgcttaatttcatagctgacagtgcaaagcttatcttcatttcttaaaatttctaattggaacccagcagttgcatccataaaagaaaatatttcttatgtggaaatggtgtagcctactccactttccatcagataaagattaggttaaacattaaaggaacaagataaagcataggtgtgcatttgctatttcaagtaccaatttctattttatcactcaggatgggttagagattctgtgttaataaacagtcccaaaagttcagtggtttttccatttaattttttaattgatacataacaattgtacatatttgtgaggtatataatgatgttttgatacatataatatgcagtaatcatatcagggtaattagcatatctatcatttcaaacattaatcatttctttgtgttgggaatattccgtatggtccttctaactatctgaaattatatattatattattgttaactatagtcatcttgtagtggtatagaatactagaacttattcctcatgtctagctgtaattctgtattctttcacaaatctcttcctatccctgctttccccaaccattcccagtctctagatcagtattttttttgttttgctttgttttgtgttttttggtttgtttgtttttaagatggagtttcgctcttgttgcccaggctggagtgcatggcgtgatctcggctcactgcaacctccgcctcttcgtttcaagcaattctcctacctcaacctcccgagtagttaggattacaggcatgcgccaccacgcccagctaattttgtatttttagtagagatggggtttctccacattgatcacgctggtctcgaactcccgacctcaggtgatctgcctacctcggcctcccaaagtgctgggattacaggtgtgagccaccgcccctggccaggatcagtgtttttaaaagcaatttatttttaaaaaaggtctaaggtctaccagtccttgggctacatgcctatttcatgttggctggggccttgctctggcataagtattgactttccttcagtatccagggtgaaggaatgttgacactctggtgatagtggctgagggaaaggagagttctggaagcttttgtatcaacataaatccctcagcccgtagtaatgcatgccatattctgttacaactcataggccacaacaagtcacatgccacacataaccacaaagaagtcagaaggcaatctagctatgtttctggaaggaggggaccaccacaaacattcggcaagcaccaataatgattatccatatactacctgcaaatctaaaaccccaatttaggttccattgctaccaatcttacttagtctacatgctgacttaactccatattttaagtattgactttttaaagaattgcatccagcatttggccttattctttaagcagagttatcttttatgtgttattgatgtgtttttcttttaaggtgttttgtcttaagtcaaaacaaactctagtgaatatgtcattagttactaagcctaataattataacattgattcaacaggattaaaatttatgcatgagattctgctatcaggtttttcagggagatgttctgtgactccaagacttacagtttctgtgttttgcatgtcattttacaaatataccagagaatagactgtgagtcatagaattctaacatcatagggttgacagggaagtgttaaaaaatatatcatctatttcttatattttgacaagattgtacacaaggcattatatatcaagccattgaggatgggagggcagacagagaaaattatttcccaaaattgtttcattcaattcatcatagagcaaggttgtcccatataactgctgtagggaatgtgggtagggtttgtcttgtgaaaaataaacttatttttggccttctttttgcttaaatttcagtagcatgttttctctttacaacaattttcaaatgaatctacttggaagtttcgtatttatctcattagcaaaattagtattgtgtaagttcataaatattctgaataataataaaaatgaaaataaaacaatgtggtatagggagaagaaagctggatcacattactgtgatccctgaagtgccttaatgtcttcaaagcctcagtttccttctccgtacaatggaggaaacaaaataaaccttttgcaaattaataatatgaacttggaactacacaaaggtcttatttgcagaacagtcttagaataactacataaatagaagcatggtaagtgtaactgtacataaacaagcacacaattttaaatggaaattaaattttattattcagaccacattgattttatctgatcaatctactctcacatatttgagttacaaggtctgagggtgaatggtattgtgtgatgaattccaacaagtctgggctttacttaatcaaattttacagcattggaccaaacagtaaatgctggtgaagttgattcctttgtctctccttaactttgagacacttaatcaaataaaatcataaaatttaaaagctagaagtgactttgaattcatatcctctaatcctttcactcacattttttaaaactgggctgttatcagttaggaattttattcaactgctagtgaaagatttttgaaagttaatgctgtatacaaattataaatatatacctccaatgtttttgcaagtttcttggccttccctacgtaattggctacatggatggcaaggtttgcacagcgtcttatttttagaataataagagtgacattcaacaaagaaagctgatttaaaaaagaaagaaaagaatgataaaaggcaaaagggtaagtggctgataagtttgtctcgtcttaaaaagagccagggttttttgcttgtaacttattgcccagcattttttttttgaggtttcaatattttattcaagtttctgtaagtgatgttaattacagcatttgaaggggaggatataattccacacaaaatggaagactttaaaatgtacccattaaactgctaaaaaacaaattgagtgatgagaatacaaaagaagtccaatttagattctgagtgttgtcaccatgtgattacaatcacgcagactcttccaagcttatagctggagctcctggaagctatttcttactctggtgcaaggacaaaaaaacacaatacaggaaggaataagtcctgaattattggcttcatcacatccaccttctccaccccaaaatggcacggaagaaacagtgaccacaccctgcagaccatttggtgtaaaagaggtgacgacgatgaactgcggtgggaacaggtcatgaagatctgtataaaaaagtctcattcagatgagtttgtaacactgtcaagcagtgagcctctcatcagttagggttaggaaaccaaggttcgattctcaggaaatcacagtttcattaatttactcaatatgaatttacaaagtgcctacatattaccagctaccacttgaaggcatttctagataaaaaagaaacttggcatctcacaggggctaccgagttccccccaagtctactactgaaaggatcttttttggaaatgggtttcttctgtacctctgaaagggtaacatcttaaagcagaatcatctttaaccttgaggtctaacatatttagcaatacttgcatcccagtcatacaatattaaaaggtacactaaattctgaaggtagctatgctgcaaaatagtttaaattaaacaattgtatggtattcattcatgcttgaaatttcagtcctagaccaagcttgtggccaccagccttgacgttcttgccatccaggagagctgacagtgtcagtttgatacctggctgcagggtctgagtgtatcctaaacctatcaggctggagttgttcactttagtggagaagcaggcatgagggtcagtctgatacttggctgctgttccgaagcgcgtgttactgtttcctgctgtccagacgagattgacagcggtctccaacttcttgttcaccttctggtaaatggagccgccaaactctgtcccgtcattcacagtagtgtgaagctggaattcatcagtcctgtagccaactgcaaagttgctctgggtcactcaggaaggactttgcagtctcaaaacgcatctggtacccagccagccagccctgtaacccggcactagagcaccccggatggaaggcccagcagtgtggaaatccacgtcacagcccaggttaatgtgctcccacttgcaccctgtcttgattttagcattttttttttcccagtgttaggtgacgaggatgaatgcaaggtcagcctcaggccacgtgcaagctgaccgtccacgctcatctcggtgcctagtgtattgtcggggttccatttctccgtagacctcgagccatagtcagtccatcggtacctggtttccagactgcccgtcactttggtggtctcagtgttggctgagcctgagcttgtaaactccgatccatcctcagatttcgttttcaaatcaagctttattaagccaatccatagcccttggtgaagacatccctagcagatttgccaagatcggcatacgtgggtggcacagccgtcttctgctcaaaggtggcggcgggctctgcgggggctgctggttgctgctggggggctgctgggggggctgctggggggctactagggggctgctaggggtgctgctggggggctgctaggggggctgctgggggggctgctggggggctgctggggggctgctaggggcgctgctggggggctgctaggggggctgctgggggggctgctggggggctgctggggggctgctagggggctgctggggggctgctgggggggctgctggggggctgctggggggctgctaggggcgctgctggggggctgctaggggggctgcggcgccaaggcagggagttgcccaacattttaatataaggctccacattgcgaagaaggtggggtgatttattttattttatgttatttatttattttattttatttcattttattttaattttattatttttttgagacagggtcttgctctgtcgcccaggctggagtatagtggcatagtctcggctcactgcaacctccgcctcccgagttcaagcgattatcgtgtctcagtctcctgagtagctagaatcacaggcacctgctatttttgtatttttagtagagatggggtttcgccatgttggcccggctggtcttgaactgctgacctcgggcgatccgcccacctcagtctcccaaagtactgggattacaggcgtgagccaccacgcccagctagtaatgtagttttatgactgatcaccttatgtactcttccaattctcaacttctattaataaaaaataaaagaatatagataatgcattagaaacatctgctgcagggaactgttttaccattacagataacgttatgaatacaagtatttctgttatttatatttgccattatgtctgttctggaatattatcaaaccagaattataactagcaagagactatataaattaaaatcacacattttaaagtaaaactgaagttggttcaaactaggactccaccacttgagcaaactacttagcacaaattacttaaacctcgatgttctcatctataaaataaggggtttacaaggtcaactactaaattagataatacatgtaaagtgaaatgcctaaatacaatgcctaggatacagtaattgccctgtaagttgtaagtgctaccatgaaccagccaatgatctctactacatactatgattgagaaattaaagatggttgaaattttatataaatcgatgtcaaggtaatattatttatgaagttattgtacttcaggtcatcatgattgctttagtgcatttgagactcttttcttagatgacaatggttctaatccatcttctatcaaagtctctatttctccatttaaatctggcagatccgtcttctagagacatgaccaagtcaatgattttgattagtctgtgctccttacccaatattacaatacctggaaagtaattatgtttctatttttcattttaatctgctcttaccatattgacaatatgggcaatggctaagtccattatgagtttaattgctttatgtgccaggtgttcggaagttcattctttgaatctaatgaaagtaaaagataaagtcacagaactctggttcattttatgcatacattattctaactttggataaagaattaatcattcttttacatcctgtattgtttaatgtctcccttgcccagaaataaggatttttatcacagtgacttcagtcactgatgaggcatacatacagaaatctcctgttaagtaagattagaatttgtctttgggcctttttaaagtttctgcaaactgataacccaattgctcatgctgattgacagaacaacattgaatatctaagtagtctaggcctttgtctggtcattagaatttgtccttttgaggaccattggctggaaactttatactacaattgagtgtgctatgagtaagacagcttcaattgaagcctctgaagaggaaaggaaaataacaaagaagacgcttttgtatctttttccattatcaataacgtcaatatagaacatgccttttttcatatgaaacttcaatatgaacttattcaaatgacactctggctatgtcataatgtctgcattctccaggtatatatgaaacagattttaatggatgttgggtggcttccattcaccctttcatatttgaaaatgcacttagaaactctgttgagaaagttgcttatgctattggtcctccttttctgttgttgttcagtctgcccccaagtggtagagagcctaaaaacccaaaaagataacaacgtggtcaatccatgacttatcagctgcaattgtatgcctgattgatttttgttgctatacaacagctgaacaattcgaaatttatcacatggaatatgaattcacctgttcaaatcatggtagtataataattcttgaaattgcagctgcatattttaattcattacaccaagtaaataaacttcaagacattcagccaccattcatgaaatagatttctaaaggcttatgtggggatcattttctttctcttaccctctaccctcttgttttaaaactcctctccccaccatggccttatactggaagacatttttactcttgatttctagcaattgctggctggtattgttgagttttaatatttcagtgtgattcagagctctgaccattttcaagttcttaggagccctctcttgtctcatttttaaacatggcctttggggaatgacagtgattgtgacagatggtaaaggaataagattgcactttggcgctgcttctgtctttgcctcttgatcttttcccactttctcaaggcaaattatagatttccttttgcctctagagggacgcaaattgcagttgccagttatatggttctttgtttctctttctagctcttaaaaaaaaaaagaagggctcttatttaattaaacattgtcattacatttattgttgatgaaaggtactgatttgtatgttggccaaatatctgaccagacaagggagaggacttgttgaactacaggcaaaaaaagaaaaagaaaaaagaaaaaaaacttttgttgcgtttgaaggtagcttccctctagtggcaaaaactggtacttcacttgtagactacaagcgatttaaaaaaatatattttttgttatctctttttaaaacattatctgatatgtgtaatgtacatatcacacattttaatgaatgtggcttgcaactaaaatcgagtttcctaaaaagtttagaaatcttttcagttaccaaattcataatcttaggtatgcaaagtaggcaaggtactttactgtccattttgttcttcagtaatcccacacatacaacacacaattccagatgaaaggattctagttgactaagaagatagttaataaaggggttttagatttttttcataatttattgggtcggagttaactcaagcggttacctcctcatgccggactttctatctgtccataatttatcaaaggagtgtgaaggaattataaagtatcgcataaatttgggtggtgggcatattgctgtacttctctgtgtattagaaatattttaggctgggcacagtggctcatgcctttaaacccagcactttaagaggtcaaggtgggaggattacttgagcctgggagttcaagatccgcctgggcaacacagggagaccccatctccacaaaatattaagaaattagccgagcatgatggcacacacctgtggttccagctgcttgggcggttgagataggaagatcacttgagcccaggagttcgaagctgcagtgagctgtgattatgccacttcactctccagcctgagtgacagagagagagaccctgtctcaaaagaagaaaaaaagaaaaaagaaaagtttgatactggaaaaattttagagagaggcgatagaatcactagatagttaaaatttaagtattagaatttaaagggcactagagattagttgagtgttacagttttaacttgaacttattcgttcacattcatgtaaccactacaaaaggatttaagcaatgccaagaatgagctataatttagacaatgtgcaggaaatacaaggacaactaagacgggcaagcggcaagtgaaccgagaactgtgcaaagagatgagtactaatggaaatatgtacaacaaactaagagagtacaccaaggacaaagtggccctttgtttgagacggatgaaaggacagttaagtacagaagataagtgtaaatgatcaagagtttgggcacagtgcacgggtattttccatgcacatagcaccatgggaagtggttctgagcaatcaggagataacagggcttcaagtatggaaggcttaaatggagagagctgagggagacttgttgttaataactttgctagagcaagtcctaagcaggcactgttttataccataataaataatcaaatgagagaatatgaggtttggttccccaggctccacacgtgactatgaataatcttataaataatagacttattcacaaaacacaagatagtctagaataaccgaatgaaatgatgtttttgtgcttctttgacttcctaccaaacatagtgttccttggaaggaattatgtttgacactgtattgtatgactggaaaaaaatctataatgaagaggtgctcacatatgaagtagcactgagaaagttcgcttcaacagaggtctggtgatgggagaattaagcataatcaaaagttctagttgcattctgaagtcaatttcaagttgtcagtcctaattgggagtggggtttgtctaacataatgcttaagacattttttggtggcaaaatttctcaatttaaaggaacatgatacaagctcagaaaaaatgcagcaaattgatgactaagacctaggtaatctgtaagtaaggaaatgggatgtcaggagagaaattgacatttgtttagataatatccacacttggttggatggactatattttatagatattttcattcttgaatattttagtttctaagatctttattatgaaacaagaacataggtctaatatatatgttatatgtttatttatatataatatattatattatacatatgtattataatatattatgtaatatattatattatacatatgtattataatatattatgtaatatattatattatacatatgtattataatatattatgtaatatattatattatacatatattatgtattataatatattatatattatggataatataatatattatattatattatggataatataatatattatattatattatggataatataatatattatattatattatggataatataatatattatattatattatggataatataatatattatattatattatggataatataatatattatgtatgttaatactatgtaacatatatattacaattataaaaaaagtgtatgtaattacttgtatcaaatagtgttttatctgactccctccatgtccataaacatatttcccacactgactatcacccatgttccctcctacctttacatactcaaggatttccaactgcccaggactatgaccttcatgtcccaagcacattaaccctcctttggcaatactcacctgctgttgacttttcatacttgctctcctgagttgagacttaattgtatctctcaagaccctgatatcaggtataagatgagatcaagtttataatctaagaagctcctccatgctaatagaataacacatttgcattttgacctgttctttcttccaaaattaatcaagaaaaagagcttttctgtagaacatgggctatttgagaaaatgtgtatcaaatgagtttgtcatcatttaatcacaccaagtgcatgcctttggactctatttgtgtatagagctaaaccaatatttgataaatgtttgcaatactgataacaaatttcttagataaatgggcaatgttattcttgtcttttaaagatgaaactcctgaaaatgattacaaagcccattgcttcatcacacacagacacatccacacaaacacaccatacacacacacacaattttcaagctttgaaaggctcatgtgtaagacaaagggtattttcagtaggcttggaaatcacttggcatttttgagatttgccaaacagcttgagatatttaaaaatatttttgttcaaccaaattccaaacatgtttttctgagtactttttttaggtcaatttttataaccatgtgtaatttcaagaaaatttaacccatatgtttgtttctgttagtgtatattcagattgatttataacacagatgtaagtatttctcttaacactggtatatgaagagggtgagagggtctcccaatttgctgcttgggacagtccacagtgagactttagattaatggtcacagactataacccagttctaatctcaacacagtctccatgataaaagtcacaggggactggctataagtgtcagcaaaagatcagatccagttactgcagtatgttgatgaatatgtgtgttcctagcatggactcaaaagatggaactctgactgatgactgtacagcactgtgagaatgaagcccttaagtgctactaaaaggtctttaccaactgtgatgaaaaactgcatctgtgagtaatgctacttactggcaaaataggactgtgacctgccaacatattccattattttttgtggcatcgagtataaaagtagacccgttgtccagttgtagggaaagtagaaacacaagtcaaaatactaccatacttcataggccgggcgccgtggctcacgcctgtaatcccagcactttgggaggccgaggcgggcggatcacgaggtcaggagatcgagactatcctggctaacacggtgaaaccccatctctactaaaaatacaaaaaaattagccgggtgcagtggtgagcgcctgtagtcccccagctactcgggaggctgaggcaggagaatggcgtgaacctgggaggcggagcttgcagtgagccgagatcgcgccactgcactccagcctaggcgacagagagagactccgtctcaaaaagaaaaaaaaaaaaaaaaagctaccatactttacagggatagcaaaaatgaatttttaaactagcgcgtgtttcctgtaattcttaaaattaaacagaaatagaaaaactctaacaagaacctcagattcagccaatgtgccaccttagaagtgatattctctccatagccaagatgctgtaggtaggaatgaataataacaggatgtcagagtaagtgccaagtggaaggaaattaaagtatagttatgatgtaagggggcagacataggtaattttaaaaacaacaatattttagaaataagaaatgattcataagtattgcttgtgaatgcaaaccaaaagtcagataccacatgcataatgaagtgtgactctatccaaatacttacaacattttcagggaaaaaaatatattctctgatcctgaatgttgtgcctacagaggaaagaaaatgaacctgtttactagagggagaaatctcagtgactgaagaagtcaaacaactttttgaactctgagagccaccttagctgttctgcttcagggttttgggcaacataacatctttatgaatgttaccttatagaacgttagttataccagagcagacgcaactggggatttgacaactctgccacactttgactggactgacatttccttagcagtaacaagctgctgctgtctggtgccatgggggccctgggcttgatttagtagcactgacattgactgcttgttatttcatatcttagagctgtcaggaggcaactgatgtcagcataaaattatttgatagctctgcatcttgggcaaaatgtgaatctattgatgttataaaatggccatcaaattcttggaattagggggtggagataatggagaaagaaaactcacctggtttattgttaagtaatcttttgtttaaaatttggttcacataaatatgaactgtaactatctattaggcacatactggttgtactcattaaactacatgctcatccaattctaacagtttcagaggataaatagtattattttgatcctcatttgacagtacagattatactcctggaagatggaaaagctgggacgcaaatgcaaacaatctggttccaagatccgtgctttcaccttgagttacatggtttttcccatggaattgaagatcctagattcatagaattctttccttgagctgccattgatttttttctttagttttaattttagaaaacatttgctcattttattgagggaaaatagcaattagcaccttgtgtgatctgataaatactcactgaatgaaaaatggaactttttatcatcctcatagcttttctggagtaaccgtgtatccaatggaatgattccagtcgtaaatggagttggtcaaagactaattctctcattacaatacttactttaacacagtatttgagaacactttgaaaatgtgaggagtagtgagtaaatgtggggaattttgtgattaataatctcagtagtaaagactattagaagctcagaagctctcacaaaatatgcaagaaatacttatcaaatttatgaattgtatctcagtttaccactctgttgatcaaatcacttatttttaaacatagtgatcttcaaatatagccatttctaaggaatgcatttgcttctttctgaaaatcacctgacaaccccaaatcatttccatttatattttgtatatccattgatcttgttttgtgttgtttaaaagtataatcttttatgttttttgattaacttgaacaatgacagatcacaatttaatttctagaatgtgtctttgtatgtgaatgcgtttctttttttcaaacaaatcacaaaggtctgggggaattgtgattctctaattcgagctcagtatataccagttgaaagcatttagttgtgattaaaacagattgaaggagataatccctctgagaaagcagcttcaaatagcttagcagcgcttcttcagggataagaactaacacaacacaagctaattcctccaaagtctccctggtggagctgtggacgtacctttcatttgttgtttttcttccttactgcgttctatttgaattcctcttaaatatgaattctgctttaataacactttactcattttgttttccaagaaccaacatttaaccttttgtgttaactgatacagggagatacacttcatataatattaataaatgaagagtgtgcaggcagttctcaatttacaattgaatgatattataaaagttcataggtaagtcatagacaatttagaactcgggatagaatttatcatagaaatgttgttctatataaaatttggtttcttggttaacccttcaaagcctattgaactctcaatgtagccgaatataccttatgtaactagtacaagttctgcatagcggcagttctatgagaatacttctaaccaatgttctggattcaatatcgggaagaaaaaacgccttttccttgggagtgccttcaaatttatttcgttcacagtgtatgtcatttcgagggtcggagaaactgacaggtctgtatcttctgggagtagtgtgctggagatgggagaaagagaaagaactagataaataacaaattgtagggtgagattttcttcattttcctattcgcttggatatgctgtaactccattttacaatttaagaccatgcccttgaaaaccggacccattattggagaagggatgagtaaagtgcatatatggaccccaactattaaaggctaagaaaagaaaaatggaagcaaatgcccaatgacaataggcaaagaagttatgactccttcagccaagcccaactgaagatagaagtggtacagatctcatgttcctggatattagacacatatggagcaatgaaatttcaaaaactatgttgacccttaactatctgtattaaaaaacattgaagatttaatggccaggtgtcgtggctcatgcctgtaatcccagcactttgggaggccgaggtgggtcgatcacctgaggtcaggagtttgagactagcctggacaacaatggcgaaaccccgtctctactaaaaatacaaaaaatagccaggcatggtgatatgcacctgtaattccagctacttgggaggctgaggcatgagaatcgcttgaacctgggagacggagacagaggcagaggttgcagtgagtggagatcgcaccactgccttccagcctgggtgacagtgtgagaccgtatctcaaaaaaaaaaaaaaaaaagaaaagaaaaaaaaaggaacattagaaatgttcctgtttactcacccgcttttccttccccacttcccccacacccctctgcccccatcacttcctcttccctcccaaaattgctttaaggattttcctttctgctgcgcccatgatgcagtgatggtgagccacacagtacattactgtaagtccctgttgagttgaggaattaaccaaatgctaccacagagtttattaataaagtttaggccaaattgtgaacggaattatattttaagacacagaacacagtttgctatgtaaagttttgtaagctggagcaacaatgcagaaactaatattctgtgaagagttcctagcaagccagaattaattgactaccagcgtctaaccaaacctaaagttctaatctagcttttatatacagatcacctgccagcacttcatcattttgtatatgctgtttgctatgctattatttggtgattgatctgctgtttaacttatagtaatgatgatggcctggcgttaacaataatggcatatgttaaaaatgtaagagagcatctcagcaataaaagagatagatatagttcagaaccttttcacattgcattgcccctgttaatgtttcacaacactttatactctgaaaaaataaaaataaaaaaaggaagtggcataaaaatagcatgtaaagtgttattcccacatgctgttcttggtctttggcatgcctgttatccccacattctccaaaaatgacaagaatgcatcccatctgatacatcctgtgaaaaatttaagagcatatttgaaaacacaaaatactgttttcataaactgctgaaatctgtgatagtttggcagtaatcacaggaacaatgctggaacacaacttttaattttttcttttccttgcgttctcttgtcaaactcagtgaacttccctgttctgtattgctttctgatgtgttgatccaagtctccctaaaacccacatgctaattcctgaacagagtttaacacttgacttttccccattaattaatagtccagtgttgatatcgatgtagtctttcttttgtggataaaaagaagcaatctgaagctaatttagcattgggaaaagtagtaacacagcttttaagaaaaagaggaatgaagcaatgggcaaaaccagctgtaagatcttctagacggatacgtgtggctacagttctatcaaggcaagaattggcagaactttggaaacttctgtttctatttttattcttttatactccttcagaatttaagagtcactccttgtctccatgacaaaacataacaaatgctgtttgttctagtgtttaggctaatgacataacgtgttaacccttggttacacagaataaccttcacattaagagtaatcctgcaccatttatgaaacataagcatcacacctggcagctttttgtcaataagcatatttaaaagaaattccaaaacaaagagttcagtgtagtgacagtgatactatagtgacttcttcagccatgttttgctggataattaattctccttaattctgattctctcctgccctgtgcctcacattgggtctatacttcccacagtgcttaggagatgtgcattcatccaatttgtacagtcagtctaaggattcaggcagactacataattcgttagaatacactgactgtgttgaccagattataacctgtctctgcttttggtgttatgtgagggcggcacaatgacagaaacaatggtagctaatacctatgtatgcttactgtatttggcacagattatctcatttagttctcacagtcccaagcttggagttataaaggaagaattcttggagatgatggaagctcaataaagccaaaaaacatgaacttcaccattagacagactcaaactaagttagtaatatttctacttttcctttttttcttttttaatataaattaaaccatttactcctctcctctaccctaaagtccaaatgtaatatatattaagggatatgatttgtcctgatttggtgtccatacaaattctctgtgtcagagaataacctagaacttggtatgctttatgattaataatctttcaatatgttgttaaagattttatttatacttgtggctgggcacagtagctcatgcctgtaatcccagcactttgggaggctgaagcaggtggatcacttgaggccaggaatttgagaccagtctggccaacatggcaaaaccttgtttctactaaaaatacaaaaattagtctggtgtggtggcacatgccggtaatcttagctactcaggaggctgacgcaggaggattgcttgaatctgggaggtggaggttgctttcagctaagatcacaccactgcactccagcctgggcaacagagtgatttatttaatctttattttctccaaaaagaaaataaagattatacttatacttgagtagcagtcagttataaatgagctgagagggtgaagtaaagaagcctgtatagacaaatgaacagagacagacttttgtgatgcgtctttaagggattattagaagatcattttggagtggacaactcaagaaagaaaactttggtgggaggttttacaaggtcttcaaggcaggcaaagaaatgtgggttttgatctgaccacattatatgcactttgcttatttatcgttgaggtatattactgaacactgtcttatcctatttcagtaataatctttgtttatttggtaaagtattatttttttaagggttagcaattctaagttccaccatgaagcagtcaagtgaaattgtttctcagtatttgattgacttgattcatccattttcaaagaaaaggtaaatcatatagtattctgtatgatgtagactgtgtcactcagagtgaaaaagttacctttgtcttctaccatttgagaatgtgctgttgaatttgcgaagaaaagagccctgaggcattaatcatacacattctccaatctagatttcaaaatgttcagtagatgtttagggtatgacagaagaatattaagcccgttaatacggtaattacagtgtttcttgcttccttgtaccctgaactgattaatacataaacaggactcaaaatataaactttatgtttagtgaaagtgccaatatctatgtctgaattcatcaatgccatcttaggaaccaggcaatatctgttcactgcctagtgccttagggagactgtttaatgaggagatgtgaagccttttacagtttattgttgatgacattttgaggacacttgcagtggggtagactgaaaaacaataaagctgggtattttcttggatatggtttatgtgccccagagtgttgtatcagattttatcagtaatcaaatttctacttgatagcaaaaacaaaaacaaaacctttttagaaacttaatttcatatattgaaggcaaagaaaaaaatacttgcaaatctgatatctgaattttcttaagattcaaagaatttcaatttttctacttattcagttgaattaaaggttactaccactgtttttacaagcttgaaaggcctatttatttacttatttatttatttatttatatattttgagatggagtctccctctgtcacctaggctggagtgcagtggcgcgatatgtcggctcactgcaacctccatcatccaggttcaagcgattctcctgcctcagcctcccgagtagctgggattacaggcacgtgccaccacgcccagctaatttttgtatttttagtagagacggggtttcaccatgttggtcaggctggtctcaaactcctgacctcaggtgacccacctgcctcggcctcccaaagtgctgggattacaggcgtgagccaacgcccccggcctgaaatgcctattttttaggttagatatggtagtgttataactgttgatatcctttgtagtctgtacttaaaaactctgaaatggcttgaggcagttccacagcaaaaattccatatgaatgtctattcagataacgattcttatattgtgtactatattaatatacgtaatgtatttttatgtctattgcctaatactttcaaaatgaaaagaaatggaacaatatatttttctcttgcctttgttttcattggaaccttttgtgaccaccttgtacttattaacatctgagactatggcacaacgctgtggtgaaatgtgagccatcagtccaggtgggctggtgttcgtgtgtcttcatgatcgggtctggtcctcagctctgtaggtacattttacagaggtagtattatggggtgtgtggttaaaagctctggaaatgcactttgtagacttgaatccgaccccatcaatttcttagtgtgtatagttatgtaactcatagttatgtatgtaatctcagtatgttgcataacttagtgtgacgcagttatataagttatgcacataacatagcataaataactacataacatacatacttgatataacatacataactgttatgtacataatgtatatttagtacataaaagttacataatagacatatttgtgtaattaggcattaattccaaaagatgtagtacatgtttgtacctgcttgggttatcattataataaaaacagataatgtttgtaaatactttagctctaatgtataacacaaaattaatagccagtattagttgctgctgttaatattaatgttagtactgtgtaatcatctgaaaagtgcttgctcaataccaggttaaaaacagagagcgctagagcgacttattacaaatttacccaggtaatagaaaacccggatgcgcttcctcactctaagcagaaaatgtgtctgtgatgatttgcccttctggaaccatttccagttggtattaagtgaaatctactaaattttgtatcctgggtttctcttctctatactttgtgcagatacctctgtctccctaaaaagaattatttgaccagatacaatgcatatgattatggttattctagcttaagccagtttattataatagatttagttgaagcttggttatattctggcgtcagtagttttattaaccatgaagaggttatagctttagatttgttgattcaaccatgcattcttaagatgatgtcgcagacaccttaattaaacctgggtgttcctaaatttcctcagacattactttcaccatatttctaacattacacttagaagggaagctttctgcttctatgtagtcgaaatggtaaagaatcctagattttcgttttattagattgattagaacagaatgcaagtatagaagcttttaagtgaaaagatctatgtgaataaaaatatatgcctatatttttgttacaaaccagtgatttaaattttaatgcatatgtttatgtagagaagtatgtttgctattataataaacaataaaaagccattgctcatgtgactcatgaaagcaaacctggcaatgactttttctcatatgtctgcagcctaccatcacatatgcctaaatttttacgaatgtgtgtccagtatattgttataaccatctgcaatcaaatgtgttatgcaaaacaaatacttaattggtataactaattctttgattcaataatgaagatcatcacattatgttatttagagtaattacttatagcttaggttgggatggacacttttcaggaagaaaatgtatactttgtttctcttttttctgaaatagggatggaaagggtattaactagcattaaaaagggcgaagcaacaagcttccctgattggagtgtaggtcccaagcattttactgataaattcattcagattgagtaagctctttaagctctttctttctttcttttttaagttaaagtcatactctaacacctattctcctgcccacaactatacctttgagtaaatgttcttaaaactaacaggtacttctctcctaatgcctaaatgaactcaaccaccatggagaagtgatagttttgattggtagatacaaagtgatcatttcagcattgtattaagctgtacgtggattaggtagtagccaaagaaacagggtggccagagattttgagggaacaaaggcagaacagaaagtgagaagaggccaaaacaatacatcagtcgtgtaaatctgccttgggcactgctgacctatataaagctgaatatcatcttcagtgacatcttcggtgtacctgtcctggattgcctgtgcttggcttcgggcactaattttctttcctcatacaatccaatccattaaacgtctgctatagtttttctggcctgaagagaaattttgtttgtttgcttgtttgtttcggcctagttccaggcccaggataagatgaagcaaacactgctttcattcattcatacatcacatatatgcttctcttcaaccttctcttccttgctctctgacatacacaggtacttctaaagctctgggatatcccttaccatatagcaaacttcctggcaggagcagaggcaatagctctctagtagtgcttggggtagtgacagatactttcaagactgacagaaaaaagaaaacacaagctctttttcaggaactgtatatatatatatagtgggtcttagtgagatacaaatctgccactaaggtaccacttattaggccttataattgagatttacttgtggacctgaaaactctgcacagtccataagagaatttcctgtattccctgcatagtaggagcaagacgattatctattgtaaggttatctatattattccatttgacatttttaagtctattgaagtaagtgagaaatgtggacctttgcaaagatactgattgcccaaactaaaagaagttaaaacttgaagtggtaatttagtgttctcttcaaaggttgtttaagtacacacattattaatatacacttagtttatgcttttgacatagcagatcagactttacacctggaaaaattgtaaagacaaaggttaagtttgggcatggtggctcacccctgtaatcccggcacttagggagattctttgaggacaggagtccgagaccagcctgatcaacatggtgaaaccttgtctctactaaaaatacagaaattagccgggcacgctgatgcatacttgtaatcccagctactccggaggctgaggcacgagaatcgcttgaacccgggaggtggaggttgcagtgaaccaatatcacatcaccgcactccagcctgggtgacagagggaaactccgtctcaaaacacgaacaaacaaaaaaagcagagatcaaaaaatatctgtatgttcatctatagccatagctgtacctatgttctttaacttaattatacaacaaacatgatagtatttagtttgccaaaatgtaaatattttccacttctattcactcacctaggctggcttctttacaatagaccccaagcccattcataattgacctatcccctacttgggtctgcatatgatcataaataacagctctcgctacgagtcattattaaacaggaagcattccaagtgttaggttattctctgattcggagtagccatcaagaaaaaggaagaaacatagaaaataatttatagtgatttatggaatggcaactgagcctaactgtatgttagataaggcaactttgattttaaagagctgacactacgatagaagagagagatatccaccaaagataagcaatgcaaccttgttaactgctaactgagtcagttaatgatgtcctaatggtttgatggggagaaaaacctcagaaattaaatgttgaaattgtcataatggaggtatatgcaaggtactgtaagaacaaaagagaagccttatgaacagccttttaaaagtagaatggactataaagttccagtaactctgtctgagaaagtcaagaatggcctcatagtgctggctttggagataggataatcaatgggcagaaatatgcctggtgaagaaaaaaggagataaaccaagggttctacttgcacaaatgcagtttttggagggcccctttggactttgtaggtgaataaagagccaggcttttgggtgcatggtgtacagagtatcacatcatggaaggtgagactgaatagtcagacagaaggcagagtgaaaaggacctctcaggttcagcaaaagattgtaacatttatccaacaagcaacacgaagtcaagaggggcctgtttgtctactagccttctttgtacctccctctccttccctttggaacttccttatttcatttttctgttcatcttccttttttctcctcctccttctgctcctcctcttcttccttttaacccatctctttctcctcttcctctttctttttttttttcttttgcttataaatgaaggatgatcctttcaatagtagtgtggtggatggactaggattgggaaagatgattagtgtattgaataattagaaattttagtaatacattatgagggaactaatgagggccttccataagaaagtagctgataaaagcagatacaaccttgtatggcaaagacaggcaaaatctctggttccctgcctaagcctggtgtaccacaccaacgcctgacaccaaacaggcagactgtgaagttttattatttgcaaacaaacacttgtgaataatgcgtagcttctattttgtgatgctgaatgaattggtgatgcctttcccaaggccaaaaacaaagcttgtgtaaaatagtagtgaggaaaaaaggaagacaagttccacttttgttttgctaaattcggtatatgtctccaggataaaataatgtctgtattcaacaaatatctggaaataaatacgagttctagaataagggaaagaaggaaaaaccatctacaagagatgaagtttcattgcaatttttataggacagatgatgtaaagggttggttttctgttaggaagaaattaattgttcactttctgaatgaacatcggcaatttctagctgttagaaagtgaagtcatatttctaaagaggcactgtcacagagatacatttggaagccttcaaatatctttttgttcttttaaaattagcattttggcttttccattcataaggcagccagtgatcagaaagtaatttctttcttctttggaaagaaaacctttgccctaagaaaaatggcatctcttcctcaagattagcccccaaaatattaaacttggggtaaagcagccaattctgttcatggttatgaccaaaaaagaaaatggagagtttattttcttaaaggctgctcaagttcaaaaatttgtgtttgatccctcaaaattcatttcatgttgaatatgttacctgaacttaagttgagtttacaatatttttcaaaaaatactataacaacaaaacatttattttgatataaaattatgtttcttatattgttactttattttatttgaacctaatagttaactcgcaaattgcatatcttgctcaaaaataagctatttctttaggcctacataaaacattaaatgagaacacgacaaaactaactgattctgggattacataaacatcccctaatcttaatattaaattcatttcttttaggaatacattgcaaaaattagggaagaaaggttttgaattactttccagtatgaaatagtaaggtcttttaaatgtatggataatcagtaaaatcattttattagtcatgtttctgcttccttggcagaaaacattccagcttgactccacaaaccagcataaccaagtttgttatagtaaataattaatctgtacgtattggttgatgtttcatttcagcatccttgaaacattccatggaactttcatatttccaataaacaacttcaatcagtaataatatgcttgggtaaaacaaagaaaatgtggttatttctttccaattataaagctaagttttagaaaacagacatcagagaaggggtaccacagatctatttttaatattcaatacaagttagagctcatattttattttggtccaggattaagaaaaaaatttgtttggagatagtattttacttcagcatttccacattgagtcttttctatttctcattgtttgtgatgcttttaaatcaagggcactttgttttttagctcacatctgctccccccttgttctggtcagactttcaacacgtagttgctctgagattgttcaggagatctcagacaggatcaccacgaccttacctgagagtggtcaaaaaaggagcagatgcgtgttgtgaagattaagcttatgtttatctgacaaatgaccttaaagataaaacgcagaaagcaaaactcacaaatgtggttgatgcagagcaacgagacaatgttgtggcaattatttttaaataacttattaaactttataaaatgaaaagatttttttaatggcaaacataggtctttaaggaaccacagagtgcagttattgaattaaaatattgacgtgaacatatttttcaaatatgcttcaaatggtaagtatctgccatcacaaatattcaatgtttttaaaaatgctaatatatttaggtataggtcaagaaaattactaggattaggtatttgctactagcaaagcaatgccatttttcctagctattgctttttctattgagtaaattattgaaataattgtttgagtttatattttactcatagttgaggctagaatagtaacgccagtgtattgatagagttgatttgtttttgaattatagatctgataatagaaacagccctagaggtgagtccctgatgacatctcaaaatggttgtttaattttccatattagaggagtattatgatagaacaacaaacagagctgctttcagacaagaaacatttcatttaaattattttctttttagttaatttctaatatatttctaatatacttaccttattttacaggagatgcggacattaagaaagcttttctttattttttgccaaatgataaaaaaattaacactctttttttaatcatagatatatatattccgtatggttgaagtagacacattgaggattagagttagaagttatttgcacttagccaggcaaatattgactgtaattaaatgagcaaagataatttgaatgtacagataatttcaaccaaagaagatgccaaactggtcaggtgataaagaaaagtgtggtgagcttgaaagttccaaatatttttcaccatcttcttcatataagaacacattttcagacttgaagttcagctttctcaaaaatatttgaaatactgttgatgtgctgaacaggaaatttcgatgcaacttgcatctgtggacaacatcagtgtccctaaaaatgcaagaaatgatcttggtcagtatagccttaaataatccatttaatgaaagaaaagttgttttgtttggttttctcaatctttgggtagccttttaaaatcatatcattttcagatctccaaaaagccattattatcatgtccctttcatagaactaaaacatacatctacagggaatgatgaccttctcatgaattagtggctttaggcattataatatatattttaaaaaaaaagagttggagtggctagcaaaaaacatgcagacatttcataggatttttttcccctttccacttcaatgcatttatttgaaaactgcttatttgcctgaatttgccctgctggcaaaatttttctaccagatagctactttttattgttgatgcacatcatgaatagcagctttatttgatggcaaatgagatgccccaagttgcaagctttccataaacatatctgaattgttcaatttccttctcattgtataatttccaccctggccctttgcctgctgatattccgataaagatttcattcaagtaattttcaaaactgtcctatgttctttgctatcataagtggtaagattgctcaattcgtattagctataacacaagtgctgcacaggttttttatcagatatttctaaaatcatttctttgtcatgaatggtaacgagaataataaaataatgcctccagttgggtttgcaaacactggtggtttactagcaatagaattagtagtaatatgaacgtgaaaagtcacttttctaaagaacatatcttaatgaattattttgtttctttttctttcatgtctcctaacatggatttgaaaattatgattgctgaatgattccaaatgacttgggcctttgtttctcaaataggtaagtgattcttgttctttggtgttcttaggagtccgtggttgtattttaaaataaatattcattgccagtttgcactgttgaattttctggcaaaatagggtaaaaattgaacataagacaaatcatcattttcagaaatataattcagatctttttcattagttggcacaggaaacagactaacaagaagacccagtttgagttgtacgtattcataggagccatatgttcaaaatcatttaagtcctttttgctggctagcttttgtattttaaagcagcttggtcatattttgcccatgaagttctaggtcacactagactagttactaatcataatactgtatgaattacccaggtataagaaagcatttcatatggcagccagtaatggcttgatacagaataattagctaacaattttcctgatctcaaagatactaggctgaaaaaaagtttagctttaggttctgtagtatcgtcacttgtagagctgggatcaacaagctagtctatgggccaaatctgaccaactatgagttaagaatattctttacatttttaatggctgacaaaaaatcaaaagaaaaataatatttcataatgtgtgaaaataatgtgaaattcaaattttggtgttcaaaagtattgttggaacgtagccatgcttatcactttacatattctctattgctgttttcataccacaattctatggcccatgaatcctaaaacatttacattctggcccttaacagaacaagtttgccgattccattgtttgagtactagcatataagaggttaattccccgaacctcttactttggagattctattagagcagaggtgaaatcattatatatctgaccttttcttagtcacaagggaatccaccatatctaaaatgaccaggtcagaacaaatggaagagcaaatcttgactgtagatttaagttttcctgaaatagtcttttacatagttatatttctcatacattttaagccctacaacattcaacccattaagtctaatgtattttactgccagcaagtctttgagcttgcccacagatattcagagtcccatagttgatgggaactggggaagtggcattttgtggctagtgaagcagcaacatgttgtataatgaaaagaaatatcctcaaacttttcaatagttctcaaggctctgtttcaccaaagagaatactaacattctatagagactgcctgttctgaattacatttgacagtgttggaaaagtgtaatactcatcactgtaatccagcttagcatctaaaacaacacaagtaagtacagttgtgctttgtggaatagattttgcagaatttttcagaggccatgtggaacatgagtggttatatgcatattctaattaaaaaaaaaactttaaaaataattataaatatattgtagttcttttcatgttggcatttatcagaaatagatgcatttgtagtttgagaaagaaagaaataaaagagaacaaagaaagcatattcttggaatattgcaagagagagcaatgtagaaattgctggatattaagaatatgcattaacttctaggtttaggccactgggaaataaagcttccgtgcgtgtatttgatgtataatgacaggcacaaagaaaaaggcaaacatactatagatattctagtatggtacaattatacagtatgtgttctaacccttttcatgaaaatttgacattactgcacctcagatagaagcagcaggaatcaccagggaaagaacagctggatgctttattaggttttatgttgtacataaggagaccatgttttccattgtcagtgtgtaaaagaaaatgaaagctctgggcatcattaaagtctcgaaagcgtaagatgtgtcagctccattctctcaacacctggattgaaagtgcagtgtggggtcaccgtaaaacaaaaacagaccgtcttctctggttggaattgcaagagttgatttttagaaataaaataattcataattgttgtagagagaattcttcctttataactagagagttgcatgtatgaacataaacttatatgtctacctgaagacattttctataaactgcgtctgaatatctttttcctgcaccttaaggggtgctaggaggcttcttggagtcagagagctagaagactccccatttgctgccactgtggtattgtccttttgatgaacatttctccctggcttttcatttgcctccttttgtggaaccatttttgttggcatcccccacccaacacacacattatattctcattgtgtcccttgttgcaagtacctttatgttggagaccgttttaccttatacctttatgtaatccacaaagcttagcactgtgttcctcttattgtggtttaaagtgctgtattagttggctcaggctagtgtaacagaataccacaggctggatggcgtaagccatggaaatctatttcctcaccgtcctggaggccgcaagcctgagattgaggtacaggcacggtcaggttctggtagggtctgtcttcctggcttgcagatagctccttttctctctgtcttcacatgacaaaggggataggtagatggagagagagagagagagagagagagagagaactttcttataagaccacaatcttattggataaggatgctgctcttatgacctcatttagccttaattattgcctaaagatcctatacagtcacattgggggttagggctttaacatataaattttgagagaatatagttcagtccagagcaagtacctttgacacaaattgagttacataagcagaagagaggactgaatttttctcttcatgaaaatttaagagctctttgcctataggctttggccacttctgttttctccaagagttgctcatattaaatctagtaaataataaaaatgcgtttcaaatattaaaagatgttctatgttctggcgctaatctctactcttaattatcttaaaaaacgtacaagaaatttactattgattttattaatcgctcatgaacccacttatttacgtatttaacattgataggttgcccaaccatatgcagggggatacagactaaggggcttaggatctaaagaatgtcctgacaacattgtaccctttaggaactcctagctggcaagaaagacagtctcagagcaatgtgtcaagtgcttaatataatttgctcttgacatacaaatgaagcagtgcccacaatctttagtaaattagagacttctcaataatgatagcatctgatcatgagattgagtttgacagttgaagaaataaagggagtaaacaaacaccaggcaaaaagaatggcaagtacaaaccaaacacatgggtgaatgagagagctttactgcagtctgcaaaccatttatgctgaacaaaatgaagaaaatacaatgctcttaaattttgtttgtttgtttgttgagctcctactatgtgtcaggttccaggttatatgagtcagcatagaatggaaaacaacaataagctccctgttcttgagccaattttcaaaggtgaggagataattaataaatgattagtaaataagtgatcaagaactgtaaatgcaaagaagaatataaacatgaccttgatatagcaggatgggctaccgtgagcctccttttatggtcagagaggtcctcctgagaagatggtgagaaggagatgtttgatgtaaaattggaatgacaaaaaagagtcagccatgtgaagatccaggtatacagaacagcttctttcatatatcaaaaatatttttttcttaaaatatatgacatattaaccttactttaaaatatgcaagaggaaaagtgggaggatgcaatggactgaacatttgtgtcccacaaaattcatgtgttgaaatcctaatccccaaggtgatggtgttaggaggtagagcctttggcaagtgattaggccatgagggcagagccctcatgaatgggattagtgtccttataaaagaggcccaagaaagctctctagtcccttctaccaggtgaggacacagcagaaacatgccatctgtgggccagacagtgggctcttgccatactccaaatttgccagtgacttgatttggatttcccagccaccagaaggtataagagatgaatttctgttgtttataatctacccagtatagggtgtttttttgttatagcagcccaaatggactgaaacagaagataaaaaatagtaagatcagcagtggtagagcagtaagacattgaatggttgttaaagataggtgatgagtacttaggaatctgtgagaattttctctcattttatgtacctttgaaaataataatattaaaagtttttttggtctcaaatgttttctccatgaacatactgtttcttcttgatatattccttatttattacactaatataaagaacattatgataaataattcttgaagggaattgcattccttatctacttcagcatgacaaattaccccaaagcttagaggctcaaaacaacaataagcatgtattagcccttacagtttatgtgggtcaataatttgtggttttagcttgggaaacacccttaaaaaaaaccgtaaaaactcttatgagatttgagttaagatgtcagccaaaactacagttatcgaaactggcttgactaggtgaaggatttgcatcaaaggtggttgactcagaattgactagttgatgatgttggttggtggcaggaggccttagctcctccctgctgggtgtccccacagggttgcttgtatgtccttaaaatatggtgtctggctttttctgaagcaatccaagagaaggtagaaacatggcagacttggaaatcacacacccttaccacacatgattgtattggtcatagatgtcagccccattcaaggtgagaggggtctacatgaggacatgaataccaggagatggagataattggtggacatattgaaggctagctgccacagggagaaacagtatatttggtattaaacaaataatcttgacatcatgctcactgaattgatgccccctccccaaaataaatccctcattaatttgttgttttcaactcataactcacacaactatctttaaacctctgtatctatatttagtttgtagggtacacacttatataatgatgtctttcttctgattaggcacttaaattagctgtatttaatggaataatgatattaaataactttgtaaatcaaaaggtgaaaatatatgcctagaataaattatcaagactttgtccagtataatgagtggtgattattttccagtatactcttcaatttattactgtaataatcttttaaacccattaacagtcaatttgctctgtgatattaaaatgttagccacattatttgcctgttaatgtaggttaaatgttaattatgctgttgtatggcggctaagatggtacatccagaaattacacataatattggttggttctttggccgtcatacactaatgtgcttcattattattgtgctaattttagtaattttagtacaaactacataatactctgtgttactaaaacagaactacccatgatatattgcttgcaaccaaacattaggcaattttggccccatcatttaggagtagtttacatgactaaacaagtaatgattctgtaactctcaaacttgcatttagtgtatttagaatgaattgcttagtatattttaaatatttgtagatcaaaatgtaatcccttttaaaacaaatgtaagtcatgctttttaagctaaatgtacatttaaacttcattagtgtagtgattataaatacagctatgattattcctccagttgtactaataatagaatggcatatcaaccttctccctgggtccagttttattactcctcattctactcttacaactattttaaaataatacttagcagtattttgagaaatagggtttgttttagtaaactatcactgtgtaacttgctgtcacaaacttagtggcttaaaaccacactcatttattattttacatttctgtaggtaagaagtttaggctcagctacctttctgcagtaggttcacattcccggaatcaaggtgttggcctttctagaaattctacggatgaatctgctttttagctcatccaggttgttgcaggaattcagtgttctacagttgcaggactgagattcccatcttcttggtagctgtgggctggggttagttctcaccttctagtggctgcctgcattcctcatcggatacccacttcctccattttcaaagccggcaaaacgatcaagtccttttcaatcttcgaatctctcttaatccctttctcctttgtcctttctcccttctggcagagaagtttctctcttcttaagggcccatgttattagattgggcctacctgtataattcaaggaaatcttcttattttaaggtcagctggtaagtaaccttaattccaactgcagagtcccttcacagtagtacctgagggagtaaatgtgggaaagaaatctcccagcgatatctttggaattctgctttccacagtgttgttgtttgattagaaatttagagtaatgtaacctgagagagcccactcaggagaagttccatttaagtttagttctcagtgacacaaggaatcatggaaagatctggagaaaaccagaaaaagaccatgctaattgcaagtacaccataaagctgtaaggttcatatttgatttattcaaaggttcataaagcaaaatagataccactactaaccaaaacaatacgaattaaatacctcgcgttccagacctgaaatattataatatatataaataaataagcagacatcataatttgcgcttccatgttcttaaaacatttttgtagcaattttccctctttccttccctcttaccgtataattcccatcagcataggactataatgtttatttctgccagaaaaaaatagaagaatctatagtgtgtcatatctccccttatctctccctatctatattttctgctcataatttgtatttttttcttaagccacgtctaaaattcagctccttttcccccaaatattctatgcaaactgcccttacgacccacggtgactttcacattactaattatgatggccttgttagagtattgatctaaatagaccccaaattaggatttgacacagatggtcacactgtcatcattgatatactttcttcactaggcttccagaacaatcagccttgcattgtttttctcctgtctgcctggaagctccttctctcatgtatgtgttaatttcaccttcttgcccaaatccttttctttagagtgctccagctcagggtttttagacctcattttctatcttaaagtactttctaggtgatctcatcatttctcatggatttcactaccgtctctagctttactcctaagagttctacttttcttcctaaaaactgctccacccacacttttctgctcaactaagcccaggatttttgattttatacacctttttttcctctaatccctttcctgtggtgagaaaagcttttaccagacaggggtcctgatccagatcccaagagagggttcttggatcttgagcaagaacgaattcagggagagtccatacagtgaagtgaaaacaagtttattaagaaagtaaaggcttttaaagaacggctactccacagacagggcagccccaaggtcagctggttgcccatttttatggttatttcttgattatatgctaaacaaggggtggattattcatcctcccctttttagaccatgtagggtaacttcctgatgttgccacagcatctgtaaactttcatggcgctggtgcgagtataacagtgagaaccaccagaggtcactctcatcaccatcttggttttgatgggttgggactgccttctttaccacaagctgttttatcagcaaggtccttctgaccttgggtcgacctcctatctcatcctgtgacttagaatgactaactgtatgggaatacagcccggtaagtttcagccttattttgcccagctcctattcaagatggagttgctcttgttcacacgcctctgacaaagctatttgttctattttcagaatatgtccagattgcgttcatttcctttgccactgcctaaagtcaagcaagcactatctgtcacctgaattatggcaaacccctcctaacaagtctccctaatcctgcccttgccttcaggtatcagtgcccaccacagctctgacctctctcctgttagtctctccccagggctaagtcctcattatcttccttgctttttcttacagatgcatcacctgttggctctgcttcattatcttttccaacagatattcatttgtctggctctctcactttcttcacttcttctcccgaaaagcttcttctcggagaggcctttctttacattgcaatccccgcctgcacctgaggttttgtattcctgtttcctgccttgcttcttcttctcacttacctaacatcagcctagcctctaaattctgtgtgagaaggtatttttgtctgcttttttctcactgccagtgctagatgagagccttgaatataataggtggtcaataaataatactgagaaaaaaagaataaaacatgaaagtacattgatagatggtatgttttggtgctggctataacattttgaggtagatagtacaggtattattttctttattttccaaatgaaggcaattatacatcttgcccagggtcacaaaactagttaagtatcaaagattaaaccaaaactcaattctcttgactcctaacccggtttccattccactacaataggtgctaaaaatacaatgttgtctgttcttgggagctacagtacagcatccctcaagaacctggaaataaagaaataagattgccttctgagagtcacactatgaaatcgacgtgtaatgagtcacttaccttaaagagctagaaatgcttttaagccaaagggaccattactgattaaatggtttaacatttccaaagaaagaacattttaataagaaaaggcagacatagaggcacttcaagaggatactccaaagcgaaagttgggcacgtgaatcctaggggctggagtctaagccagtgaattatgagaattccagaacttcctgggttcacagatacatcagactctgttagttaatgacaataaacattggattcatctgaccaactcactttttttcagagaggcctttctttgtcaccccactttatattgcaatcgtgatcacaaaacagccttatgattaataattaattttccatgcagctctgcctgtctatagaagaaaaatcccttctaatatgtacttccagcagtctggtcccgatgttagttatttcttattgaaagttagttgaccttctgattgcagtatggcttttgtaaagcttacttttggaagaaaagacatcctgatttcactgacacctgtacgtccctgcgattggtacattaaaaaaaaatatatatatgtacacacacacattcatatatatataatatatatatatacatatgccgtgtgcagtggctcatgcctgtaatctcagcactttgggagactgaggcaggaggatcgcttgagcccaggagttcaagaccagcctgggcaacatagctattaacccaggtaattttgggaggctgaggtgggaggattgcttgagcccaggaggttgaggctgcagtgagccgtgatagtgtctctgcactccagcttgggtgacaatgtgggaccctgtcttgaagtaaatatacactgaattgtgattttatgtatcaatctcccttacttggttaattgaatgtgagtctcttctgcacctccctcacttccactgaatatggagatgctcttaacatttcagtgtgaaacaaaatcaaccactccagaacttcctagtatcattctgtactcgaagtgctgcacaaaagcaggctctgaaggaggctcctaaattagagacgaaggacagacttttttttcttgtatagagtcttaacagaaggtgtcaggtgaaattcagcattttagggaatagtgggtcaaggataattctgggttttcatagaaggaaggaatcctcttgcagagtagctgccattgttttggcaacttagatttttatcaagaggcaatgggaggggcacttgtcgttaaggtcacttgcaagaggaagcccagaggaacagctacacggaactggacacaagagaggcccagaagaggagtctcagtctttggttgtctctcaacagaagcaaattaggtttctaaatcagccagccagagaactaaacacacacttggtggctttctgatttatcaagcacagctggtcacaaattatttttaatgcttgcatgtatgcatttctatatgtgtcaataagttatgctttggtggtttctcccttttaaagtcttgaataatagttaacaaagcactcagggaaaatattttatttctagcaagaaagcttccttccttcctatttgtttgttttactcctgacttgtctttttaaattatttcaccttggaagataaatcttagggaagtttattgtgacaacctcaaaattctgttgtactatagtcagatctcgaataaataattaattttagggaaaaaaaagagcgacataaacatatcaaaacatactggcattgtgatggcataagaacacctgaatttaagtctgagagttaacaattcctctttaacatcaagatatcactcagttaccacagaaatgaaaaatgagccattgaaggtgaatagacaatgagtggcatgacttttatgttgggcaggaaacaaattatgatggcaggtgaagatattgatcatgagaatgagaaagggtagctccaagcccaggaactgggatcggcaaaaatgaaggaaaaaactgagataaagggttccttggttgagaatcgtaaggtgcctcactacagtcaccaggtatattttcccttaacaaagtggcagagtcatctacgttgaaatacaaggaggtacctccttagacatcaagaaggtctcatttatcagcaagtagaatggaggatcattgtcataattaaccaggttctctaatcagcctaaagctgttgagagtgaattaggaagcacttgttatattaacattctaagtggaaagagcacaacaatataatctggggtctccaacaataagagtcgcaggtttttttgtccttgcgataggacaaaaaaccaaacacctcatgttctcactcataggtgagaagtgaacaatgagaacacatggacacaggaaggggaacatcatactctggggactgttgtggagtgggggcaggggggagggtgagcattaggagatatacctaatgctaaatgacgagttaatgggtgcagcacatcaacatggaacatgcatacatatgtaacaaacctgcacattgtgcacatgtaccctagaacttaaagtataataataataaaattaaaaaaaaaaagagtcgcaggtatcagcattttactctagcattctagaggaccttattttaaactcggtgcaaaccactacagaaacacataatgaatgatttatgctctctctttttttttctgaaaaaaaaataaaaataaaaaaaggcctaggatttgaacatgtaggcaggagtgactatagaagtgttgtcaaaactcttgactccaggagtaatgacaagggcttctttacaattcgtgcatcattctatttcgtggaagatattctcatgcaggtggtctgacatcctgtgtctatacacagcagcatcagcccagagagagacatcagtttttacacaaaacagcgatatttttttttcccagagtctaaagtcaatgacatcctgatgggagaattgcaaggctacgacatgcttttcttgttcatttggtaagccatgaagaaattagaacatgattttttttttccaatagaagaaaactatgacacagaatgaatagtctcaaaaaagttcaaaacttttgttttgtaaaaaatggtcatattattgtcttcatcttagttttttgccttcaccttatttttcggagtgttcaaccttagcaacatcaaagtcatcaactgaaaagtcaccagtgggaatgaagtctttctattgagttgatcttctgttagttcactgtagaccccagatgtgggaagttacttctctctgtgacaagacggctagagagagcattcaggaaaatgcagatggcgagtatttcttgatttaaacagctcatttcacatggtccatcacataatccttttaaataaagtagtttgtctcaatagacttattaatcttattggtcatgtgctacctgtgtttgattgaatctcagtgtttacaacttatccacagaattatttttagaattgttcttttaaattctatgatgaaggaataaattcttaatggcttaaactttttcatagtttaaaaatttatttttaaaaatgttactcttacaaccaaccccctttatgaacctggtgctcaaatgaatattgtaactttgtagtctctctaagaagttttcaaagctgtacattgaaccagatgatatatttctgcgatgtgggccacccaaacatttggggtgctgtcaatagtgtaaaagatttgagcaattactgctacttctaaaaaggtgaattatatcaccgttccttgttttagataaagcatagttggaatttcttgacatgattgaggaccaaggagagctttggtcaaatctattttatttgaatcaagatagggagttctgaaacaaaaatgttcaaaggataaacgtacttggtatctaattagtcagtatgcctcaaaatagttcttgcatacctagggaacctttttttttgagatggagtctctctctgttgcccaggttggagcacagtggcatgaccttggctcactgcaacctccgcctcctgggttcaggcaattctcctgcctcagcctcccgagtagctgggactataggcatgcaccaccatgcccggctaatttttgtacttttagtagagatggggtttcaccatgttggccaggctggtctcaaactcctggcctcaagtgatctgcctgccttggcctcccaaagtgctgggattataggtgtgagccacagcacctggccgggaacctttagaaaaaaaattagtaattattaatactgctcagaacatgcaatggaaaatattgatgtagatcttctgaaatctcttcttggattaaactctaagaatagaaaatgtgtaaatgaattacattaattaccgcttcttcccaccactgctccttcaactccataccctgaattgtttttactgaattgcactttgaaattatgcccttgggccacattgaggatctttagaaaaaaacagccctgagaaactcattactttatttactgtaagatgttgtttgaggatgttgttctctgccttgccatttggacaccttttgagaacccccagaagagatagatctcaaagggcaataccaggaatagtcttctatttcctgaacaagtagttgttggtctcatggacactgacaattacaatttttttttcttttccagtttacactggagtccagataatacagatcaacctagagcacatctctacccttagtacagaatattgcagaattttttctcctggtctcactgcagtttcatttcattgttcctttgttaattttcctttgccttgatgcacttgttgacttaattttatttcgcggcatgaatttgcatcatgaatttgcatctaaagtctggaaaaagagtgtaaacaaccaaattgcctttataatgtgagtgagaccaaggcacctctgggaaaccaaaggcctagtcttagatgaagaatttggggaaagattgtcaactgaaatgtccatattttcatgaagtctctcagtgtggaagttcagtagaattaaggtgttatctgaatcagaatccctggaaacaacacctgagcataggtatttttttgaattataacatgtaaaattaaaagatggcatttctggcatggaaaagagcaagttcaaatgacctgaaaagggaaaaagcttggcatggtttggaaagagtgaaaagtcacacatggctgggacagaacgagtgaaagggaaaggtttgggagataaagttgagaagtagacaggccagatgtcaggcagagccttacaaaccataataagacgttgcatcccatttcaaacacgctagaaataccgaaggtttctttgttaagtcaagtttgttgaagtagaattgatatacagtaaaatttacttttttagcataaagttctgtgggttttgataagcacatggagtcaggtaagcatctctacaaccaaaacacaaaacatttctctcactccaaagagttctatcacatacctttatgatcaacccttcctcccatccccataccctaggagctctatcacatacctttatgatcaacccttcctcccatccccttaccccaggagctctatcacatacctttatgatcaacccttcttcccatctgcataccctaggagtttggctctgctttctcttgtatagttttgccttttccagaatatcttataaattagatcatacaatctgtagccctctgagtctggcttcttgcacttagcaaaatgcatttgctattcattcatgctagtgtgtgtacaccaagagttttgagtgggggaatgatacaaactgctttgagttttatagaaataactcctttgctgtggtaattgtgggagtggggttgtgaagaggtgattgtagcaggtgaaattaagggagaggataggtcacagcaggaaggtgctgagatgcggattcaggaaatatggtgaaggcttatctatcatgagtgctagtgatgcagatatgagtaggacagataattttctacttaggaaaaataatttcaaaacatttaatactaaaaaacaatgaaagtactaaaaggattcataggaaagtttaatataattttagattgaagaaaaacttattcatcaaaacaaaacataacaaaacgtggagaaaaattacaatatgaaaaagttaaatttgcataaggtgaaggacaccataatcaaaactgtaaaagtagtgtcagccagggagaaacattaatagcatatataaccaagtattgatgtacacactgtataatgagcagctatcaatctctgagacagataatccaaaaaaaaaaaaatgggtaaagtggagaagacaattaactgaagaaatatagatgtccaatatacatataaaaatatgcttattctcgttactttttgattcagcaattccacatctggcaatccattctatggtaatacttatgtatgtgggcatagattgttttgcatcaatagggaaataaatatgtaaatgttggtttattggcataataaaatattatgcaaccattaagaagaatgagctagatctgtattaaaagaatgagctagatctcagttaaaagagtgagctagatcatggaaagttctatgttaaatgaaaaagttacaaaacaatttgttcagcatgattctactgatagctaaataaaaagaaaagcacattagtgactatgtgtgcatgagagagagagagggagaatgaaagagagagacagaaagaaagaagggaaggagagacagagagagagtaagagagactaaattcagagaaaaacaactgtatgcacatcaaatggccaacaggttaatagcagttcatattcacagaggatcttagaattgggttgggtatgtagacgaaaagaaatacatttttcttacccatccctgggttcatgactgaggcctctataacaaaaggcagattaatagaaaaacttgcaaattgatttagcataagttttacatgatatgagaacttttgaaatgaaaacgcaatttatatattgttttggggaaatacccattagtaaacggttaaaatatgcaaggaatgataccatacagtctcaggaaagtggttaattcagggggagatggcaaagttgggcttcgtttctataatttttgactattaaaaaatataaagtatatatgacacgatatttaatgtttggtgatctagatgattgaaatatgtggacatattattttctgtttcctgatggtttgaagtttttgttattaaaaatacagagaatattttgcttagatgatgactaaagaagacattatggagtaacatgaggaaatatattaaatattgcctaaaataggggaaggaagaagtgtttagtttggaacagggtgctaccgttgtgacctttcttggattattataatacaaacagtaacttgcatctgttgagaagttattgtgtaccagatactttgcaagggcctttcgtgtattttatcatttaatcctcacaacagctgttaggtgatgctatggcttgagtgtgtcacccaaagttcatgtgatggaaacttaatccccaatgcaacagtgttgagaggtaggacctttatgagatgcttctcatttctctagcaaaagactctgccctctgaatggattaatacagttattgcaggagtgggttccttatctcatgggagttaagttcctgatgaaaggatgagttcggctggcccctttccctctctccctctgtcctgagtattctctctccctgtcatgccttccaccgtgttatgatgcagcaagaaggtccacaacagacgcagcccttctatcctggactttccagctaccagaagtgtaagaaataaatttctgatttttatacattacccagtctcaggtattctatcatagcaacacaaagcagactaagacagcctgtatcatagatgtagaaaatggacatagattggttttgaatcttattcatggtcacccagcagttaagtgacagaatcaagattttaaccaaagccttctgactcccttaaaagcttgtaactccaaacttccatgttctgtaataaatagcatttttctgttgagaaaggaaatgtggaagagactggtcctagccttaaatcagttgggttattaggaaataaagtagggaaatggaaagtaaagtttaagggatagaagaaaaaaggtttgggctaaaaactacctttccctatggaaataaaatgactagagaattaaaccttgaaagatccataaggattggtgtaaaattcttgtcttttcacttttgaactggtagttcaagcataagaaagaaacagtgtcttctcaggaagatcctgtttaaaatgtgttcctcgttggaaatgctaaagggtacacaggtttattggtttgcaagggctgttgtaaccaaatgctacaacctgggtatttggttacaaccaacacagagtttttgttgcaaactgtcataaattgtcagaataattctggagtctagaagtttgaaatcaaaatgtcagcagggccatgttctcttggagactctaggtagactctttccatgccttttcctagcttctggtggtggctgtcaatccttgtccctcaacttgccggggttagaactccagttccttcctctgttctctcattctttctttgtttctttccattgactttttataacaacactgcttagattagattgagtgcaccttactccgatgtgacatcatcataactaattttatctgcgacaaacttatttccaaataaagtcacattctgagctactgagaattaggacttcaacatgtctttctgtgggacacaattcaacccataacaacaggaaaaacacaataaggcaatcattataagttttatgtttcattcttgaacttggtagatattgagcatttaaaataaattaaaatatgttaaatgtataaataactatgagtatatatccacgtgcatctacgcaggccatgttttatttctaaatagtacatcatttaagtgtttagcaatttgtattatgtactgagattttatatctagataacaatgtatttagaaagagatttttaaatatcaccccaataaagaaaccagtggaagaaaactgtattaagtttcctccaattccttatttagaagagcatatagtattcaagtcaaataagttgttgaataaatgaccttttggtaaggtaaattattatagtaggtctgcaagatgagcacagtcattgtaggaaaatctgttgctgagtatgctttgtgttctttttcatttagttgttctgtttggttttgctttattttcttctctgactgaaagccttaacagaaacaaaagtgtttctctcatgtgaaatgattagctctctttctcaccctgacttcctgtcccgacttgaatagaaagcaatgcatgagtatctaaataggaatcaaatgttctttgacaaagatgcaaaagaaacaagaaaacaactggattttattcgtttctcagggacacgttcactgaactgcaaaagccaaaacacctgggaaaatctgcctaggcaggcagggctgtgaccagtaatggaaaatgcatctctgtgtgggcttagagggctgggaactatcatagactgtggctggagtgtgatcaagtaagattcaaaagagagagattatttcagaaccatatagcataaaactgaaacgcagagaacagataaatgtatgtgtctgtccttttaggcagaaagcatccgttttgaaaaaacatttacctgtgctgatttgaagatttcaatatgtgcctttccagagtacttgcaatcatcattgtgtagtgagccttcaaaaatgaaggcttgctgaagaacaccattacctgtgagtctgagtgtgttgtgggttgggtcatccaccagagcagatagggtagagagggcatctgtagaccactaagtaaaagaaaacatctgaaataccaccttctttattcagccctttggtttgtttgtttgaaatgaggtctcgccctttcactcaggttggagtgcagtggcttgataacagctcagtgcagcctcaaactcctgggctcaagtgatcctctcacctcagcctcccaagtagctgggactgcagacacatgccaccacactcaccaaatatttttatcgtttattttctgtagagactgggtttgactctcttgcccagagtgatgttgaactcctgggctcaagtgatctaccaaagtgatccagcctttcagtgccaggatttcaggcatgagccactgtgcccaacctcagccctctaatcaaagaaatagtaagctgcatagatgccaagtgtagaagttgaagtactaaatctctgctgtgttccagcattgctagggatgaaatcccctaagtttatttagcacttaaaataatactctctagtatccaagggcctgaccacttctttatcagtcaccacatgcaggaagcagtgtcagggccggcggggagtgcttaaatattctatttgcaaatgctctaagttgcaacagttagaatgtaatgcaaccccccccccaaatttagaagcccaggagggatttattctacccataagtagcaatgaatttgacacttgaagaaagttattgtgtataaatcaaaaattcagtgattataaattttgaatttttgtttgagatgaagggtggagaggaaaggtgggagtaggtaaaaataaatccatcgaggtaattgaagtcaatgaactttgtcagtcagtatctattatcataaaatgctataactgtcaccttgggcttatacagataatgaggactatctgtgttttaccaataaatttctttgtgttggtttagcacaagccttatacaagcactgaaaatgctaggagtaattttttttcttttccagttgacttttttttttttaacaaaactgtaacatgtggtttgcaattagctttaatttcaaactaaacatattttaagaagccaagtagtttttatgcatacaaagtttcaggattcctctcctctctgactttttaagcaaattgctgtgtctgggccccatctccacattttcacaacttaattcttagcactttcatctgaccacattctatattttgggaagcatccaaaggttttcttagggacttgaggtgggtgctaaaatatttttgtttgcattttttttttctggctacattagtttcttgttggtagtgagtgatttttcttaatttggtgattttcttatattaagattatgactttttaaattgcataggcaaaaattattagtttaaaattccagatctcttcatttctatcaggcatatctattggtaattttatcaatgtttatgctcatgcctagttagtacttcaattagcaaattaattgtacttttcataaaatacctttttaaagtaaggttgccagattaaatgcagtttgcccagttaaatttgaagttcagataaacaacaaatagttttgttccagttaaatttgaatttcagataagagcaaatcgttttgttttgttttcagacatactttttcacatagtaagtacctatacaaaaaagtatttgttattcatctgaaatccaaatttcactatttttttctttgttatttatttgtatatttattttatttttgtctggaaatcctactataaagaaagaagtataggaaaatttattggttaaaaacatgttatatatcaagctatctgtcttagttggttcaggttgctataagaaagaccttaggctgagtaatttagacagaatctatttctcacagttctgggtgctgggacctccaagatcaaggtgccagcagattcagtgtctggtgagggtctctccttcaaagttggcaccttctatatttcctcacatagtggaaaggagggtcaagctgccctgggcctcttttataaggacacccattccatttatgaggatggagctcttatgacgtaaacacccttggccccgacctcttagtactatagcagtggggattaagtttccaactggaattttggagggacatgaacattcagactgtagtattatctctaaaaatgtgtgtaattgactcagttacatttcaatgattagagagggaagggtaaatccaaatttaagatcttgttaactttgattcattaattcattttacaaatgttcaccgaatgcctaaaatgtcaggtcctaagggatgagcaaaacaaacttaattcttgccttaatgatatttataacttaacggagaagaacattaaccaaataatctcacaaatacatggtaaactgtaataaatacaataatggggaaggatgacattcatacatataggggaatgtgttggaaagggaaagtcaggcaagatttccctgaagaagtgaaatttgaattgttaaagaaaacaatcagtcaatgatacttgttaaagcacagtgaggctgactttagtcaggtctattgcaatagacatagggaccatgaaaatgggattttgcaatgggggagagaaattgaacgaaactccaaatatagcatgcacaagtgggaatttatagccaagaagtagagtgggggtcagtggatggaaaattgctaagaggaagcatctggagtaagaaagattcaaactaaaccaaccaaacatgaatcttgctgaagacagaacagagtgattaggtatcatctgggggatggtggaggatgaagaacctgctcatatattgagagtgatcaggtatctgtggtggaggattcttgctaaactgacttagcagggttcttgctaaaactggattttacaaggaagcacacaggagagcttaggagaaggaggctgactgaattttggttaagcaaaggataattgtcagaactaaaactaaagccccagtgggactaaattaggcaaagaagagtgtatcagtctgttctcacactgctaattaagacatacccaagactgggtaatttataaaggaaagaggattaattgactcccagttcacatggctagggaggcctcacaatcatggtggaaggcaaataaggagcaaagtcacatcttacatggtggcaggcaaggcggtgcgttgagaggaactcctttttataaaaccatcagatcttgtgagacttattcattatcaggagaacagcacaggaaaaagatgcccccaagattcaattacctcccaccgggtccctcccacaacatgtgggaattgcaggagctacaattcaagatgagatttgggtggggacacagtcaaaccatatcaaacaggtagaggaaaggaagtgaatttatacatagatgaggcatcaagaacaaaagaattgaaagtatgtgtcaggttgaacccagtgagcatagaaagtgttactaaaaattctgcaaaggaagtctaaccagatcaagcatgactcagcaagctatttcaattttgatactaaaactcaatggaaagatctaccaaggttttaaaagactagtaagatttgcatttgaaaagatgaatctagctgctcaaaagcaagaagattattgttgaaggcaccatttataaaccatttcctggtggcctgtatattcttgtagcaaaaagaaaatgatagctcaatgtatatcagatattggcaaactttttccataaggggtcagatagtaaatgtttcaggatttgcaggccatacgatctctgttgcaagttaataacagaaaggtataacaaattaatcaaagatttatgtgacccaagagccttcaaaaatgaagacccaaagatgtagggaaagctatctgtttttctgctaagtttagcgtagaatggacagccgtctagaaatgcgactggacaaaaggatatgatttgctgacaatagactgagagtgtggcaaaccgagccaggctgtccagacacttcttggtctctctgtgtaacatttcttcctccctggtatagggcacagccccactggaatgagggtcttcaaggaagaagggagaagggagagagtaacctttcagaagttttatgacttgctgtgggaagagagggattcaagtgtctatgacctgccttggagaagacgaattttatttcctatgaactcactatgggggagaaaggggagcagaagacagggggctgggagaagggcagacagaggctttgctttgagggcttctaatttcctttagttcaaagtccttgggatgccaaagcattatattttggagtattctcttctaagccacaacaaactaaaaaaatgaaaatcattttatcttaatacaaggtatatgaggcaattgaagccagcaggggctgacatcttctataatgcttaattgctaaagtctttccagtgcttctccattctgggtagatcttaaattatcttcacttttcttccctgctatatgtcttattttctgatatatttgtttatctactggtgattatcagctctgctccctatcaccacttgttgaactatattctccatgatttttaatattatctagtgtggtgcctcccaggcaatgttcatgacctcacaaatgggtcacttgttagccttggggcaccagggcagagtttgatgaggctttggatgggctggccacagtgatcatatatagctaaaagtggcctctttcattattcttgacagtatgagtgtattactattttctctctatgccttgacttggaaaaatttggaaaaccctgatcaactgtaacggaaagagtcagtaacaggcatatcagaggttctctggttaaggaagtagatattgaaaagagaaccattttggggtcagaacactggttctcatataccagctgatataaccttgggcaaatagtttctctaagctcaactgactaatttgtaaaaagagaataatagtagttgaacataagaagtaactgttatgctttttttgagagtatttaattagataatacttttaacttctagcatggtgttgagaggaaaactttctctgtcccaacttaggtgtgtgtgatgggagaggagaatgtgaatcaattgacaacagatagattaataggagaaaagttttaattcatatgcatgcaggaggcaggagcagtgagtaaccttgctgaatagccaaggataagcagtatacctagttaatgtcaggagttcgagaccagcctggccaacatggtgaaaacctgtctccactaaaaatacaaaaattagcaaggcatggtggtgcatgcctgtaatcctagctactcaggaggctgaggcaggagaattgcttgaacccaggaggaggaggttgcagtgagctgagattgcaccactgcactccagcctgctgggtgacagagtgagactccatctcaggaaaaaaaaaaaaaaaaagaaagaaaaagaagaggttctaagacttcagtgggaaagtatggaaggttctactgttttttgtttgtttgttttcatcctgatgctaatggagttttcttcttgactgaaagctccactgaaggagggtttatggcagctgaatttgtacatccttgtgttaaggatctgtcttctctcaagcaggaaacaccctcagaggggagttactgacagctatttttttgggaggctctgcttgaatttagataagaattttttttcttgttgctgcagttagttcagatgttttcagtttaaagtaacatttacaccagtctggtagattattggtcccttcagaagcgatagtatacccttgtctaagtcactgttctattcctacaactagactcaaaagaattgtcttaccttagaaagattcatcactttgtgtaacactcactttgtgtaccaccagttaagttcagcagaagacttaggtgtagaaaggtatttcagatttcttggcaaaccgttcacatagctggtaacaaagtgcatcatgaattgtgaatcactttcacatttttgtgctgataagaggacctctcatggtatagcccagagtaaactaacatgcatgacgtgatttattctaaccaacccgatgaaatgcagatgtgaatggaagctctaggcaaaatattacatggtgtatttcactgaagaggagaaaaatgtattgactagcaaaattttaaatatctgaaacccaaggtggtggtaaggactagaaaaattattttgattgcagaaaaatgtttttttctccatttctttttaaagaaaaattcagcatcaaaagcagatatcgcaggaatcagtcctaatgattatattctcctattgttataacaactgaaatgagaacacaacctaaatgaatttttctgttgagtttgtaaaaagaagtacatgttacattaaattcactcatccatgcatggatctttagaaagaaatagtttgaaaaaatttcaagtcttttagagaatgtgactaatctggtctgggtatttctggtcagggtgcatcttctctgctacagacaattcttgtgtctactcaaaatccatgtgttgaaacctattcctcaatttgatagtattaggaggtgggactttcgggaaatgattataagagtgaggctctcatgaagggaattagtgcccttagaaaggagggcccagagagattctctgtgccatcagccatatgaggactctgagaagacggcctgtaggaaccagaaagcaggccctctccagacaccaaatctgcctgcacattgatcttggatttgctagcctctcaaattgtgaaaaataaatttctagggttcataagtgtctcagtctgtttatgttgctataaaggtatgcctgaggctgagtaatttataaataaaaaaatttgatttggctcatagttctgaaggctgtacaagaagcatgatgccaacatttgcctctgataagggcatcagtctgcttccacttatggcagaaggcaatggggaaccagtgtagaggtcacatggccagagaggaagtgagagtgagagagagaaagagacagagagagagatacagagagatacagagagagaaagagaggagggaggtgccaggctctttttaactactagttctttcaggaattaatagtgagaactctcacagcacccccccgacactcacagtcccctggaattaatctgtgcatgaagggaccacctccattaggccccacttcaaacactggggatcagatttcaacaggaaatttgaagaggataaacattcaaattgtagcaatacattgcactgtaagttgtattgtgttatgacagctcaaacagatttagacactcactttgaaaccctttgcctgaaccttttgtgtcataatcctgctgctactgttgatgttgtacacataccactcattggaactgcaagaccaccaggttaccgtatgatcatatttttatgtgaatatatatattaaaaacctttaagccagagatatgcacataactcttattgaaattatgattaagcaaagtgaaaaggtgatagtcctaagtatcctttttctaaggaaatgattagagtattgctttacagctgttgactttgcaagtgtccttggagtacggcattccttccactctccccttcccaacccccgacccagtagttaatggtgggcttctagtacacacgctgagaatcatctcccactttggaaatgatgataactcagaatggatcataaccggactcgcgatagttttcatagacaggtaataaaaagaagacattcaacatgaaaaattaaaggtgttacgaagatgccaagagatatattcttcattttattgtagaattatcagaaggagatgaagagttccaacctttaagagcaggcaacagtaattttccgtggttctgtgggacaccttatgcttagcaatgaaagtgtgtaataaactctctggatgaaatattaccgctagcttccagaactttattctgtttatcctctccatgggattctgctataatgttaactcttagaatgctaagatttgccaatgtctgacacttccagttcatcagttgtggttctttatgtgaatatttgactagagagcttcagaatgttataacattctttaatggaaagggaaaattagttttcggatgtgagtttcgttttatggaaaactaaattttcttccatctaagaattttaacttatgaaattataggagacaagaagtatgttttttataaatagtggagtgtttctagtgtcatctgccttgtctgaattttcacatcaagtaaacattttcttagagcatttatgaatcatgaaacagtgtttgtctattaaacagattctggtcataagtttttcaagggcttaatttataattctctccagcaccttgattctttatgctttgtctgtattaaatttccatcatctttttccttttttcttattgaaattatttgggggtcaaatacattcatttttttgttattttaataaagaaaaccgaagctatgcatccaagagcacataagaaatttattattcatgaatatacatttatatgtgcaaatgtatgtataatagacttaatacgtgcttgtatcattgaaaaactttgttactaacaggctttgggaatcatgtctgtgacatgaagttgaaacaagacaaaaaaacttgagcaccaaatttgctcattggtggtttagcaactgtgtagaatttcaaggattatgtcctcattagctgatactgctctagatgtactatatttaatgttatacttttctgaatatactaatgttcaaaaaagaatacaattaaaatattagttaatatgcccacttcaggtgcaaacacattttacatgtgtctccgcacaattccttgtttatgtgtgcattttaatggtttatttagatcttatgttctgtatcttttgtgatattctcagtacatttagctacttaaatttgaaatgtgaaaattattctttccttcctaaattgatctctaatatgatagaaaatttttagtgcttactataaacgtcaaagttgggtatttatcttttatttgacaaaattcatatatatgaatacatgcatagtataacctttagtcagtgaacacccataaagtcaccttacttgagttaattaattcgaaaattatgcattcactacttacgggggtgttaaaattttatcttgcggtggggttgcaaactctcactgcaaatcccttaaacattggcaaattacagtttcacatataagagatagaactagtatcctgttcattcaagaaaagccagttagagcaatgttgtctaaggtggcctcttgatcgtggccaaagctgtcctgggactagagtgaagcaggtgaagtgcccggggtgtgcttcacactcttcagtctcccaagtgcccatcctgttcttgaacaaccctgaaagttgttcaagtgaggtgccttgggggcaaaatttaatgaagtcctcactctcaggatcatgcatctgtcccctgaattttgtacttgctacacaattgtctaggtcctggactgtagcaggtttcacaaaaatgtgtacagggtgcccctcctgtgtcactgagctgcagccagaggcagtgtatgcatgcagaaatgaatgacagtctcttggaaaccaagcgataatcttgtataatgttgagtgatgctagcaggtatgtggatgtaggccataactgagcacttctgaggcaagttgcatacttacctgaaagtgcggacccttttttggtagctgcatttttgtaattattggatcccatagaaccatgctcacttgtgagaaataaggggataatttgtgctcccaattaaagttttttggactcttgatgttgattccctgcaagaggatactggaacttgcattggagaggctgagttagggttttatggatagacttaagccaaaggcaatatgaaattgtccaaatggtgtagggttctctttgtcccaagagttatattcttgcaaggagttattcactggcctatgtgtgaatgaaaatatggccatctatagttaatgtattgggctttagtgttaggagacagtgatatttgaaaagtcatccacacatagtgaaaccattaataatcaagatctaatgaataaactcagccatctgcagagcctcctaaaacactgtgtttaaatacattgtagatgcaacaagagtgatgcaagtcagatttagaagaccaggctgttttccagaaagctgtaatgctctgaaatgtattgtaatgtttctgaaataatggttggattgttataacaaaagtgtgatggtttgaaaaaggcacaaaaaggggaacgaaaatttaaaattgctagtgcatatccaggaactggtatgggttgtggttcttgatctagataagtgctttgctctccttagatagttctagcctttgtatatcaaaggtaatagtcatactacattgcttgaaacggaattcacattttgatacatctcaccttacattggagtctccttagtagcgtaaatgaacctgatcatctctcagtatattgatgaatacaattcctgtacatgctaaaatgagggctccgattttgacttggtgttgaagtcccttcttagttgccactctctctcattctttttctggtgctgcagctttttgctgcctccttcttccctgggcttgtggcagcaggtcgagtgtattgggttatccagtgggctgattccaatttagatcctgtggaagactgtgctttagaggagggatcagcaaaccacggccacatgccaggtctggcccactgccattttttggtatgactcgtgagctaagaatggtttttccggttttaaataactgaataaaactttaaagaagaataatattgtaggacacatgaaaacttgatgaaaggcaagtgtcagtgtccacaaagttttatcagaacacagccacactcacttattttttgtactaccacagtggaggtgagcagagacagagttgataacaagagaccgcattacccacaaatcgtaaaatatttactctctagacttttacagatctctgccctagatagtccagggaaatgagctgaaagtttccataaaagctctgacgtctttgcagttgtcgtatagttcggtcttcaaggggtggaaagttgtgttgtggaagtgcatcctggaaaaagagcggatatgagaaggaaagcaaagggaatgaaggtggtgatattatttttttctggtttatattgacaatcttgaaactgaatcaagaatcaaacttctaaattcagattcatttaacaattcttaaaaatgctttatgttccagggatcaaggttggtgatttatgagaaaacaagaacactagcccattcacaaaagtcatctcaaaacataattatgcacttttctgaatgattgcttaactgtttcaattagtatgtctcctctacaagtagtgctctttatagggtaaatttaaaatctctacattcaaagtctttatcctctttctatgtttcttctctcttctccgttctcctgcctcccttctccctttacatctctatctacactaggtgtgaaacactggacaagttacttaagttctcatttactctcattataaatgagaacttacatactagggccttacttacatacaagggctattttagaaacgttaaataagaggatctgtagtactcagcatacacataagtaacacaggcaaattttgattcttataatgtgagttttcttatgaaactaagaagaaagtgattcagaagtgctacattaataagaaaaaatagaagttcaaaatacatttactgttctatagctacataacactttattcttgtgaaagtttaagaatgacctgctaagtatttcagttatcaaacctaatatatgctgggccatttgggtcatgatttttatccgggaccaggcatgtgttaccgttaaacactttcattcatcatttactagctaacagctaaacaaaactagttgtgtaatgcgaaatcactaaattgctgcagtagtcacttgtaatgaataacagaatattacactgccaataattacaggtgattaatattttctggtcagtttccattccaggatttgagttatgtggataactggaacattccaccttttatgagtgacaaaatcttaatccacatcaagagttctgtattgtcctgtgaatatctaaagctaaagaaagaatttagagactgtaaactacattgaaggagattttaaaaagggggagaaagggaaagagaaggaaggagggagagagtgaagatgtgagagagtaaaggcaggggaaaggagggagggagcaagaaaagaaaaaggaaaagcattattaaaaagtgtccggtttaggcatagtcaattcttatatcaggaagaggatattaaacggaaaagagatgcataaatcaatatcgtctctattttgagggctattaaaataatccttaagtttctttccatttctgactttgatgctaagattgctctccaaatattatatttttcattatattctatgccatttatagtttgtaggagagaaggaaataaatgatgaggtcccatactaaagctgaaaatttttaatctctcagacaacagataatcatgtcaccgtgcataaaacataaccatcagtagtaaatgtataaaactgagttgcttaaagtcatagaataattgcttctaccaactttgtaagaaagagtatactatttttgcataaaatgtaaattaaagttgaaatattatctgtgttgaatggaagtatacaattctttctcggtacagggaatcagtagagccttacaggaggatcttccatgttgcttttagtttgggtgaaaactgttatcactggatttgcattaaatgaagttccttcctcttaagataggatgattggcagggattaaggctttattactacaagatttctaagccaagcttctctttttcatgaataatacctacccccttatttattcatggtatttttgacagctgacagttcaggaagtatatgtgcttctgtattaactattaaagctctctgtttacatatgggtggagatggctggtacatttccacttactccaccaggtatgttaaaatcataagtgaggaaaaaattatataataaaataaattttataataaaataattaaaattattataaaataattaaaatataatattttaaaattattataaaagttataaaattattataaaaattattataaaattattattaaaattatataaaatattatattttaaaattattatataataaaataattaaaatattacaataaaataaagcaagacatgtggaagtattagagggaaatatccagagattatcaagccatatttagttgcaccttttctcgtggtattccatttcagtgattttaaaaaatatatcaatgatgagtcaactagatacaaatgttattacttctggaattcactttggccttgttgaactgaaatagttctatgtaaatgtatatctgtctgtctatctaatttgcttagttttacttctataatacaagatttgacctttatttttccatttattaatatcatatttccatggtaggtcttcctagagtataaagaaatcaagtttctcaaaaataatagtgttaatatcaaaattgcgagtgagtacaaagagcatcatgccaagtgaatggcttatctccagaaaagctgcgtcctggtgaaaaggggaactgagcaaaatgcacattttgattgtgtgtatcagataaattatagctgccagcaatcctctctatagggagaaaattcacaggatgggtttatccaaaggaaggaaaaagggtcatctcccctaccttgctcttgtctgagcctgcagttgctgttttcattcactcccacaggggtgattatagagcagcctcaacaccaaagcaggcaaaaaaaaaaaaaaaaaatgttggcggggcgcgatggctcgtgcctgtaatcctagcactttgggagggagaggcggggaggatcacctgaggtcaggagttcaagaccagcctggacatggtgaaaccccatcactactaaaaataaaaaaattggccaggtgtggtggcgggtgcctgtaatcccagctactggggatgctgaggcaggagaattgctggaacctgggaggcggagcttgcagtgagctgagatcgcaccactgcactccagcccaggccgacaacagcgagactccatcaaaaaaaaaaaaaaaaaaaaaaaaaaaaaaaaaagctggactaaagaaaaaaacaaactacaacctgaatacagtctttaaaattattaggccagtcttagtttttttggtgttttcaacaaaaatatcctgaaccattaaatctgggtttgagtcaagaatgaaataataagttgaagtgactagactaagttcagtgaaggaaaggaattgagagatttttcttaggaaatagataactgttgacaagtaaatagttattaaaaatatatgtcactgcagtgtcagccacttatttatttttaattaaggatctgttgacctttttggccttaaataattgtgttaaatagaaaatattgccatttaaacttctgtgtagattactgttaactataatttaggaatatgcttccttaaagtttttgtaagtttattttctggatcatttctcaatgacttgattcttaatttggtctaagtgctattttctgatgcttttatagagtttaccatgttggtttaaaatatactttgctgccagtttactaagagagtagctgagatgtactgactgaattactcttagttgcttgtatcctaattatagaattctttactaatccaaaagtaattcagcaaaaatacttgactcagtaaattcttattttaatccttgtattttactataaaaagatattttaaaatatttctttgagacagacttttctttcagtacaataagatatatgaatggtgctgggcatgctggctcatacctgtaatcccggcgctttggaaggctgaagtgagaggattgcttgaggccaggagtttgaggtcagcctgggcaacatagcaagaccctgtctctacaaaaagtttttgaaaaatgagccaggtatggttgcaactgcctgtagccctagcaattcaggaagccaaggtgggaggatcatttgaggccaggagttcaaggttccagtgagctatgattgtgctactgtaccccagcctgggaaacagagcaagaccttgtctctaacaaagatatatgaatggaattaaaatgttttcttggagcctcttgtcattgatttagaaagtctatttaacctctgttcggttcccaatgacaatagaatgtctttcttttctcatttattttttctgtcgtatcatgcagctctcacagaaataaagacagaacattaaacaggtgtaccttttaaattctaagattgtaattttattattgaatagaacttcacttttagtgctttccaaatgatggtgcctatttgatttcctttaaattcttctctttacacatgacgatttcacttgtgttgactagtaatctttggtttaacccttccgcactttttgttaagtctaaagtttaaccctttagactttctttactatgaaactatctaaactagaaacatactagggttcaagttaagataatgaagagtcatctggtattaatgggaaacaggagtatgtaaaacccgaggttctcaactgttttcttcctttcattctaggacaaacattgatgtgtgagatatccccatgcatttgagaacctttgcatagactgtactgcagccctacccctttcccacaactgttcactgctcacactttctcacccttcagcacacacatagaaaaaatagtactgaagtgctcagtagtagttaagagtgaaattaccgatgatttcagtactgcattttagccagaaaagtctaaggtaggcctaggaagccaattcagaccaagagatccctttctcaagtaggtcatgtttgtgccttgagtttctatggctctttggcatccattgtgagcgagatggacacagtccaggaaatatccctaaggaatagctactggtagcagatcccattatcaatacagttgtactataaaaggcaaaggcaaatgaacattacaataggcatttaactttcttttttttttttttttttttgacagagtctcattctgtcacccaggctggagtgcaccagtacaatctctgctcactgcaacctccgcctcccaggttcaagcgattctcctgcctcagcctcctgagtagcaggtattacaggcctgcaccagtacacctggctaattttttttgtatttttagtagagacagggtttcaccatgttagacaatctggtctcgaactcctgacctcaagtgatccacccacctcagcctcccaaagtgctgtgattacagacgtgagccaccgcacccagcttaactttcattttttaaaaatttatgtcaacaagctaaaattcctcttgattttgcattacagttaaaatatcacaaggtatcattgaagaagtttaggtgctcagttcctaaaggcccttataaagtcactttcctagaagccgttcccttttctccctaggttggttgcatatccttcttgtatatgcttagaaagtccagcatttaacatgcctagatcttgctgaatgttaattacctgcatattttaagcatcttttacccctgcatcctccattagaccgcaagtccattgacagtatgtactcaacactagcagagggctgggctcaagttctgaaacatgtgtgactttggatatcataatatccaatgaccacccacttgccatttctaccctttctattattcaattggtataattctgactagcagaagtattttaattcaaataccatcattttctgaaaataatcatgctacatctatgacaaagtgtcacctaaaattatttcctcattctcattaagtagaaattcctaggccaggtttatttatttgtaaatctcataagtttggatttaacagttcttgtttattaaaatcaattatgtggtgatttgtgagtttgaccaaaagctgatttccctactttattttagaaatttatatcttcagtctatactgtttttatatttggatataaaataaatttacattattcaaaaacataaaattcaaaagtataaaggaataaaattcaaaattcaaatataaatgaataagcaataaaaattatcttgttcccctagcccatccattgctctttccaatggcaactgatgttgtagtttcttggttattcctcctaaaatattttgtgaaatacaccaacaaattcatatactgtgtaaaaggtacattagtttattccctttgaaaaacaaatattgatatactatacaattttttgtccttgaaatttttatataacatattacagtgatcttaatccatacaagagaacatcctcattcactttataactagataagcattctattacatcttgtatacaagttgagttttgttcgttgtgtttcatttatgggatacaaatccagcaggaatttacacacaagtcaataatgtccccaagaccatatgaaagatatgagacctcgatccttggcaggactgactgtccattgtaccatgttgttaaagtgactgaaggttattgacttactgcaataggagttagatatctgatttagttgagtatatccatttcaaaaggaaaacccaggacttttggtgtttaatcattttgtgaaccttaccttaaccctttcccattagattggacataaacaatgcttaatatcagtgactaatggtattagttcttcagcctggcggccaaacagagcagttcagaactaatcagcaagatacaatcagatagatgccagaggtgagggataatttttattttctctgttctgactctctggagtttcctctttgcagtaatttaggtcatgtctatatttactggatgaaagatttatctgttgaattctttaaatggtggcaccaactaaatctagttctttgcaacagactttagaaagattaatatgttctatgctttctaaaaaaggtagtatagataagacttgtccctttttatttgaagttagaatgaaagtaacatttttgaaaattaccattgtcttattgaaactcaataggtaagtatcgttctccctaacttgaaggttcagctaatattttgttgagaacttgcactttgccaggtactattttaagagccctacctgtattaactctttgagttcctataaggtaggtgatgatgttatccccattttatagaatgggggaactgagaagcagagaacttaaggacttgctcaagaaaacagcagaactaagatattgtaaagccagaattagaagcaaataaataacaacaaacaggacatttggctccagtgtcattactttctatggctaaatttatgcgacttctcagaggaaactctagttccagaagctcaaagtcatgtacctgcaaagtggtaaagccaggatttgaacccaaatctgacatcaaactctgtagttttattcactgtataaatagagagatatgattaaatatatgtattgatatataaatataggtaaatatatttgaaataggctatgtgattttgaagtgggtgaattttctcttgtgccgtctctgaaccggtgttagatttcttgaactgttttatgattccatgctatggttaactatgcaattacttctgcatagatgcccgaaaaaatctttacttaagatccattcaattcgtgtttcttcggtaaagtcttccctggccatgctttccccaacccggcatgcgtaacaagtcaagattatcagtcactccttgatgtcacttctgtgtcttcttttttttttttttggagatggagtttcgctcttgttgcccaggctggagtgcaatggcgtgatctcggctcgctgcaacctctgcctcccaggttcaagcgattctcctgtctcagcctctcgagtagctgggattacaggcacatgccaccacgcccagctaagttttgtatttttagtagagacgggttttcaccatgttggtcaggtttgtctcgaactcctgacctagtgatccacctgcctcggcctccccaagtgctgggattacaggcgtgagccacaacgcccagcaacttctgtatctttttacataacttagttaaggtacttaccaatacatgcatgccttttgttaatctgcaatacctttatataaaatatggtgacttaattttgtatccaaagtatgttacatgctatctgactcctggtatgcactcaattaaaaaatgtaggaagtctctgtgaatgtattctggttcgagggttgcctgattaaaaaaaaaaattaaaagtcaatgactctgacaccatcctacatttgtctaacttaatacgtcagtagctgtaatgaattagagctctataacttgaagaaatgtgatattgtttgataaagtaaatatagaataaaatctttgtacgtcgtttgttcagatgaacattttaaaaataataaatgacgtttatcctttgtccccatgtgtgaatcaagtctgtgatatctctaaactctggtactctgaaatatctcttcctgacctgctacttcacttcaatacactccttcactcccgcagagcttgctcttagcttcagcaggatctcttcctgttccatccagatgccctttcctagccttggtgctcccactcatcttctaaatgacagccagctcagactccattcacctttctagttcccccgagagagtctcaatcccatgtcaactcagttgttagctttcaccctgcacctctcagctcactgcatacaggcggagcatctgtctttttatccccagggagaagcaaaggtatttggattgccctaaaacactcagggaggacttaacggatagtcacttctaaagcactctttctgttccaaccctttcactgtgtgcctctgtgcagtagagaagtgagtctactaatattaatgtgtgaaacaaggaacacttatcaaagtagctgccatcagtgagccacctgaagtggaattttatttgtcttgtactcagcaccaaagcagaatatcttgctttttttggaagaaatcaaaataacacagattttactttggaagatgaaacacactagcatgtctcatctgttccttcttgatgatctgtcctcctggaagtatgacagtgttgacgtagatgtactgagttcatggaacacaagcctattatcgttcctctctgtcatatggaaagaggagaactgagagattgagaaaaaagttaaaacacagaggacccaagtgtaacgtcatgttaaaacatttttgaaattatgcaaagagaaataactatcaaaggagaagaatgaaaatcaatgagtaacaattaaaagacgggattttttttagaattcaaaaattaatagaattggtagtgctttattttcttatacaacatttatttagtgatatctaaacgttctttggctaaagtgcaccttctttttttctccctcttccctccctccctctctccctccttccctccctccctccttccctcccttccttccttccttccctccttccttccatcatcacaggtgtgagtgttacagagattatctcaatggttaatctgtataaagatgaatatttcctttatttctctccgctgattagcgctgtctcaaatggcaaatgttttaaaccctgatcttttgatgcacttcctgcagcctcaccccacccccaaactcaaagagagtaaaatcacagtgttcctttctctttctccccgtgaaactggcaaatccccaccactacccttgctaccccacccatcaccattcatttctaaagcagacatttagaataatcaggacagcattttggcagggcgcagtggctcacgcctgtaatcccagcactttgggaggcctaggcggggggatcacgaggtcaggagatcaagaccatcctggctaacacggtgaaaccccgtctctactaaaaatacaaaaaattagctggacgtggtggcacctgcctgttgtcccagctactccggaggctgaggcaggagaattgcttgaacccgggaggcggaggttgcaatgagccgagatcacgccactgcaccccagcctgggtgacagagggagactccatctaaaacaaacaaacaaacaaacaaagacaggattcttacacttcctgtttccatagaatctatagaaggtctaaagtacctaggatgccgtattagtccacaaagccatgatcagatttccagtctcttgagcctagcttagatcttcagaggcacaatgcaagacggtttttaacagagaaaatgtgcatgaaggaccttttaaattatagcttctaaactttcagcatcccttcaatgatttcatactctgactatttttgcatcttcctgacatttgcagttcccttgaggcatatattacagtacacacactacccatggttagataatcacaagtttagatatttgtgaatgtttcagctgtgaagaagaaaaatgacttcaggcaagggtacttgtgaacatcatcattgaaaatctcagaaaattccatttgcatatatccacatatgtgagcacttggttgattctcctcctttacttttgctactattttgttttgctttaggtcttcctttcttttcatttatttttaaaccagagtacatttatcctggacattttctgatgtttatggggggtgaggggctatgtgaaacttgatgccaattgacatgaaatctatttttctgaagagaaatttgaggtatctaggagaatgcattttcaatcccttctcaccattaacgtgtattaaatgcccaagctaagtttgtccttgatgtttgcagagaacctaaaatctctggagaaatcagatattttagggtcataccaacaaaggaacacatgaaaatgaaggttactcagaaacaagctttttaaagctgaggcataaatggcagagctgcccattgagtaaaatgttctgcaccgtaagagtgaaccggaaatggatagaaaaataaattaacatttaaaattatactttgtgtttaagaattgagaaaatttgataggccctgtaaaaaacaccattagaatgagaacattctaaattacatcgttgaaatagtagaaaacacatgtccttttttttttttttttaaaaagtctttttttaggtgttttaagtaattctctttttctttttcttcttcttttttgtaatttcaatagcttttggggtacaagttgtttttggttaaatggttgaattgtgtagcggcgaatcctgagattttagagcacctgtcatctgagtagtgtacgttgaacccagtatgtagtttttctccttcacccccttcccaacctctttcttctgagtctccaaaatccattttaccactccactctgtctgcctttgcatccccatagcttacctcccacttacaagtgagaacatacagtgtttggtttttcatttctgagttacttcacttcaaagaatggcttccgcctccatccatttgctgcaaaagacgctactttgttctttcttatggctgagtagtattccatggtgcatatataccacattttctttatccactcattagtcaataggcatttaggttgcttccatatctttggatttgtaaattgtgctgcaataaacatatgtgtgcaggtgtcaaaaaagatctatttgtaatgtttcattcctagttgccaacatgccaacaaaatacttttttttaatgacagagaacttaaaattgatgttgaatttctgtttttcttttgttactttttacaagtatctgcaagtttcttgctgctaggaagcataaaatagaaactatttgcatatgcatttaaaataacttctgacttatatcttattttcattaataaacttcagctacttcactggaaataattttattaccaccttgtatatagttgataagaaatgagactctagaacctcattagcatgtttccttagacacataatttaacctcaattttctcatctgtaaaatgaaaataataattgtgctttaactcaaaagccaaagtttagacacatactgcactgtaataggcatgatgttcaataatgaaatagctattattattattttgctatagagaaagatatataagtaacattaaaatttggaaacaagttttccatattttcctattaattaaaatatttatttttctcttttattgttttatatattttatgcttttatggtcattgcaggaatggaagtttaaggctcaaacttgcaataagtagagccagttttaattatttatgctgctgatactcaaagtttagttgaaattttaactagtttttggtttgtttaaactaattcaaagtttagttgaaatttaactattttttggtttgtttaagtccctaaaggtagatatattgattttaacctaaaagctgttaacttaggattctacactttgccatggaggaaaagaggttgactaagtgcctcctttgagaaacttaagatttaattaacatttttcctttccctctgcttcatccatacttcctttcaacaaaagagatttttcatcctttatgtactttctaatattccatagaggtttatcactttagttttcataaacttgcaaagatgatctcaaataaacggcttcaaaaataggacattaactgtatgtgtttaaggagggaagagattgtagttagaatacttaactaaatgagttctatcaaacattggagaagtactttagaaagagtttactaattgacaaatgtaaaatatgccgccctgaaaattttcagatgtagtatggtgtaaaatatgttcacaaataaacctaaaaagcatggtgagttttttcatatatactctttaaacatttggtcatgacaaatctatgtgatgtttgggtggagactagtgctcaattatttcccagaatgctaaaatctaaatgtatgccaaccgaaagtctttaaatcagatgtttattacttaaaactgaaataggttaacctttcctagatgctctgattaagcttagtcctcaatgactgatgtacactggcttacactaaagttattaacctaagaatcttcccagcaagtccatctctttcttgatattatgatctgtgaagtttgaacaaatgttgtttttcttcaatgttatttatctttaaaaaaagtccaggagtagaaagtattcctgatactcgataaaccagtcctctctgaacaaggaaataaatacctctctccaacttttagaaacaattgaatgacagccttctagtctcctattactgagaagattatgtgtggctttaagacacaaattgtaccttattagtctatatggccctctacccagtactttgcctgaaatataagtgatactcaatgaacgtcattttaacaaataagataataaattaatgagcagatatagacctttttaaaactcatatgacattttgcctgctccttatagagtcacaaagtatatataaataagatgtaattagaatttgtgttaatgagaatttaaaatattgtgatatagaaaatggctgtagactttatttacagacaagatactataaatttcccttcccccattgttacctctaaaaatttccatgatttcaaagctgttgagttcattgaactgttaattcttcctcggaggcagtgcaatctctgcaaaacaaaaacactctggctctgtggtttacaataaacttcaaatatgaagggttttttgtttgtttgttttgtttttgtttctgtttttgttttagacggagtctctctgttgcccaggctggagtgcagtggcatgatcttggctcactgcaacctccgcctccggagttcaaataattgtcctgcctcagcctcctgagtagctgggattactggtgcgcacaaccacacctggctaattgtttatatttttggtagagaggaggtttcattatgttggccaggctggtctcaaactcctgacttcttgatccgcccacctcggcttcccaaagtgctgggattacaggcgtgagccaccgcacctggcccaaatatggagtttatttgcttgttttaaaatatttattagagaataatgtgagtaattttagtcagtaatgtgcagttattttaaaattcaaaattattatcatttaaaatcttttcaatatcccattgtaatggtacccaagcgacatttttgtgtggtagtgtatagatctagaacatttatctgaagataaataactttgaaacagagtttaacaatgattcaaagcttgggaaaagcctaaacattcatcctgatatatccgaggaagtccttcctctagaaatcttttacacctattcctatggaaaacttagcttgaattatacaagtttttcattctgtgaggtctttgggatgaattcctcaagtgaaatgagacacctccattgataaccctctcagttacatgaagttcctgccgcacagtaagacattgtatgttttcctgccttaagtaaagacactttgttgcagaatttaggtaacttactcaaaaccctcagacacgtgagtgacagagcctagaacacagttatcctaacactcgatccaggaatgtttctatcacatcacttctaatcctaaatctaaaagtgaaatctaacaatagcaaccaccacaagaaagagaaataaaaacatgaaatattgtcatgtaagtcaatttgtaatgatatttatgttttactattctaataataactaatgcatattgagtatttcctaatgaaggtaaaatgcaggtaatatgcttaacagtacatccactgcgtactgtgctaagtattttacctgcattttattactttatctttatgggaaccatcagaagtgcatattaatattatctcattttacaagtgataaaaataggactttaaaaagttcaataactttcctagctattagatgtcctgactagatctgacttcagagcttgttcttataacccatctatgattccaatttacagtatcttcaggactaaagtaaattgttaatgtttaacactttaaaaaaagataccagtggaacacttgattttctaaagcacacagagaattttcttttagcacgttaggtatagaatgtaatacatttaactgtaattcagactgtgaaaattaaattatagaaaccttgtagcagcatttctttgagtgttacatcaggtacatttcagttaatatttgaggattacaagatattttattaaaatatgtttttctaactgttaaaactcagagttaattattttttcagccaggtaatttttttttttttttttgaaatagagcctcgctccgtcacccaggctgaagtgcaatggtgtgatcttgtctcactgcaacctctgcctcccaggttaaagtgattctcgtgcctcggcctccggagtagctgggattacaggcgcccaccaccacactaggctaatttttgtatttttggtagagacaaggtttcaccaggttggccaggctggtctctaacttctgacctcagatgacccacctgccttggcctcccaaagtgctgggattataggcatgaaccactgcgcccagccgataatttttttataaattagttctgcttgatcaaacaggaaaagcttgaaggtcagagtttgaagtatttctgacttatttatgaaaatgagagaaaaagaatgctcttgtcttgatgaaagccttattaagccgctcacattcccaaatttgggatgttagagtgaaatcttcagcctcggccccattcatgaaaaatcttggaagcaagtagtgatttctcaaactgtgatgccacccatttttacaccaaatatcagtgtttctgggactatcatgcccctggtgggtgtgtgatttagaatgctaatgagcgttggcagaccaccgtagctcctgctgtaatcctcacactttgggaagctgaggcaggaggattgcctcaggccaggagttcaagaacaacctggccaacatagggaaaccccgtctctcaaaaaaaaaaaaaaaatgaaaaaaagaaagaaagagaagaaaaaaagaacatctaatgaaatcctaggagaaacctaggtcgaatcaagcaccatgttgggtccagttggtcttaggtcgcttgacctacaccctggattttcagggtcttatcagtccctagcttctgcagctatttgaagtttccttttgatagtcatgtgaaactgctgcctgaaattttctgatctcctgcgatcaccctgtattatttctgtctcaaaaggaaaataaagcttgagaccccaattcactctaccaaaagaaaaaaaaaaaagctgaaagctgagtcgtacaagaatccgcctttccttttgttcctaagcagatagctacaggcagaaggttaaatatccccacaggtagctactctatgttcatcttatcttatgtaaagtgtcagtttactgagctccagaaaaatacataattgactattgccctagctgctccttttgttctgcaccttgtagattcagtaatgtggccataccattcttcattcacctccatcctgcttttccccttcaaatatcgaagccgtctaaatcatccttagagaaaggctcagacttctcttttaggcattgtccttaaccttggcaaaataaacttccaaattgatcaagaaaaaagaaaaaaaaatgagtttcgcttgtcccaccatttacccctgccgagtggtcagatatttgtagcaaatttagttatactctcttaatatctataagcaatccaaactccattctcatagattcacacatacacacacacacacacacacacacacacacaagcagtttttttgtaaaggtactattttgttaaaatgtgaaaggatgcagggttatcttttcaatgtatattcaacaaatgaaaagatttttggcaccaggcatggtggctcacacctatagtcccaattactcaggaggctggggctggacaatcacttaagcccaaggagatggaagctacagtaagccctagtcatatcattgcattctagcctaggcaacagagtgaaaccttgtctctaaaaacaaacaaacaaacaaatgaaaaactatgttgggatcttcccttttgttcttctcgctccttctcttctttccccacctctttatttctctactttcttcttttttaaagtttgtttttggcatttctcaaattattttaaaaattaaaggcatccttattgtaattttctaatgtttttaatttttattctgtgttgtatatatttaaggtgatacaacatgatatttttatgacttctctcacaattaatatcaagttccagtttgtggtgtgaaggaatgatgtgtttcaagtattttatcatggatcttcaatttgtggccttttactaccatagtaaattgactgtaaattagaaaggaaccttaatacaccaataaaatctataaaaaatttgtctgaaagagccatgtctctaaagacaatttttaaatagagacaagatgtagcattttaatacatagaatgtaaagtaaattcagagtttacgtcagaggggtttttctgatttatttatttatctattttgttgttgttgttgagacagagtttcactcttgttgcccaggctggagtgcaatagcacaatcttggctcacctcaaccttcacttactgggttcaagcgattctcctgcctcagcctcccgagtagctgggattacagccgcccgccaccatgcctggttaattttgtgtttttagtagagacagggttttaccatgttggtcatgctggtcttgaactccggacctcaggtgatccaaccaccttggcctcccaaagtgctgggattacacgtgtgagccaccacgccaggccttatttatttttttaacccactttcttcctccatagatgtatggtgatgatagagtgcccacttgctgactgtgcctatgtgtatttaaataatttaaaatttaaaaaaaaatccagttcctcatttgtactagccacattttaactgttcagtagccccatgcgggcttgtggctactttattaggcaccacagacataaaagatttccatgatcatgcagtgttctattggacagtgccacacaacatactttggtatttaaccaggaaagtcagcagtattgcagaactgtgtgggttcaagccaatgttgtttaagggtcaacagtatttatattttatatttatatatttcttacatttatatttactttatcttctttcctttttttcttcttcttccctttttccttcctcccttctttccttcatgtcttttcttcatgtctttctcccttttttatttttaatttctttgtaatttctctttttgaccgagttcattaacttttttttaaaaaaaagaactatttcagcaagaccatgacattggctcacccactttgtattcatttaggagtgtgtctgttttctcacccccacctggtatggttgctaaatccagatgaggataaagagcacagatgttctcctccactgtgtggaagcctaggctacactcttgccttatacttgatcatgtcaaacgcattcactagaaagggatacaaagaagattctaagattgtgattttacctataagtgtatttaaacagcagcaacctatgtccagaagagaggaaacagattttccaaatatcagtcttgggcctgggtcattatggggaagtgggatcaatgagatgaaggtggtaagatccatgtccttaaggccagtccttccgccccttcttccaccttaaccacgcagcttagattgcaacccagattcctattttactcgacctgtaggtaacctgtaaattggttactctcctcctggaaaatctaaagttgttatatgagaaaaagttccagtcaagtactctggtgtttttcttgatgtatggcatcttacacagtttggctgtgtccccaaccaaatctcatcttgaactgtagcttccacaattcccacgtgtcatgggaggcacctagcagaaggtaattgaatcacggggatgggtctttcccatgttgctcttgtgatagtgaataagtctgatgagatctgatgggtttatagagggaagtttccctacataatctctctcgcctgccaccatataaggtatcccttgctcttctgccataactgtgaggactccccagccatatggagctatgagtccattaaacctctttcctttctaaattacccagtctctggtaagtctttattagcagcgtgataacagataataaagcaactatgatcaaaatgtaatatgaaaaaaatgaacattatatttttaaatagcatgtgtgccacttacattttaaaaacattcagtgatcgagattatccattattcctgtaaaccctgcactcattatacacagtgtctgaagtgttaatagttcttattggaatcattgccctgctgagttcccaacatcccaacaattcagcacatctcaccagtctctttctctctttcagcttgcaggtaagcgaatgaaagttttccctcccttccctatgccttctggatgtgtttcagtccctttgaatttcagacctgccttcattttagacactcttctgagtgctgaatgccacagtttgaagttcactgcatccccctcaaaaggcattaattccactcccaggttctttctctctgttggacaccaagggtctatgattttggaggagaatattttattatattaatgtatttacaatgccaagtattgtacaagtttagaaaggaagaagaagacaaaacactttcctaaaaaattgcttataacctgcagtattcaaagtcaagttttcattagaaacctttgaaatttgcattatagtataatttataaacatcaaaacaaaaagcttttttaagaaatttttttgagacagggtctcactctgtagcccaggctggagtacagtgacacaatcacggctcactgcagcctcaacctccccacctcaagctgtcgtcccaactcaacccccaagtagcttggactacaggtgcacacctgtagtccacctgtagtccagcaagggacgtcttacatggcaacaggcaagagagagcttgtgtaggggaactctcctttataaaaccatcagacatggttttatagcatggcaaagacctgcccccatgattcaattaactcccactgagtctctctcttatgacacatggaaattatgggagctacaattcaaaataagatttgggtggggacacagccaaaccgtgtaagatgccatacctcatgaaaaacaccagataatttttttgttggaattttagtagagacgaggcctcattatgttgcccaggctggtcttgaactcctgatctcacatgatcctcccagctcggcctttccaaagtgctggcattataagcatgagccaccattcctggccgaaagcattctttttttgtaaagtgatgtactttagatggtttggatcctctcttttactgtcatctattttccacatgctttctaatcccttgagacttaatatttaaaaatcctaattttagccaggccatgcataacagatctgtggaagaaactgcattgtgaaataagacctgtcaaagcaacaatatttaagggcagctttgatgtcaaattgaaggctggcattttagtttggaagtatattcatctattctttgacttcataaattatatttagactactagtggctacaataatgaaattactgtggattgtaaacatgaggtattgctactgtggtctaccatgtatccttaatcgactcagtttttaaattgctaaaattcaacctatttgactctgtcagaagagctttaatgttcttcatttgtgcaaactttgtttctgtcacccttgacaaatcctaatagggattaatttagttacgggtgacaggataagctgcaacggcaaccctgcattctgccatggatccaaactagttgtgagctctgtttttcttgctgcaggcagaaagtttgctgaatctacaatggacaccacaatgcctgactctcgtttccatctcttacttgttcttgtttaacataacctcgttcttgtgtggcccaatttaaaattatatattgtggaggtatttgcaattgcagtaataaatatgtgttctacacttttttaatcacttgccagtctgcattagccttttaattattaataaagtgaaatccattgatttcctccagttgttcgaacatgagtctgacctaatcctgcctcaggcttgaggggttctgagatgaacagcaaatccttgagctaaacattaattttgtgggatttaaacatagtactatttttttattcctaacagaagctatttctttgtcttttttcttctgaatttgcagaagtattatgaactttggtctgttccgtgttatacatacgaaacaaatcttgaacaaaacaagtttgtgatgccactaaaatttgacctttcttattattttgtgctgatattagaagttttatcattgatgctcataaaattgtaggttcagaagactgtaatcacattttaaatttaagttgagcaccagtcattactacatcatttttgtctttctgtgttaggaagagctctgttttcctggttatattttaaaccatatttaagaataaatttgcatttattgaaaattttcttaatgaaatctcattttctattttctttgtttattgatataatatcaattaacatatttttattctgtctgcctatagaaattgaataatgtatcaatttctcttctcaatgtccttttacctgcaaaggtgtggtaagcaggatgaaaggttgcttttgaacagaaatttatatttggtctgatttacctattttcttttggaaaaacacagtttagagctttagcagctggtgaacagcattaactaaaacttccggaagacaaagcatcataagtataaatggtctatctcattgtatatgctaaaatgttgtttttcaaggacagaagaaaagttacctatgataacagtaccacaaaatgactagcacagagtaagttacttatatatgtgaatgaattaactattatattttatatatagttaatagtatagtataattataatatatagtaatatataatatatttatactgaacatcaaacaatgtttaattataacaactactttgcaaagacaacttcacatagttcaggatattcatatttatataaagtttattaaagttattacattctgcacaggctgatccccaagtcatatattattagtcaacagtcattatttgctattcatatactagctgttgaatatttaactcaatcaatgtggttgtttcttacaatgaaatctggagttcttttcttacttaaaaaagattgcagaatattatatatatggtaatttattaaaatataaactagactttatcaaacttagagttaattgtaatatttacaattggaagctgagaaatggaagattacaagtgcttatttgaccaaacagtggcaacagattttgtttttatgtgtgcggcctctccttatagagtgaaccctcataactgcttctaatcccaaatctcagggaatttgtttccaacaccataacagtctttcaaaagcaacggtgattatagtaacttcaaagcggcaagcatctgtactttaagaagggccagtggaagctagcatccatcttccataaaaaagcaatcgtgcttttccctgctgccacttagaagagcttccttggggaccttgttagatgctttcatgtgaagaccatttgacccatttctgattagtgtgcaggttttcatggcagtggcttctgggagggagatgccgttggctggtcgcctccctattcttgaagtgaaaagaaaactctcagtggaatatattaaggataataaagggaagaaaaaattccagttaaaagactggtgaagtattgaactactattaaaaaaaactaatgaaaacgtatttctatactgactgttaagaagaaagcagagccagtatcacagttccttgttttgtgctcagatgagttttgcgtcttcatttctctttcttgcaatatttcagaaatatgtagtttgagaatgcaaagaataaatgactttagctcatttcacctttattttgtcagttttcttttacctgaatcatcatgtctacatttaaaataacagtaaacaagtctttataagtaacaggaaagataaccaagaatgcctgcattgttaatgctgtaataattgtcatcatagcttttttagcctcatttaccttacctatcttcactccaccaaattcactgtttcatatgatattcatatcagcaatactgttggtatcaagatatcgacaagcttctaaccgtactacattattttttaactttaatgccaattcttcactaataactattattcaatatagaattattttaagatcctgcttgcctaaataggcccagtatttctccatttctcatattaacagagtgtttacattcacagactcaaactatgaaggaaatgattccttagtagtttctcttgctatttgaattttatttgtatagatgcataacggaagagttcagagcgtaatgcagtatttgctattttctaccctccctcctccatataggattgccacagtctaatttcctattatgatagattgattttaatgtagtagattgcaaacactgtgttcaagcattcttatttttaatttctcctgcttcatccctttaaaaaccacagctgttactaggataacaaaaataatgttgaataactgcttacttttccgctttcccggaggggtgggggaacagcaggtagcatagcctcatccccaaacagatgttactttattaaaaattgagtgttttggagggagtagaaggagatttatgctttaggagagcagtgaaattagaaggagtcagaatatgatatggaccaattcagcttttaaattcaagctttgcttgtattttattgatagcattttaattgaattgtattttagatgtgtttggattaatcgaatgcccaaggtccagcctgatattaagtaattgctatcataattagtcaactcaacaagtttttctagactcttcatataaaattgcactggataagttctgtagtagatctaaatgtaatcgtgtatgatacaattcttcttttatgagagtttaactgataataacactttactaaattatttattaccagaatttttaagggaatttaatatgcgatgcatgatacattgctctttatttaaatgtatttcactatacatttgttggattacattttgcatagcgtcttgtatacttctttaaggcatgaatgagccatagctttgaaagtccttttgttttgttagagaattcagacctgcccccctttttttttaacttaattgtggaagcattctgaaatttcaactgctaggaaatcgttctgcaataacttaatctttttgatatccaaataaccaataaaattatatattttcaaatgagtttttaaaattatatccaagaaacttaaaaaaaaaaagaaaagcactagccattctcacttgcatccatccatccctgagttaaaattctgaggattattatctcacctcctatttggacctgctttctaggttactatttgtttctatatacaagattaagataaattatggtaatatgcatatttccaatgccattgaaacaaaggatttataatttgtagaaaaactagaaaaatcagtcaaaatttcaaaactaggcagtctgtaatacacttcaaataaatttatttctttctgtatttttcagttgtttctctttgaaataatcaaattattaaaagcattctaatcaccttgcaatcacaatgtagagacaaaagagtgaatacgtgaaacactgatcttcacaattattgtgaacttaagctgtcgtactcttgtagttactgtgaccatcagcaactgaggacaattatgcagaatcattaaattttagttatagtacttaattaaacacttgcaattttttgaaggtgttggtatctattaagttttttgtttctacaatgctaaatatcttctagacataatcatcatattagaccctgtcatggttagattgctgttattaaatgtctcagtcatgaaagtctgtcaactgccaatgaggatggagagttcaaatcttgcaattagtcagtcagcaaaagtacattcagttgtttttcttaatcttgtcagtgtcattttatatcattaggtaaaccaagaaaaggaaggcacttatgtgggcaatttattccgtgatactatgaacctataagtagaacaattattgtttttcatttgtgaggttaatagaaacttcatcctttgaggtccatagtaaaagcgaatgcattcagaaaactatgacacgtttagattaaatataaatatatgttaaaattttcagattacaaatacttaaaggatatttaaaggtgtcacatctgaatttcaggaaactgtgtgagtattacacatatcattagattatccagtttttccaagcaaatattcagtgttattgtagaaataagtcaagtttctggggaaaaaattgctctctcacccaaaagaaagtccgtctgttcatattcgggaactgtaggtaactaaaagtcttagtcagtgagactgatcatggcttgttcatttgttgcaccctaccaaaaaagagattctgtgaaatcaaactacatcaaaactttcacagtggaaactcctttatggtttctagaattctcattgtaaaccccttaaaccagccatacctgacagcaataatcagagatatttgtttctatagtgaagtagaaatgcatcctctagaacaatcccgtcttcatgagtcccatcataacatgtgctcttacctagaaggctctgtctctcttctggttggcagcccaggttggagatgaagccttgtaagtgtgaatgcgattagttactttcattaaaagatcctcagtaagaaacctcttgatgccctcctgtgtatttactagcatcatcacttggcaaaaatgtatatctttcttttggcaaatgtgtgtgtgtatgctatcttcctgtaaataagtgcctataaatgttcaatagtattcataaaatgttcattgcaacaaattggtgtataaattgcatttatctttttaatagttttctgaagaatttccatttacttagtgcaaactatataatttttgttttgtaaaatttctgaaatgttcttcctagctttgtactgagttctcaatttgtctgcaaaaccgtttatttactaaatattagtaattgatgctacttaaagaaaaattaggagcaacaaagaaaaagaagagacataaaaataaagataatttttaaaccactattaatcctagtacttaaatgaaatgtctttaacatttagatgtattgttttctgaacatgaggaataatataacacagagaacattataggtcttttagaatgtatgtattatattttatatatgaatgaaatacactaatattcactacaataatgagataactaggatcattttaaagccaattatatgagcttctgggtttaattgagctttagacatctaagtcttttgtaaactcttttgatgcaggaaaaccaaaagagaggatttcagggaacatgcgggagggagtgagttagtttggaatgttagcttggtggagagaagggagtgttagaactgatgaagcaggttgtgggaagccaagatgccaagctgaggagtttcttctttattttattaactttgccagtgatattgttttgttcttgaaacaatcagagagatacaatcagagagaaacagggagactgaatgtagtagaattctcattgtatattttgtgccatgtaaaattacttacatggaaaaaaatcatttcctttggtaaagggctttctcttgctcaggtttactgataacctggatttttactaggcctcttttttctttgtattttaatttattttttttagagacagtctcactctcccgccctggctggagtgtaatggcatgatcatggctcactgcaacctggatttcctgggctcaagtgatccttccatctcatcctccctagttgctgggactgcaggcatacatcacctcccccagctaatttttgtattttttttggtagagagcggggtttcaccatgttgtccaggctggtgttgaactcttgagccaaaatatccacctgcctcagcctcccaaagtgctgggactacaggcatgagctaccatgcctgaccattactagctatctttttaacttatttaaagtcaagtcttgtaaaatagcctggagttaatagaagttatttttttttccttctaaaagtgatacagtcaaggtcctgtttcagaaattagcaaaattggttattgtcttttagcagttggttccttatacaagcctttgagaattcctttgaaaagataaatcaaattgccaagtttgattttttaaaaatatattttccttctttcagttctcattagatatagatttcaagaaaatacttggggcagtaaatgattctagaaaggcacttaaaacagttaactactaaaatagcctatttacatgctttgagtgaatgataaagagaattaagtttatttttgtcacattaattcccttcatatctagagctctccagaaaagctctgcagataggatgcccaatgcacatattccttggtgacaagtagtcaggataagttttatggaagtttcctaggaatctttttttctttttacaatacttggcttagtaaatcaatatttttgtttgggtttctgtttaaatcacaattcagtacagcttcagccactgaatcaagatgtgaaatccatgtactgtggcacacatttcaaattgtgtgttttaaagcctcaatctaagcaaattctaaattcctatgttttttgaggatggaatggtaccttaatgaccataacatgtggttagaccatatatctagaagtaaattgatttaattggtcatgataaggacttatatagtacttaatggtaatagatatagagttcgtgcagtctccttagggttagaattcacatggtgcctgtgtatggatccagatctatgcataactagctagccaggaagcaagctatctctatcttttaaaaacatttacacctatctaaagtagaaacttgtattatctttggaaaactgaggccccagaaaccctaagtaacctgcctaactcacacagctctaggagtcatggtgattccactgaaacccatcagcttgacactatgatgcaggttgaaatctgcagtgcgttgccttgggctaggttaatctgcccagagaggtattttgctgtgagtggattgtataggaaaagggtttgtgtggccagacagcagagaggaaatggatgaggaggcagagaaaatgatgaagctagtaatgaaagcattgacattgattaaattccacttcttagaattgtcactgattaaccatgtagcttagcattttatttaaaaattttccttatttctggcccaggatgccatgagtccaaggatttaggctttaaaaatgatagggttagctcaaaaggaaatggataggttgtgaattatctgacttggtgaattctaatcagacaaacagagctattaaaatgtttcaataacttttagggcattttcaaaaattagtagttaatatttctgaatggtactgctttcttttctgtaggctttatcaactattgatcatgtgaaatcaaccgtggattcttctggagtcttttggggggccttttaaagtaaatcagacattggaacacatagttctaagaaggagccagtacgttcactttagacattagaaattatccaacacattcggttcgtttaagtgtataaccgtacaagtaattgttttaacatatttaatttccatatttgttttaattaagaaattgtgttcaactttttcttctgagtcacacttctttgattgtttttatgattgccttgtaatcgttcaagaatcccttttatattggttagtatggggctaattatgcattcgcgagtgagctaaatgcagatgtagttaattctcacatctactccatgaggtaggtattaagatcttcacttcagagacgaggaaaactgagatagagcctggttaagtgagttgttaaaattctatacctagtgagtggcaaagtttaattacaattcaatgtttttctactacaaaattgatcttgttaatcctattccttattctgttcgaagtcagttttaacattatgcatacaatttttgtgttcttttctacctttcctgggagggttcttgcaagaataaaaacatagggttgtgtggcatttccggattgtttccacgattcttggttatttcctccatagaagccatgaacatagaggatacaaaagcattgtagaaagaagtaaatctgtcaagaaatgtcatgcctttgtttagattacttcctcatcagtccttgcagtttattgaaaaatcctgctctgggtggattgactatgagcttacattttattttatttctgctggtcatgtactactgcagagttgtttgtatttaaaaaaaaaaaaactcaaagaggggatttcaatccttaaaaggcaagaggattttgtttatctttctagaattcatgcagtgttgaatccaagtctcttctttacagctatattttaaactttttcaaggcagggacagtgtatttttatgtgaattttcatatacgctagatgcaactcagaattttatgaaatgcttcttgaattagattttgcactgtacattttgaagactatcctacctctttaaacagggagatacagaagtaaacctattgggctggtaaaaagggtatgcacttgaaaacttggtggcctttagaaagcattgagatattggactgagcacatcaagggacatattctgtgaaatcgttacagtagccagctagtcagatatgagcagagcaggagagtaccctccccacaacacacacaccaggaatgtcaggcagccatcaggcgatggtcaggcatttgttaccggcttctttaaaataataattggttatatacccaataatgggattgctgggtcaaatggtatttatggttctagatccttgaggaatcaccacactgtcatccacaatggttgaactaatttacactcctaccaaaagtgtaaaagcattcctgtttctccacaatcctctccagcatctgtatatacccaaaggattagaaaccattctactataaagaaacatgcacacatatgtttattgcagcactattcacaatagtaaagacttgcaaccaacccaaatgcccatcaatgatagactggataaagaaaatgttgcatatatacaccatgaaatactatgcaaccatataaaaggatgagttcatgtcctttgcagggatatggatgaacctggaaaccattattctcagcaaactaacacaggaaaagaaaaccagaaatcaaacaccacatgttctcactcttaagtggggattgaataatgataacacatggacacagggaggggaacatcacacaccggggcctgtctggagtggggtctaggggagggatagcattaggagaaatacctaatgtaggtgataggttgatgggtgcaacaaaccacaatggcacgtgtatacctatgtaacaaaactgcatattctgcacgtgtgtcccagaacttaaagtataataaaaaaaattaaaaataaaataaaataataattggttgcagcccatgtcagggaaaggcaatctcccagtaaacagaaacacctgaaaccggtgatcagaaacttctgaatatctcaggagttgggtgaatgggctcaactatgtgcactaaaaggcaaaatggcagagtttaactggtatatgaccttctatggacatttgactgttaacggaagaatgcctcaagtgagcgtgtgtacaactccagtaaacacagtgcacacgctcccctcccaagtgctagcaggccactgtgcatgagggcagcccaccatagggaagaatcaggagagaagggatgcaaggcctcagaagtacgccggcacacgaaatcctgagttaaaaggtcaaaccacgcacttgatctcccaagtcgcccacttggccctcttacaagtgtactttactttctttcattcctgctctaaaggtttctaataaacttttactcctactctaaagcttccctgagactctccttctgccttatgcccctcagttgaattcctatttctgaggaggcaagaattgaggttgctacagacccgtacagatacattccaccaccaggaacagaattagtaagcaatgatagaccaaacatttttcaattaattaattagttaattataactgacaaaattatgtatttgtggtgtaccacatgttttaaaatatatatacatgtggaatggctaaaccaagctagttaacatgtgcattgtctcacatatttatcatttctttatggtgagaacacttaaaatctactttcagcgatgttcaagtgtacaatacattaactatggtcactatactgtacaacccatctattgaacttattcttctatctagctaaaattttgaaacctctgaccaacatttccccaatttctctcacaccccagcttctgttaaccaccattctactctctgcatctatgacttccactgtttagagtccatgtgtaagtgagatcacacagcatttgtctttctgagtctggcttctttcacttaacctaatggtctccagattcatccatgctgccatgaatgacaggatgcccttgttttttaaagtctgaatagttatttcagtgtgtgtgtgtgtgtgtgtgtgtgtgtgtgtgtgtgtgtgtgtatttttttttttatccattcatttattaacatttaggttgattctttatcttggttattgtgaataatgctgcaatgaacattagagtgcagatatctctttggtatagtgattttgtgattttgtttccttttaaatatatacccagtcatgggattgttggatcatatggaacatttctatgtaccaaacatttcaatggagtaataaatcaagatgaaaaaagtggagtttgaatcagaccaatggagagagttttttttttaagttggcactctgttctcaagcctgaattgcttggaataggtcacttttccaaattggcactaggctcgaaaatggttggttttcaagttggcatttgctgaaataaaacactagcaccagcatccagttaaaggtacacaaataccatagttattttttattatgaggaaagaattggggaataataattcctcataacactgaggctgcaaaaatgttatatgacagtctctatatataataactcatggattcttggtttttaaataagcatagggcatggggaaattattaaaatagagcaaagccttatggaatataatatctcatgtgtaagtttatgtacacagcccctctatataaacattaagtgtgtgtgtatttgtaggatgtaaggaggcaaaatcatctcttagttgtgtttatatgaaacagataatttcatgattacattttttcttctgtgtcacttgcagtatgtcttctaacagttgttggacaactagctcagacattttaagagcctacagatgtcattattaaacttagtaatcagtctagaaataaacacacaaataacaaaggatcataaaggtcagcagtatggcaaggcataaacatggaattctagaacttgtttttattatgaaaagatgtattttgcagttcaaagcatgtcattctttgcatatgttcaactgaaatatgaaagaaggaaaattccctccaaatgactaaggtaacgttttacaggggacatatggatattcttagaatttaatgggggataggggaacttacctggaatcaattataggaaatttggcaaaatggaagtaaaatattcatttgctttgcttgttataattacgtttgttataagctttttaaaaatccaaaagaataaaatgaaagtaatttcaatcaatgggaattaattgtgttcaaataatagcatgacaaaagagacattggaactgattttgaataatagatttcaatatgtgctgagtaaagctctagggctgatgtcttctcttgtctgaaattttctaatactctccccaactgatgttgtttctcccatgtcttgtgttccttgaacatgcacttccctgaaagcaaaaatcacagaattgtttgtttacctacctatcccacgagactatgagtttcttggaagcagtgatctctcttacaaaacacttttggatcttcagttatttttaacacatcatgaacttcctatttcatgtatagtattgctagctcagggctgagagagcacaataaaggatgaataagaacttacaactaaatggacaaataaataaatgagtgaatatgatagtgtatgaatgttgcactgatatttacttattttgatttgatacatttcattgtaaacagtaaaaatgtagagaatattcttctctgtaaaaataaaatagtattttagagctttctttgtaaaatatatgtaatttatttaaacattacagatgtatttgattcaccaaaaaattaaaaatatcatagtaccattcatatctatcttcatattctaattatgattaagttttaaatagcagttatgtctttaaagtgaatgtgtgttatgttctgccctaaatataacttaacattgcaggtagaactctagtgtttgaaaatgtttagaagtcagaattgcaattactgagtgtgggataaatattagctataaatataattatgtataaatataatgaatataaatattagttataaaaagtataagcctcttccaactcttaatgtttataagtctactaaaaaattaaagatttctaatagtttaggagttgggagggaaaaaggaaaaaccacaaacaatgatgttggaatgcaagaaatataatttgatagtgcagaggtgagcaaaaaggtctgttgggccaaattcagcaaaattcaatgcagaaaatatttactatctgacccattgaagaaaatgtttgctgatccctgtatgtcatgaaaagataaacgtgaatttgatttgaatggcaaaaagtagaggtatgaagtaaaatgcatatagtccaaaatgtatatagtctccacagagccataaagatactccctgagactgcacaatttataaagaaaggaggtttaattgactcacagttctgcatggctgtggaggcctcaggaaacttacagtcatggcagaaggtgaagggaaagcaaggcacagccttacatggctgcaggcaagagaggaagcgaaggggaagagcttcttcaaaagcactttaaaagcatcagctctcctgagaactcactcactcactgtcatgagacgagcatgggggaaaccacccccataatccggtcacctcccagcatgtcccttccttgatatatgggattataattcgagatgagatttgggtggggacacagagtcaaaccatatcatagggatttctccagaatatttgtgttgtgatgctatcttacgtacttatttttaccttttaaataaaaattggagtgaaaatggcagagtcagaaattaatggatcaattatttttttgtttgtatcaaagtttgagataataaagataaatattttatcaacatggccttattaatactgtatattcaatgcaaaaggagtgctgactggaaaacaatttcaattagtaatacttattaattggatgctaagcctaattctgtccttgttttattttttttcccaagatattaaaatatatttacctataagttgaaaagtaaaaatatgactgcaggtggctcattttgttttcacatattttgaaagttctaggctatggtgcccctttttgtccccacttcatgctttcccatttctcggagacaagtcacaatttctaactatttttgctctttgaattattttatgcttctttgtagcaatgtgaggcttggaagaaaatgtacagtacatgactttctcaaagtttacattttaaatttaacacattggaccttgcatttcgagttcaggttgcactaatgagatttctttatgagcaaagacaggagaaatgtttaacgtttttaatagctgtaactctttttatatatagatatagggtcttgctatgtttcccaggctggtcttaaactcctgggctcaagcaaacctgctgccttggcctcccaaagtgctggaattacaagagtgaaccacccaggcaataattcttttttatgtttgtggatatatatctatcctaagtgacaaaggaatggacagtattcacattgcctcatgctttcaaagaatatatggtgcagggacatctagaaaatgggcttttggtggattaaaagaaagtcatgagtgggttggccaaatgatttctaaaaaaaaatcaactctagagtagttttctctaagccttttagaatcgtttctttagatatttatatgatcttataaacaaatatcataaaattatggttccaatttactgacacattgccttgctggaaatgtggtttcatgccaagaacaaatatgaaaaatgtagcaaagctaattacagtacaacatgtgtccatcatttgatcttttggaggagttaagggaaattcaaaagaaaaattatcatgtgcaaataaagagagcttagctatcttgcctactggcctaaggtttctccatcactcctgcagcgtttactttatgtatcaggagttaattaaggtgaaacatgaggtaattagggctaatcctcccagcctcctgctggcttgttgcctcccaggctattgcctaaaccaaactatgttcgcagttttaaaaaataatgctcgtgtttattttagacattactcttaacttttaaagttgccttattcattttaaataggactttccatggaaaaagtataaagaatgatcaaactttagttttgatttaaaaagtaaaacaagactcattaatatataggtggtcattgacagaattgtaagtttacacttgttcactttacgtgttactaacagatttaataaaatttgcattagtataaatctttagctttgattatgctggaaaggtgcatgcacttcccaagaaaataatatttcttatacagatttctcaatatattatgcatttggatgtgtatcagggtaattggagggaggatcagagaacaaaaacaaaaaaaaaaataaacaaacaaaaaaaccttccatgaactgcatttaggtattttatctttgaggaacattctaacttttagatttcactaaatagatctggtaagtagtgactgatttattctccttaaaataaatacatcgcttgtgtcaaatatttttaattccacactaaattgtttgtgcgtgtgtatgtgtcgtttatattttcactttttcaatgaaagtaaagaataaaaaggttttctatccttgttgtttctctaagttgaaataaaagcatgtgcttttttattaccctagtcttataatttaccaatcataatagaatctgtactcttgccaaagacatttcattaggatgtgaagactttagaattgacaccccctcacatattaattaaaaagcaaattgcaggtaagcagtcatgacatttataaaagggggaacttacatgggtaaaatctcttttgttgttttttataatatactatcaggactgggactaataattctattataaatttgatttggggagatgtttgttttcccaattgctatcaaaatttgacttttatttagcctacattgacttcttctgttccatctttttatttatttgtctgttttattatttttttagagacagggtttcactctgtggcacagtctggattgcagtggcttgatgatagctggctgcagcctcccttaatctcctgggatcaagggatcttcctgcctcagcctcttgcatagctggggctacaggcattcaccactgtggctggctaattttttaagttttaaaattttttatagaggtaggtccttgctttgttgcccaggctagtctcaaactcatggcttcaagtgatcctcttgcctcgtcctcccaaagtgctgaaattacaggtgtgagccatcatacctggaatccatcttttatatgtactcttaaaagaattgtttatgctagcatcttgaaatacatacatatatatatgtatatatatatatatatatagtcttttactgaggttaaaatcatttttttgcagagtaaaccagtaaagattgcagaacaattatattgcaacaagttgctaattcatagtttctgcttgagactctaaagcagttaatatttacattgttagatgtgtggccaaatcatgaacttttatttagtaggcgatttcataacctccaaatgtctgaatcttactctttttgtattgtattgaggaaaaaaatgatcattttgattctataggctttaaaattaaatcaaactctaggtagcattgtttgggttatttagtgaatttaatgttgattctttaaaaatagaagtggggcttttctcctgcaaaattgccaagagagcatttgcaccatggcatttaagaatatatcagttgagattttctattgatcccagctggggggatgagtgccccgagagaatacatgcgccggctttatgagggtccctgtcatcaaggatttagctgtttcatttacagattcctgtaaatgttcaccagatccatgaccagtaattttcactggagaaggactggaccgtgggtaagcaaatgactctttgtcattaatggtttcaagtagcattaaaaatgttctggcagctcagttgattttgatgaagctatgaagcccaactgcaatgtgtatctagctcatatttccaattataagaccaaggaaagaatcaaagtgaataatatgtaacgtacacacatacacacacaccctaattttgattacatagcttttcctgtatagagatttaacttgaagtctacagatgttcacatttagcacagcacaataaaaatacaagtaaaacagaaactactttttatgtaattaaatttatatctgctaatgttcacttccttaattgggttatctcctaagtgatcagtaaattgcatgcaataactaatttacatgcctccttagacactgtagctgcctgatgatttgaaaagtataagtacccacaagtgtaccaaaattcattttgaattaacagtgaataaagaaatcttcaaaaattcttgagacatgacagataaatgagttaacacatctctctgtggaatctgtttctatgtatcaaaactttttagttcatgttactgtttaaatgacctcccattaatgtaagcctgtcatttataaaaatattattattattgtttctaaatttcacttagagatgccttagaaaaatctatagctaattttcttcgcctgtattgcttctagtatgggctgactcacagagatgctgcattacacacaacaaagtgttccataatttgcaatatcctctcctcctccttccccttctccctcttctttcctcctcctcctcttcctcctcttcctcctcctcctcttcctcctcctcttcttcctcctcttcttcctcctcttcttcctcctcctcttcctcctcctcctcttcctcctcctcctcttcctccttcttctcctcctcttcctcctgctcctctttctcctcctcttcttcctcctcctcttcctcctcctcctcttcctcctcctcttcctcctcctcctcctcttcctcctcctcctcttcctcctccttttcctcctcctcttcctcctcctcctcttcctcttcctcctcctcctccccctccctctcctcctccttcttctccttcttcttcttgtcactctgtcatcccaggctggagtgcagtggtgtgatcatagctagctgcagtcttaaactcctgggctcaagggatcctcctgcctcaacctcccgagtagctgggaccataggtatgcatcaccactcccagctgtttttaaaaatgttttgcagagatgaggtcttgctattttgcccagctgttctcaaattcctgggctcagaccatcctcctcccacctcagcttccccaaaatgctgatattacaggcatgagctaccacaaacagcttgtaatctgtaatctcttataagcacagagcagaaataaaaatggcatcatttttaggttctcctaactcttcttgcccattcttcactgtctgcccaggaacaaagtcctgctcttgagtccacaattatccaagtaattctaaaggtcttctcatacatgcctggtgagggcataaattaatgaaacctttattgaggacaacttagcaatatttattaaaattaaaaatgcttgaagccttcaacccagcaattccactgctgtaaatctatatttcagataaatttgtgtatgtgaaaaatggcattatatgtgtcaacttttgcattatggcattgttttaaatcgtgaaagatttcaacctaagaaggatgaagtcagcaggggacttgctaagtaagttatggtgcagcttgttttgagccataataaaagaatgaggaagtccttcacaccttgctacggtaaagttaccaacacactttattaagcaagaagaataaaggtggtaaattgaacttctccattttaaataatttgtgtaaaaatggagaaatgaatatatacacatgtatatgtatatttatgcatattagcttatatgtgtgtaaactctatctggaaggacggacataaaagaaattaatcatactggctgtttatggggaggagaactggacaaagctaaaggagacaggtatgagcatggcatttttctttaaccactttaaataatgtttttatatcgttaagacattaaaaatattctcatcctttattgtttccttcccaacctgacatcccatgttcaaatgttcaaattacatttttcctcttcccctcttttaaatttccattttagtgctgtcaattttagttggctattagaaaaacaacccaaattcatattaatgtgtaggtgactcatagcctcagaccttccaggcgtgttttctatttagaagaggagagttattaacttgcatggaattctaactcgttaaataccaggcggttctaaaagtaccccaggcagtgcttgcacgatcatttgattaaagtgaggacagcaagccaaagacatctgtaggttctttaatccacatccctgacaaaaggacaaagcagtcactgccactcacaccaagattctacccagaggtggatgcccagagggcttccaaggaagttgcatgctggaaaactccaagtacagatgggacagagctgctgagctctaagccagtatatctaagtgtggttatcacacatgtggcaaaagacatataacacatggcatatgcttcatgatggaatgtttgttaaaaagaaagactctagagcccctctgtcctcaagatctactgaaggcactgtataaaagagccctagtttgagcactgctgtctgtcatgaattcgcttcatctgctacttttctgatttcagtaactggggacagtgggatctcaatcagaaaggatttgctcctggaacacccaaggcttgggcaatctctgagcagccaagcccagtgttctctgagttcaaagatctgaaagtctttgcaaagaccttagagacccatcctgccaagactgatcccaaaaatgctttcctaatccatttcctgaggctctctgctcactagggcccaaccccacacttcctgttttatagggatagttagcctctgccctggggcactgggctggtccatgtgttcctttcctaccctagctaatgtcttttgacatttggggatgcgtcagtgctgcagattctttaaactctattcatttattttaaaaaaatacttaataagggctgggcacagtggctcatgcctgtaatcccagcgctttgggagcctgaggcaggagggtagcttgggtccagccagcctgggcaatatagcacaacccccatctctacaacacaaataaaaataataaaaatatctagtgagtacaggctttgggaccagtactcttttgggccctggggattctgaaaggaacaaaagagaccaaaatcagtccttttgggaagtagatatataatagacaataaacaaggcaaataaagaaaacataattgttttaggatgaaactctaaggtttgggggtaaaaaagaaaaaaaaagtatgtaggaatggggagtggggacagaaaatgttctagaaagaggaaagaggaagtgcaaaggcttaaatttacgaaaagcgaggagttccatgtgagtggaacagcctgggtgggataaatcctgcaaatttgaatgaggtgaactgagagccatgagcaggggccaggtcatggagtctctttgggaactttggctttgatgctaagcgagacaggaatccattgaaaggtttgcgttttgttttgttttgaagaagaatcaacatgatctgacttactgaaatgatcttgatgttcagttgagaatttcccacatggtgacaaggcctgaaatacagagctccgttacagtaacgtaggtgagagttaaccaggtggaatcagcggagaggttaagaagtaattagaatatggtgtattttcaaatcaaaaccgtgaggattccatcactctatgtgaggatataaaggaagaacgagagtcaaggacgactccactttgttggcctaactggaagaacagaattgccacttactaagatggaaagactggagagagatgcaaatgttaatggacaagtaaaatgtggcaggtcaatctgacaactaaaaatggagctgtaatgtaggcagttggatgcatgagtccaaggaagagatatggcttcaacatataaatttagaatctttgtgtacatgtagtaatttaagtcatgatatttgataagtctacagatggagtctgtggaggcataagagatcccaagactgagctttggatcagttcatttttaaagattaagaagatggagaggacccagcagaggagactgagaaaaaaagaaaaaaagaaaaaccgtagctagtaggcagaaaaccaaatgagtgtcttattctgttggccaaatgaactaaatatttaaagatagaatgctcaactgtgtcagatgctacttaaggtcacagaagacaagtaacaagaactgaccgttggaaacagcaatgtggagattatgggccacctttataaaagcaattttcctggagtggtacaaggaaagtctctattgcaggaggttcaacagagaatgagagaagagactgtggagatagcaggtaatgataccacactagtgtcctgcagtacggggaagaaggaaaatgaggaatatatggagagaaatgtggatataacaggttttgtttttaaaacaggataaggaaaagcgtgtccatatgcttgtgggaatcatctagttaagttagaaaaattaatgatacagcagagagggggaaaattgctgaagcaaagtacttgagcagacaaaacaagacgggagctaggcacaagtgtagaagtgactgtaatgtaggcacatagacagattatcattattatgagagaagggagataatgggtgaaggaggtagataagcccagatatttggtctttgtagtgtgcagtccatgatgcattcattatttcacattaatgtttggaaaataagtgggaaccctggcatacattgtttggtaaagaaacaatgaattatgctgaaagagaacagatttccagacagtgttgttggagtctttatccattgcatatggctcctgttagagtcaatttatataaatagagaattccttttccagtcttgtttaatttaagcaatgaagtattgagtgctcctgaagattattaagactccacccctgccttcaggaagctgcccatctggtggaatgagccctaagatattttgaggactgctcactccacccatgatcccacaacaggaaagaatatttaacattagggacatccaggaatattcaggacatatgtttgccattactgtaattagtgtcagttgtttgtaagtgcagaaatagggaaataaacagtgttacaggagaacagaagagcaaatgctcaactttgtctgggaggtgtagagaagcaatgttaaggcattgaaacttactgaaatagaagaagagacaggagttaagcctggacaggtagattagggtcatattgaatgaataattgttctaaggggtatgaatatttttctataaacatcaatggtgacgttaagtatgtctgtgttttggagagaaatgtagtagctgtatggagcagaggctggccataattgaaggttgaaaaccattgtgtgtcctctgcaatagtccaggctaaatataataaggaagtgacaatgacacagggcgctttcagctccacttcaccagccagaaatctctgtggccagctgtgcccctgcccaggcttcactcggctctgggctcgccactgggctcattccacccacttggcccagtgggctgcactcagcttgcactaccaacccagggtagggcacaggtctttgcactcagtggctgagctgggtgtgggcagtttttgctttgggcaccagcatctagataaggggaacccagtggcatcggaaaactcagagatgccggtaaccacagagacctaggggttttatggctctttcccagggagtccccaggtttgagcccccaagaaatgttacatcatttctgctgcccgcagtgcagcaaacaggagggcatattacagcttattcatgttacagcttgttcgttcctgcagcccatagctcagcaaatgggggcatgttgtgcccagaggctttttctccacattgcttggtgaatgagagggagggttacagtgttacagctctttttgtacctactgtttggtgggttccgtgttcttgtcccacaaccaagaaggatgagattgcacagacattggagagtggacaaggcagggaagaattttattgagtgagagtaaagttcttgacaataagaggggagcccaagttggtggccctttgtgtgagggggagggcccgaaagtgggtatcccaatgtgtgcctgagtctggggtttttatgggctcagaatgagagagtgcatgctgattggtccatggtgggcctggagaatgcaccatttaattggctaaaggccttaaggaagttcttactctggtagtggactcccctcagaactggaagttcagttttcaggctttaagctgtctttggcttgaggttggatttcaccagagacctgtccctttctgcccagaaatttatctgccgtggcctggagcagtggctcatgcctgtaatcccagcactttaggagactgaagcgggtggatcacagggtcatgagtttgagaacagcatggccaagatggtgaaacaccatcactactaaaaatacaaaaatcagccaggtgcagtggcaggtgcctgtaatcccagctactcaggaggctgaggcaggagaatcacttgaaaccaggaggcagaggttgcagtgagccaagatcatgccactgcactctagcatgggtgacagagcaagattccatctcaaaaaaaaaaaaaaaaaaaaagaaaggaaatttatctgcctcctgctgctatcaacaagggcaataaatgttgaaaggagggagtacatctcattaagtttttaagcagggctttgacacgtatttagaaaataagagaaaaaataactgactatgaggttgctgtttggggtaaaagttacattttgatttcatttgtcaagatgtagattgccgaggatgagacagatttggtcagaaggtgagcaagcataatgagttcattatgtacatgttgaatattaggtaattttaagctactctaaagtctaggatttgtttctttgacatgtttcctgtcttttaatgaacgttgaatctataatcagaactcaacaaaagaaaactcaggaaaactagcaatatttaggtgcaatttcatgtgagggacattgactgctaaaggacaaattcattacatccctagcaaaatcaagggtttccattattttaatgcagggtagcagggtaaccactttttttttttttttttggcttaaaataatttttgtaagttacaagatgggccagacatactttactttcttttcttgttatatattcacaggcaatcaatcctttgataaagaaaaaataaaagtttagaaggatggttaggaggatgtgattaagtaatacagcataaagaaaaggattaatttacttgaagatacccttttctttcatatatgcccagtggaaaatgataatagttttaagatttccaagaacttcaataaaatatatgtaataaatgcatcaagcttcttattgcattgtctcagtcattaattatacaccaaaaccatttaatgtcagaatagaatgcttacttgaccaatccacaaaaactccattgatttgtaccactttagtctatggattcaatatactgtaaaaactttaaaaatcagtaaacttattttttaacaaactaaagaacactatgaaatgctatgatgttttctcattacactgtcatagtgttcttgtactcagcaatgttatcaatgacatagattatcatatgaatgtattatcatctttattgtgagattatgtatatttaatgcaatgcttttttctggaaagttaaacctaaatttaatatataattatggccaatatattaattcctttaaggtatttaaaattttctcatgttacatattttttaaagtttccttttttaagttcttatatttttattaggtgaatgactttattattgactaaagtctctgacagcagataaaaggaggaataaatgaatgaatatacaaactgaacaattaaataagccttgttgctacctcaagtgatttcttaaaaaaatcttgctttcagcaatgttagtagcccactgaaagtaacatccttatattttttttacctacagaaaagtatgtgaaaaagtcacagcagcctttttggtgcttcttgtttttcttcaaattgatatcaactgtgtttagcatggataggtactttgcttgagcaaaagttttcttagtatttctaaattagcttctcctcattttttggaggatattcttatcatcatattgactctgcaacatattagatgcatccattttccaaatcgtgtacatttttattgcggttataaatggtaatcttttaaattgtaaggtttttaaattaatcatggctcaatttaccaaagacattataaaatggactaaatttgctggatcttataatttatgatttgttcttttactttcatttatattttctcattttctttctttttcccttggagattcactatctcaaatattgtgtaacaccaaatctctttaagagccacaaagaaaagtattgtgattcatacattcatatgacagatcgcttacccaaatctccattttactaggagttatgagatgtagaaagtaaaggcctaacctgccttttccaagaactagtaatatgatggagagagacatttaaagtacagtacaagagagaatacagtatttgttgctgtagaatttttaaaaactataaactatgggagcacctagaaaaaattgttaaggagtgttaaaagcctcgttgaagttggcacttctctcacactgcagattatgaaggaagacctattcatatgggcaaaagggatggttgcaatcaggagaaaggaataatggtttgtttcctagagctaccattaaaaattagcataaattgggtggcttaaaacaaatgtattccttcttcattcaagaggccagaagtcagaaatcaaggtttggttctttctggagactctgagggagtaactgtcccaggcctactcttgaaaaataatagtttctcactattgtttcaatttattttagaagcagagagacagattctataaaggcccaaggcaacataaactcctatgtctggtttaagtaatgtcctatcatagaaaacgttaaatcatactttgtcagctcacagagatacattgacctatctaatagaataataataaatgttattagcaataaccgtcatgtattgaacatagttaagcgtttcacatgtatatctcatttaatcatcaccttaatggtagtactagcatgctctaggtagagataagaaaactgaggcctaaagagagttatctataaacatttgcttgtgataagcagaataataataaaacaaattgaacatgaggacatatattactatgaaaactgaaaaaagaaggagaggtggcacatgagcataaatatgaaatgatagtgcaatgacagaggaaatggaactctgtgtggtgtgatcaacttaattttcagcactttctgcttctgccttctgcagcaaaactcattacacaatataaaaatattatgtgctacttactatgagagtaaatattaaggctatagtacacattgctttgaaaccttgcatttgaggattgaaagctttatctcacaaagtagaagttaatataaactgccattataagtaaatggatatttgttaaaaagcaaacaaactgaagaacttctcaaaaatgaatttatttctaagctagaaaagcctaatatttttgaggtgcttcacaaggctgatatttttcaagtatgaccaccatagtgtattcctgaaaataggtgtcataggaataggtaaaagtgaagattactctgctcaacaccatgccttctgaatcgaagtttcaggaaacaaactgaggcaatttgcattataaatgaacatccagggtaattgtttaataccaaatacctgagaaccattggtgtaggtttaatgtgagtattcataacattccccccaacattaaaaaaaaattctttaatttttaactttaagaaatgacttcagtaagatggaagagatggtcataaaatgaaagggtgttctcagtctacagtggttccatgaattttcatttcaaaggagttgtattaagtaaatatttaaggtaactattttacagatgacttttttttttttaaatcaaataaatatgtttggaaaagccatgacctatttgtaaattcttttctaaaaagcctgaatgtgtgtatgcatatggtatatatggtcgtgtatcataaaataaaatgaaataaaataaggtagatattgggctttctcttgctggtcagaaaaaagccttcccatttcaagggactggctctaccaatcaggccaaatttcctgggcacacatccttctgggagtggttgctctctttactttccatttagcagctgtacagttgggaaatgttcaacagaatgaaagccacctgctcctctaatgatttcagccaaacagacaggattgaaggtttaccaaatgtgttgtctgtcactctgactctgctcaaaaaagtaaatcaaactggtcagatattcatatagaaaatgtgtcattagttaactcctggagtgcctgaagctcctttcaggctaccagactctgctgatttggagatgcctttttaaaatgaagaatggaagtgatttgaagagacaaatttggaaaatgaggcattctagaatgtttcccttatcaaatgctatatcattgcactctataaaatgagtagatttatgcacatttttccccacattgacagtttgattttagtatgtgattatatgttcccaatccgactaattaaatgtcaaattcccataagtttccaactcaccccttcttccagctcagtctctctgtattccctgaaaattgtctacaagaaagtatagtatggaagggaaaaccatcatagtctttcctatcacactggaaaaatcacattagaagtggaaattggcctccaccttctctggcagtttgggcacgctctttaatccttctgtgccttaggtttttaatctgtaaagtagaattattttatacattagatgtgtctggaaatgtcacaggacatttgttttcctgaataaatgttcagtattatgtggttttttaaatgttattttgagatacttttgttttatatggttatcccattaatatttacatcacgacaaatatccagagaagtttcattttatgtattttgttttactacaatctgatcgtgtataacattttttttctatggccatcttcaaccttatgttgtcaatattggttaacagagggtgatgcagcttcagtataaatttgtttgtgtaagtatttctgtaatctcaagggattaatgcttcataagaattagctcatataacgccatagaaataagtagagaaaaagcccacaaacttttgttgaataatttcaggaaaattctttatgggtgcacttttttgttggatcacagagctttagtcatcgaaagcattgaactagtgagcatcctcagcatcctcagtgagcataatagtgttaaaaactccataaacatgttaattgaagtagattttgaaaaagggaaaatgataagcagatagatatagaaaaataaaaatgggtaaataacatttatcagtaatccattggttatctttttttcaaaaggcatggtagaaattttattataatgaacaaataaattatatcagcctgaaataattttaagtttaaaaaacaagatctgctgtctaaaaatgttatttccttttacacattaaaatgttattaatttagactcctctaatttagagttcctcaaaatttattcaaatgaattagaaataatatcatgaaaaattagattcatgtgctgatttgtattcttgcatttaatgggcactttgctttatactcttctggcaattttgaatgctgaggcagcacactagaaaacgccaacatcggcagattagtgcaaaagtcaagaagccatttacctaattgctgtgtcagtctaactgcacaagcatcccactcggttttatggaactgtacctgaaggcgaaatcaagttggtgtagaataagacaggggattagcggttccttttgacattttatgcctttcatttccctcctgtgctcactgtatcttctggtgtccagggaatcttgcttagaaatggacatgaaggctaagcaggcatttatagctaatatgtacttttctactcctccatatcattatttcatggttatctttgcatcccagacggctcctggtacaaattgttgcacaaggtgggccttcaagacaccatttttaaaaacgtctttgccacgtcctcctgagatatgactctggaatcaatctgttcctaaactagtgtttcataaattagagtcagctcaatgatatcgaaccacagattcattcaaatagaactgcatttcaggcatggatttacaaatgattatcttaatattttcttgcaaaacatagctaatgtgttctttacatttatttgacctcccctggttggattgttctgtctttattgcttcagcatgcaacattgcctggacactcacagtgatttgcacctattttttatggatgtgtcagcctatgattatataattatatgactttttataaaagcgtagaaggcatagaaaataatgtgccctcattttatgaatactcaagtaccctttaaataaaacactttactcacttttagagatgatatgccactggaaagcaatcatttggtcttttatgtaaattactatttttcattgtttaccaattcccttatggcccatatgtagtgtaactatattttctatggcagtcagagttatacaatctagaagttaagtgattaataaagcagatttcctgggatcagatgcagtataatgctgtgctaatataaataactattttttccccacattactcattggaccaaaagcatcaaaatatattttatgtaaatgaggaccctacacttttcaccagcttatgaagcaacatttctttaatcttaccgtttagtttctaatatgcttttcagataaatttctttaaaagactagatgaattactatgtcatattaattgcatatttgttgtgtagttggtatgttcaattcagtgacattattttataagaagtagacctttcctgccatgagctttcaaagtagttgcagaatttcccatgaatgtgaaatacagaatgacaaatactgtaagtaaacatttaaaataaacaattattaaggttatactaggttgaaatgtatgaaattgccagttttcaactgttttgaccaaatataacctcatacaattgtattataattttacataatattttattcttcctcaattctgtgcctttgttcttcctggtttttctacttagaatgtccctccccacttttttctgacaggaacacttacttttcatctgtatggtctcacctggaacactatatgtgcccagcatttttgctgatattcacaagaagacttaagcactaccactactgattatacagattttacatttaaaataattcaatgtgtggacattttatcatatgtgatttcataaacccctaactccaccctggtgcttcctaaaacataattctcccagggtaacgttatgacttactgtgtccttcaggctagatgtcataatgtatttgtatctatagagcttattaacatgattggcatataacagtaggtaaattcagtgctgactgaatgaatatgttattctattaataattcagtaactttttttctttgaactgggaaaaatcttggagagtttctacttctttccccttattttataaatgagaatactgatgctcagaaaaataccttgatattgctctttaagagtggagttaaagctgatacagcacgagcaaaatactaaaaatcatctaaaattatatatgtgacaatttgcacagatattaaaccagagaaatagtaactctgggataactctagacaatgacaatcagagaaggtgttgtagaagaactgggatttaaaatgaattttaaaggacgggtagaatttggacaggcagaggaaatgggagaatgtgagtaggatggtatgagtaaagcattgacagaggaagacctaaaatgtgcttagaagagtgagcaaacagaatgttaatcaatgattgttctgatgtctttacaaagtatatgcttttacccaggggatatatacttgttggctttcttattttgatataagatacaatatatgtgaaattctggagactattcctttgagattgaaaagcgagtgatactttgtcaaagtgttctgtattacaagttagaataggattgaaaattaaatataatccaaaccttgaaacttggcttaaacataaatatatttctaatttactgaagcaactaggcttccacaatttgtaatgtaaaggttcttttcttttttttgttggttttatccccatgaaattgtttccatcaatttgagaaaatactgaggtttcttagtttggttcttttttgtatatgaacactgcgtgcccgtgtatgcgtgtgaagtcacaaagagaagggttggaggggagagttggaggaaacaaacatccccttgtcaatgtagtttagggttttcagctccttccatgaacctttgcacagtatgacatctacaggttatagatggttttctttctgtatttggtgttggctctaaaatcctccttagaaaaggcaacacaagtatcccttcccgattaatgtgaattggaacaaaaggtataaataccatagataaagagagatacatatatatgacgtagtatttgagtgagataaactcttacccatggctaatatttgagtgaaaggcaaattggtaaatattttctctattgaattatttttaaatcacttgagaatcatctgttgagttctcactacgtgcccagcagtgtgctagttgtcagggatgcaatggcaagaaaaaaaaaaaaaaaagacttgaatggtctttgctcttatggagctttgaactagtaaggagatatataataattacagaacaaatatacacattgcaaattgctggaagtatgttaagaaaagcaaacagatgatgtggtaaaaagcagtttggtctgttagaatttgagtaaaattaaaagaaaaaacatagcttgagatggtgtcctcttttggaggtggccaaagatgttctttctaagggggtgatacataaacttagagccaaggtgaaagatgaagtcacccatactccataaaagacagggacaaagtgctaagcagggaggtggaactgtatatgcagtggtactgcagtgagaggaactgggaaggagtgagggtgaagactgggtatgaggaggatggggtgatcaggaatagtcaggtcatgcaaagatgtgcagaccatgctaacgacttcaatatgactctttttttttttttttgatggagtctctctgtgtcgcccaggctggaatgcagtggcatgatctcggctcactgcatcctccactcctgggttcacgccattctcctgcctcagcttctcgagtagctggaattacaggcattcgacactacacccagctaatttttgtattttagtagagacagggtttcaccatgttggcaaggctgatctcgaactcctgatctcaaataatctgcctgcctcagcctcccaaagtgctgggattacaggaatgagccacagcgcccagccccttaatatgattcgtggtgtgactagaaaccatgaaagaatttaaagccaaggagtgcatgacccagttcatattttctaaagattcctgggattactgtattgaggttggattgggagggagcaagaacgaagcaggaatgtcacgttaaaggtcgttcagctgtccagacaagaaataatggtggatttggctagggtgatggcagtggaaatggagcaaagtgagcatattctagaaatacttgggacattgagctgtaaggactccaagtgccggcttcatgatgtgtgggaaagactgatcaaggagaatcgatgggtttctaacttgaacaacaggatggataaaggaaccatgaacagagatggggcccactgtggcgggcaggttttgggggtgaagaagatgagttccactttgtattctgaattggagatacctgattgtcgtgaaggttaagatgcttcagagtgttcagaaatcaggcgtgagattaaggtaacagataaggatttgaataatgggaatatatagataattgaaggtatagaaattctttttcttgatcataaagggggaaaccctatttgaatgtggtgtgtataatgtaaatacctacacacacatacatatgtgtgtgtctgtgtgtgtgtgtgtgtgtgtgtgtgcataaaacctaaggagtaaaaagaatagctgatatcatttggtcaggaaggaaggaaggaaggaaggaaggaaggaaggaaggaaggaaggaaggaaggaaagtttttcttgattgaagaaacccatgttcaattcaaccttacacattgaaatcatttactaatttgctttcatttactaatttgctttaattttcccccacaaagctgtatatgaatgtaaaaagaaaatgattaaaaatacaaataagattaactcagcttccaaagttcatatagggtaagaatttgcattgaaaatctgatgaaagtgtttgaactctatgttctctcccaagagtcatactccttttaaaatttgctaacagcgaacttcatattttaatttaacattgagctgaagcctctaaaagtgacatttctacatggaaggtgtgccagattcctggagagggcatatggaatgtgcggaatatgagcaacctgtttgtaggcatctggaggcactggaaaagggatgaggttaacctgaaaaccactggattcaggattagagtagcctctcttgccgctgatcctgaagttgtatcttatggaagcattgtcagaccacagaacgcttgctactgaaaacacagggctgaattaataattgctaatctatattttatttatgatgtgctagtcagtgttgtaagcacttgatgtattatttcatttaattattacaattcccttaaaatgggtgcaattgctatctctattttataactgaagaaattgaagtgagcttaaataatttgtagaagttcacgtatctcataagtggtacacctaggatttgaactcctgttcgcacaaagcatgtatcgtaattgttatttgttgtttgggatgagtgggttgaggggacaagaaatttcaatcccaaaggaaagaaatgctgtctttcctggatgttagttgatttcctggagtgaatggccttctggctcccactggccagggaaaaagaaagaaaataacagcaagtcgttaattcataaaacaattttcccaagtgcaaggcttgcagtttctgcacctgctacgttgctgactcatctcacctgaatcatttagtcagcttcattgtgtttgctaagactgctaattatcctactggaataatttaaactatcaataaagaatgcaataaatcattaaagatatggttaatagggagagataattttgactattcagcttgcattgatccttgatataaaaagattaattttatattccgtttttaaccttacaggcaaccattagccatttcttttcacagagttgagctgagctggtttttcattaaaaatgtggcatttatcttattgaattctagctgtgatatctcattccaggaacaaaaatatattctgacttaccaagaaagcacaacaagacaaatgttacatttttaataaaagtcattgtaaacaaatttttgaaatttttatgctttttaatctacccaagtatacatcctccttattcctattaatttagaaaattgatatcttttccccttaaaactataggaattatgtgattttattcgttactgaaattaatgaggatacagtgtcaaaattatttggcctgtaatacataaaatgtaatattttgtgtttgaggcattcacagcaaaacttaggtaatatttttttttttttttttttttttttttgagacggagtctcgctctgtcacccaggccggactgcggactgcagtggcgcaatctcggctcacttgcaagctccacttcccgggttcacgccattctcctgcctcagcctcccgagtagctgggactacaggcacccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccggtaatattttattgttaatgttccttggatgcttgtagaatggtgctcatttttaatagcttttaattaatttttatgtttttgctattgcttggcaaagttgtataataagaaatacttgtattagtagtcatgttgatctattgcatgccaagattatattggataatgtatgtatccatgaaatcaaaaagtttcagtgttaactttttcaaaataacagtataagaaaaatgcattttctgtcaaaactcatagagtttgagtttttaaaaagtttattgaagagaaagtcagaaccatactatagaattttgatttattttttattagaaccaaaggaatagttagtgctactctaaagttagatcagctaaacaattactgtatatacactagttttatttccataatctgataactttagaaacatgacaaaaaagagcaaacttcagagtcgtatcctattgtgacacaaatcagctatttatatccaaagtgtgcattcaaaagtattcctggttactcttgaatgtggacttgtggaagctcacaaattcaatctctgcattacattttatttctccatttactgatcctggtaataggccaggagctacattttattaccatcccataagtgcacccgacttgctttaccagactatgacacatatttttaagccattattatagcccccactggtacccaactggtcagaaaacacagattcaaactcaagacaagtaaaatgatatttctccccttcctcagacttgattggaaattcttcctttatgcaatcaactaatcatcaaaatcctattttgctggtctctgaggggaatctcaggcagtatagagagcaaaggactttgcagttttgttatgtccatggatctttgggttgtaagtaatagaaaacagttcaaaattgctcatgtaaaaagcagggttttttttttttttttaaatgcactcagtatttcatgatgttcaaatactgaaaaggaaattcatgagaatcagacctagaaagttgaaaaacacggttgtgatcttccctgtgatcacaatctgtgatcacaacaacacaatctgtgatctgctgtgatcacagattgtgatcagtctgcacccctttctctctgcatgttgatacttgtggtttgaaatggccccacacaaatcacaccttacggtctcttagctgcggtgctcactaatgactgtatctcaagagagagaatctggatcaacatggtagagcctaagagtgggagcccctggcccactctgctgtgaccatgaggttagatcaggtgaggcttctgtgcaatggacagtgatcgatatgtttcatataatcctatccctagaaacatggcacaggcactgaatgatagctagaaacccaagcctggagtgattaccagcttgcaatccattctgtggagaagggaggacttctactgatttttggaggatgagggcaattctgacagggagtggtatgagtaaaggctaaagattggatcctttctaaatggtgactagaagggtgaggggagctaaaggtctacatgaagaagttgtggaagcttggaaaggaaggctttgtagaaagccttagataataaaatttttactttggcatcctttgaagttttgttgttgatatggcttttgtgtgtgtttgtgtgttttagcaaggagtggccattggtcagaggtgtgctggtgaatgtttaacaaccagctctccaaaataaaaatgtgtatgtacatattaatgtattaaaaattttattgataggatatggacacacaatttacaaataataaaatatgtggctaagtctgaatgtttgttttccctcaaaattcttatattggaatcctaaaccacaaaaggatgatactagattatgaagtggggctttttagatggttagtgaccttataaaggaggccccagagagctgccttgctccttccactacaggagggcaccatctcaggggaaccatgccctcaccagacactgctgccaactcaaccttggacttcctaacctccagaactctaagaaataaatttctgttattaataaattgcccagtgtaaggtattttagttatagcaaccagagcaaactaagatatgtgtaacaccctttgttgtacatttcatatggctagttgatgatctcaagattctgtcagtgatttttgctaaacttttgtgcctgtatctcatctgcatctgcagtctagccatggtttcccaaatcaagttgcatcccaatctgcttattcttttcccagtaagtttattgtcattaaattttatatgtgatctgctgtaactatttctcatcctgatattaattacattctttaaactggaaacttttcagcgttagaatcaattagaaatgtatatagtgcaacaacagactcacaaagtaactgagcatttagcaattggctcctgagtttcagccggagctggtttcagtgagtaactcttaatgtctgagaggtgatgataccctcaattacaatgttacaatcctcaaaacaatcaatgggatttgattagatatgggagtatggtgaagacaaagaagatttcaggaatgtgtcctttgataaaggggttatgatcatccacaatggagaaataatataggaatccattcattcaacaaatatttatgaagaagcaaatactaatgaggaaaagctaaacattttatatgctctacaggatagttttctaattaattgttcaagtcaaccacagttcaaaaatagatataaataattattgatttctattaaattaagcctctcttttcagcttttagtgatgaccctacttgcacattatgcctgaaatgacatagtcgctggaccctgagccctcccaaagcagaatctgtcttactttcgtcctgtgttcccagcatccagctcaatgtttggcttatactattcaataaatgtgggttgagttaaggaacaaagaatctatacttggctccctaaaagagctagtcagtgatgaaaaggggcagactggttgacttcaaccactttctagagaaagtgttgacagtgttaaatctagggaggctattttttattcttttcaaatcccaggaaagtctatcagtctataaggaagtctacaagaaagattcaataacgtaagtatgttgcttgacactgatgtttctctgtcttcagggtgaaaattctaggaatcattgtttacagggacatccttgaattccaaatcctggaattaagctaaagatttgtgacttaggttggatattgatgtaactctaaatatttagcaaaaccaggctgagcaattttctctgcagcatataatgaatgtgcatactctatgcctctagcttttttagcaatttggaataaaatctttgggatttgttctgacacttttgccttgttaataaacatagtaagaataaggacaaagagaggattataaaagtcatttgtatggtcaagctaaaacagtggcatttacagaagtttataggaaatgtaaggaatgacattttatatacgggcttatttttcctttaatcctatattaataaagtgaattctgtatgggtaatacaggataccctctgtgagttgactgtgtttacaaaattcatttctaaactattgttcgcaatggggcatatagcggtgcatggaagcaatattaaatatagtttttagttacctccacaccagtctacaaaatctgatttagcaaagcatctgaagtctctgaagggactaacgatattatagaccagggtgtggggaagctattgtccctgggccaactctggttcaccccctgatttaataagtaatgtttttattggtgcacagctgtgcttatttattagcatattgtctatggctgctttggggccacaatgacaagactgagtagttgccacaaagaccttttggtccacaaacccaacttttcagtgggagtgtttgcctatcactgaatggtctttaatgaccacaaggaagggtgacctgtgaagtttattcagttttgactgtagagatcaatcaggaattcatgctaccctagtcgacccgtatgctggtttattgtgtctcacagcaccctcttgtattttcccgtccctccagacagtggtacaacttcatgtggcaggaattaattctcaaggtctgaagagaggactctcacaggacatagtctaagagacataaaagaatgggattggattgtttcttttggtgtctcaagttcaccgcagaggtgaggacatggctttatttggcgacaatgccttattgtcggatgacaattgtcggactagtgatgaagtcaattgcttgcttcctttcttcttgctacactgtccccataactagtctctctgcatctcagcccctgatcaggatgggtcttgcgatgagacaccttgcagacatgagttgatttttcaaaggtttagtcttggtcaggagccaatagagcaagataaacagaaataaagacagtgaggcaaggtgagcaggggttcccagactcctcctgcatttcagataatttattagctaggagagttaaccataaagtagctgtttcccatccgtcctaaactgttctgtattgtgttctattattctatgttatgctgtcagtatcactcctagatgacatctatataatgtttattagggaccatgcagggtgctagatgccctgcacgctaaggattttccttcttctctggcaacttgtatatatatatatatatatatatatatatatatttctccttcatctaatctttaaacaactgagtttctctagacttacttgtgagttctcttaatctcttattctatattttctccctagacaatcacatgaacatcacagcttcaagtgccttccctaaacagataactctcaaatgtataactctgtcctggacctaatttctgagcttcagatcaggatacccaactacctacttggaaacatttcctcttggctcactcatggtctttctatctgactcttcagtcagagactgtctcagtaaatacatccaccatccatgaaacttctaaacccagtaattcttgtgtcagttttgtcccttccctttcccttatcccctggatcaaatcacccagtctagtatgtattttcctctaaatataattgggaatccatctacttctttttattcatactgccatcactctcgtcaaagcagccgcatttctccctcggagtaggaaacagcttgttagctagtgcacctaaagctactcttcgcaccaatcatgttgctcttctatttgaaacttttccctgacctccttttactttttggaaaaagtccaatagcattaatgctacctacaagaccctgcattatctcttcacagctctcttcttggcctttttctacttcctcctgtgtgttctccttcttgcctttgaatacattgcttccttatccttagcctagataacccctgaatatctttctcagcagaacttacctcatatccttaatatgatttttttaagaatgatcagactaggtgaggacccccaaatttcccatttgcaactgtattcacaactgtaattaagtaaacaagtatgtaattgtgtaaaatgtgtcagcctcaccagaatggaatctctagaaagacaagagctgtatagttctgtttaggactgtgtttccatctcctaacacaactttatcattactgaaagaattaatgtgccgactgaatgaatgaatgagctcatttaacacttgcatacttgttagatatttattgttgtcaccatttatgagaactaggtagaactaagtttccaatctaggctatcagaccctcagaccatgtactgcgatacactgcaaagaaggtttagtgcttatttgctctcctggttccccattaccatgcataatgaaaagttgatgagttccagctactggatcctaggtaaggaagagcaaatcaatatgtaacagtgtttttggtgttaagggtcaaattgaataaattgtgtaccatattacccttacatttagaaaatggcttcactggatacccttttattttaagatcacttattgtatttttattttaatgcactcgcatataaaatgaagaaacagccagataatgagtacttgatccccaaatcatgaaatcaattttaatatgcttagaagatttaatattttcttagggcaatgagattgatgaagtcctgttaatgaatatattgatgtaattgaaggaaaatgggctcaacagtcttttgccatcagtgagatgaaccctatcacacaaactaagaagtaggtaaaaaagaaggcattaaagacattgcataagcataaaagttcattctaaacattttttattaataaaataaatttgttgatatagataacataaggctaattttctcttgaaatttacataacactaatataattattttaagtatcttatactgactccatgaatctgtttattttctttccatatcagagattgtagacgaaaaaagaaaaaacacctcctttttgcagtacattgatggaaagtattttatttcatatcatattttattaagaaactgatctattatgaaaaacactttttaagccaaataagtactaagaaatgtgaaaagtagcattgttttaaaaaatttaaatttcttttaaaaacattcattttctggaagaagttttgaatacaggtttaacaatttcaaattttttttccatctaaattctacctttcaaactgtattcccatgttaactagcctgaagacagatactaattgtaccccaatttgtaatgcatcagtttagcactattgatccgctaaaaaatgaaagcaaactaagcaagagccagtctcaataccaaaggaatgatatattgattccatctgacaatgctttgtctacagatcaatgtgtatgtgcagcatagaccagttaaaaatgaaacagggtggacaaaggtcgtgaaagaaacagggtatccaagattattggagatcatgaaatgaacatatcttaaagtatatctgatagttgttcacttataaaggaattctgtaggtttactgtgcaaaaaaatcataatgtaaatgttttatgatgacaatgccatatcttggtcctgggagtctctgaagaaattgagactcacttcttaatcaagaatgactttgtcttgattaagaatgactttgtcattcttgattaagaagtgagtcttagagaaaaaaaaagacatgatatggattcagtcctgctatgcttggtcataaagagatgactgtgtatgatatataatacatctgattcttaggttctctaatgcatgttttatattcctgcagttttttttacatttcagattttgaaaatcagatatattgggctgatgagagattgagagatggaagaaatgttttctggcataatcacaaagtagtaattaatcagactgtgagatttcctccctgtcgaataaaatttaatatactgtagtgaaatatatgcatatacaatacattatctgtttgttctcttcatcactgtattaaagaatcacaaatatgttctagaaccagaggtgggtaatgttgatagtatagctatggaaaaatagcctaccacaaatttctttttttcttttttattcctctacacattttattttcttgggcttgttacattttaagagcaaaagtaggtgtcagcctgtatcaacattgctactttaagaataaaaatactctgttttatgaattgttcaagttagcatgtctgtggggatttttgaagattcgaatatggtcagatgtgaccttctgagttgatgtaaaaagaacatagaaactaatttatgtgtagagatactggatttcagaataataataataatatttggaaatcacatattagaaagtcagaactagttccaaaaatgtatatttgggatttccttatctagatgctatttatgtttttaaaaccaatttgaagtctattcaaataggaataaggaaagaaactattatagcctgtatgcagaggaaatatctgtcaacccaaaagtttagcagctatgcaataaaccataatgtgtattcaggctttgcttatgcaacttattttattattaagaagtgtgaatattctgtaatagcaatctttggacaattgtatacacatgattttctacttttgcatttcttctgattcaattctgcattaaaatatgacaaatggaattcatgcaagaaaatgtgtttctgaataccttgcatagtccacatcttctgttattcataatccctgacaaaggatgacagatttttgcttttaaccactaaagtggaaccaccctgtggcaatagcataaagccagttcaccattcacttggcctgccagcatgaaaattctttgaatatttgagaaatttttaattttcaaatttgtgatttctaaaagtttgtttatgatatgaggatatagttcttacactattttaaataagctcaaaatgttactgtattatattgtctttcatcttataaaccttgtgctcaagtactgaaatttaatgtgtctagggttacctatttaggattttaaattatgttctaagatttaaactgtggatttaaatagaaatagtgattattattacattatagataatacatagtattaattaacaatttatttttatgatagcaaactttactgcctattaaagcatctaattttagtttatttttcttatagttatattaaaaaacatttgcatagaactgtaacatgtttaacctttctaagtaaaatgggactagaaaagctcctttattacattattcatcgtaagcttacagataagtgagagaatttgacattgttttcacaatctagcctataaaatggcttaggtttttgaattgatgattacctacttactcaaaactctttttttaaaatcaaaagaagccttccatcaaaaatgtccccaataaaatatgacagccttctgtgaatacaccctgtcctctgaccagtcaattccttaatatccagatgcaagaacttatatcagtcggtatgccacacactacagtgtgcaaagctaggataataaataaagtgtagcagtatgtttattaaaaatctatgccttaaagcaatttaaaacatttttaataacgataataactataataccatatacatgattaataggaggtttttactgtcttataataatactttccccttctctttggcatatgcttagtttcagatacaaacttttcaacctacacagccttgattggattggaaaatgtgcttgcacgctctctctctgtctctctcggcctctagatagatagataggtagatagatgatagatagatacatagatagatagattgattgatagattgatagatagatagatgacagagttgacctctgagagggatgagcaaatggcaacagcaacaagacatccaaagaggactagcaattgtccaaatgactacccacttagactgatttctgagcatttcaagcctgaaactgagttttaccaggaaataaatctgtatatattttatatatatatggaaagagagtgagcatacccaacctacgagagagagcaggtttgccagaacacttcagactgtttagggtgaaaagtgagtatctgaaaaagagtgtgtattgaagagaaggggatacacacacacacacacacacacacacacgcatatatgtgtatatatattgtgtatattacatattagattatattaatatcaatagttatgtttattacatgtaaatcaagcatattatatatgtgcttactagtcatttaaattgtaaccatttaaaaatgtaaatagcattcttggctcaccagctctacaaaaacaggcaacaggcagatttgacccacagggtgttgcttccagatccctgtgctaaactgtacttttaaagtatatgcagaagaagaaagctttcttttgtggatgatgtgttactaaataactatcatataatactaaataactcatattggctttgtaagaaaaagtgaagtagtttttttgagttagttttacatacagagctattaaatctgtagtgttctatgtggtcaaagtcatttaaactaaaagaaatctcactagttcaagggaaagtcaaaataataaccatgatgggggagaacaaaaattgcaaaatacaaaaggacaatatatattgtccttttgcattcaaaccatttttaaattcttacaattatcatcagctttagcagctaattttctaaatgttaattaaatagactagaacattctatttactattatccattgtcccttaaattaatagcaaaaagtgagtaatatcttgtaagttattaagaagcaattagtatcttaatacagaacctggactaatcacttcattgaaacagtcatctgctttatcaactttgctcaggatttgaacatgatgatcaaggaaatatatttaaaaaggaggactatgtcatttctaaaatgaagatatctgatgatttttccattgcagtgtatctgtattttatgaagctacatggctttgtggcctcttatgatatgaattagaaattatgatatacaaattagttctgaaaaagatggactgcatttttctcttctcttattctctggcatttgctgaaataaatacttacgttgttcagggcagaacagaccaagatccaccaaaagaataccttattaagtatgaagggttccttgtattaatgcatttcaagagaagacgcatgctaaccattagtattaaggagtacaaggcaacctactaaggcaagaatgtcaatcaactttgacagtcccatgtccttcaacatttcctgttttttcctaccctccccaattttcctctcattttccttgcttcctttctcctgtgttcttcttttctagataaacattttatctgaacattttacattctaacgtgttttagctctcttccagacacctcatacatatcatacctcatctcttaagtggtttttaattaagttaaacacattttggcctgttacttgtccaggaggcagtccaaaaatatttattgaatgaatgatgtagcaacataatatgcaaacaaaaaatagtttttacgtaatatgtagttttaaatacagaagatagttattatatatatgctcagtgtgagaaacaggatataaatgtagctaaaacacagaagttgttttcatttatgtcagtctaccatgtgcttagagtaacaataaaagatggtttagtaagatgaccattactattcccatttttactttgtctttacatatgacacatttttacactgttttggtcaataaaaagcctagctttccatattgattgctatcacgtacttattgaatccaggctttgtccctctaattactttcttatgctattttacatccttgtttttagtattgagtggcaaaactcattattaacttgagagtcttttgatctaaataaaagttaaatcaccagtatcacataccggcttttttccaaataaatgtaaagattttgcatttatggtagttaaaaagttaaaatgtacttttataatgagctgtgcatatggctttagtagttaaaatatgcactgagtaaatatcttagcccatatatatgggtcatgacatgatagatggaattattctattagaaataatatgaagaataaaaatgtaagttcactgtgtttatagtaaacatttgataggttttcatgttctttttgaacaaaatgttttgaaattattctcaattgcaagacctatgtgaaagctcaattttattcctctttattcattcttactgggaaagaaggaaagtctcagccgagtgtaaaatctttgaaattgttcaatttttgctacattctttttccatttacaccattgagaattgacctggttgtggaagctcagtctccaggaatatttgagggttgcgggtggtgaggacgggaggagaggatatgtcactatgcacccagatttagaaaactccccattctctgcgttcttttctcccatgcctccccattttctcttttcttgccctaattctgtttacaattcccatattctattctttctgtcgaagatttcctgctgattgtggaaagacaatgtccaagggaagactgacatacaaatgagtagagtgtagttctacacgtcattttctccctctggacctttcctctttcactggggcttgtccccttgtgccattcgttgcccaactggctttacaacagggcagccccttttcatttttgcttagttttatcatggtgtgccttaatttaatccaagaaacatgtttgaagattgctgtgtaaagcattggatgtttccaaaacagagacgggaatgtatatgtgctgatactagatcagggtgggttgaaatattattgtttcatttaaaatgtaagtgtgcaactgtatatatgtatatctatacacacacatatacctatgctgtatattaaaatattcataaaataatacacaagaaaaatgataacagtgtcatgtaaaaaaacccaacgctttaactttgttataaaacgttacttaaaaatccttttgcaaggattgaaaatacgagatatgaaggacatatgtcttcatgtctaaatttaaacatacaaaattataaaatgagctgtactgcataagaaatcagtgttctgaaggacagctgggacagaggcctttgggatcagactgaagaaaaatgatcacacagagtaacagttagaagataaatgtctttagtcaaggttttcaaagtgacattttacctctcctagaaaaaaacctgctagtttctaaactttaaaattccattttggtgaattagcttaaaatattagaagaatgtgactgtcagcgattctcttcagaaaatcaaagaaaacacaaatttacaatggtcattttttgctgatgcttatcaacgttttgattatggaggaatgaaagttttaaaacattttacatttaagataattttttatcttaaatgtgttaggtttacccacaacacattttagacttgcttcctaagtattagttaaaatggaacaataatatcagatttacggccgggcgcggtggctcacgcctataatcccagcactttgggaggcctaggcaggcggatcacgaggtcaggaaatcgagaccatcctggctaacacggtgaagccccatctctactaaaaatacagaaaattagctgggcgtcatggcgggcgcctgtagtcccagctactcgggaggctgaggcaggagaatggcgtgaacccgggaggcagagtttgcagtgagctgagatcgcgccactgaactccagcctgggcgacagagcgagactccggctcaaaaaagaaaaaaaaaaaaattacattcatgagtcatgtgtttgttgcatgatgctattttcattcaaagagagagtatggtcattctgtaaaactatcctgttgtgtaggaaataggactgtaattttcaaacttttttcacccaatgaaaaccttttcttcatggcagagctgtatcatataaaacataattaaatagtatttaaagagatactatgaatgtaaatgtctaaggataagcatttaaaacttatacatatcaaaacagtctccaatacatggcacaatatcatggtgctgtgacgtgttgtatcagttagtagcagtgaaatgactatagcgtgatgatgtgcacttaccccacatatgaccctaagtattgagtaccagggttcacatgtgtagcattctcatttgtaccatgttccaaatgagccggggcaaatttgaaacgctaaatcagaatcttctcttccaagatctattgtgatgtagtgtgtgactttcccatataaagtttctgaaatggttttgcaagccttacagtgctatacagatattagtaataataaacacctgaattttacatcagtgctcagaaagagtggactccaacctctgcatgaagtcagttagattgcttgcacatatggtggttctcatatgatgggattggaatataatgtgtctgagtgcattgttagtttttgttataaaaatagttgaaaaccaaatttaaatgaaattcaaatcaaatattgttgccattcttagagactttagcgaaatactaggatttcattggatacaatggaaagaacaatgaatgtaaaatcaaagtcttattataattttgcttataaataattgcttttaataatacttgtatagccctgaactgtttatagaaccattttacacattatgctcaataatcttcaaataattctcatacaatgaggataggatggttattattatcttttttttttcagaagaggaaatagactgagaaaaaaataaattcagcttaacatggatttttttctcacttaaaatcttaaatttccagtgtggcaacatcatttacatatagtgctcaataaaatagtctaagtgccactcattgcccaatttaagtagtgcagttctagtatattttataactactcagctattgttagtagtaccatgaaacagtatgtcaaaataatattgaagaataaatgtatgtgcttttggagttcttgttttagaggtagacaattctactaaaattgcattttataaaataatagaagaaattgagaaaaatactataattttttttccctttaacatttttacctatatattaacataaataatttctaatttaacatcttaatcatttctcatatgagtaaaaagacattaaatcctctaacttcatttggagagttcttgtctcttccccatgcaagttgtagctatgtagccagcaggcagacatagcattaagacagccaacttggacgaaaggagacataaagggaatgtcagagttacccagcccagagcccctccctcctaccaaatctgaactttttttcttgattctcatgtcattctttccaacttctcaatcttctaaaacaatctgcataaagcatcttaggcttcacactttacaaattaagcagataatgtctctaattagccttacttcttctcttcctgattacctccccatttgtttcttattatctttgtccatgccttcatttttgatcttagatcttcttttctatttattcaacatttccctctaagattccatatgaagtaaattcaagaatactatggaatagcattttaatattaagattttctcttactaaacatgtatttgcataaataaatgtaggttcacgtctttatgtattttattagaaagaataacctcctatttaatacagaggatgaagctttaagggaatataaactttttatcgtgcctgatatatttgagtatataattatatgcttactctgattaggtagatatgtgtgtataaaaccttcaaattttaatggaaacattaacttttgtatacattaacttgtgtctctgaatacattaacttatgtctccatgtaaacagcctcaataactctgttcaatgacataccagtttctgtctgttggtgttttttagtttgccctttgacagataattttttctaagttcagttaattgaaactaatattttgccaccatgaaaagttttaaagaggaaaaagaggttaaaatacacattggaattattgatttagcagcattgacatctctacataaagcacattgctgcttgatactgaaggctctcagtggatgacgtataaaatcctatgtgggaaaaaaggcagaaaataccgaaaagaacacatctgtttatcccaggctttgggagtttggaaagacctttatttaagctatataatgtatagaaaagggcagggatttcatatttgaatagttagtgtctccagttaggagttgtcagcagacatgcagaattgtcacctatgtttggaatgtgcggaggcatccttaccaattgctatgacaaggtctggatgggatacgtgtctacaatgcattccagttccagtacccaagctgatttggtgttctcattcttgaaatggcgtatggctctttttcggcaaataaaatcagcaagtgattgatgtgccacatccgtttggtgacgtcaactgccatgttgctgatacattttttgtcttctgcagatagagcctttttagggacttagatagttcagtgtcttaagaagatgaagacaggagagcagaaagatgggcacctggcccacagcatcattagccactctacgctactagtggaaagatacatttaaaaattaatgcttttttaatttaaggaaaaatatgaaattaaaattaagactatctcaggacttcttaaaaccagtcaaatgagtgtaacattcaataattgtcacttacctcaaaatcaataggatatatattaaacagaaagcttatttggtgtaatatgggtatgtcactcctcataaaatacttccctacttccctctcccagtgattatatatacttatttatactctcatccttaaatatccatacaaaaataattatatatcgcaactaatagtgactttcgaccaaacttctaataggaaaaataaaaaagttgactcttgaaattataaataatattgtaaaacaaggttagagatttcaaggttttccacaaagtaaagaaaataagtgaacaatttaaatatagatatagccttaacttgataactatggaagctagaattttcatgatagtttcctgataaaaatatgcatgtatttttgtctaattaattgtagtagcatataaaggtaccagttgcttttaaacaattaaaaggtttttttttgtttttttttttttttttgctaattttagtatagcaaggatagctttctgtaatataaaccacaggaattccattttgaaactgtgtctagtatactgtacaggtgaaataattactaggatgacacgtagtaattgggtctgtaactccaattaccctgaggcattgactcatttagacttatgcctttattcttcgggtttgtgagataagcttttctgtagaaataaattcagagtatctttcctagaattccaggagtctacaactctcctctccagaggaccagcaagaaatcattgaattatttgctaattgtgagcaaaatttgtattgatttttctctgtctctctagtcgatgttaatagcatcatacttcaggttactaaatacttttcagcaccatctaattgtcaaagattcacttactaagacaaaattgtagacatcaaagctatacacacacacacacataaacacaaagaaaatgatgacacaggcagtttatatgctctttcttacttctctttctcatatgataatgttttgcaatatgtatttcataatttgaaaccaataacaatttgaaaggatattaagactactataccactcagctccatgcttgatttaactgctgggcaagtattaatttctcattgcacccaagtgcagctaacagaaaaaaagtacatcaaaataagtatatatccatattgttttcatcatgttgtcatatcccttaaggatataagcagcatatcttttgttttcctattaaaatcactttatatctgtaaaaatagacactgtatttttcttatagtgcttaaacactgtatatggtttctactacaatgaaactattcccacatattataatttctacaatatattagcagagtttttaaaattaaatatgaatgtccgttctccacaccaatacacaaaactattgctcaataaatttgactaaatttagtgaaatatagtggtggaaagaacagaaaaaaaatcctttgggtgctcacagtagaattttacatgggaaaagctatttctctcatggcccctaaatagttgttaaaatcaatgtacctcatctttgacatctgtttgagcagaatgaatccatcttaaattcccaaatcactttcactgtgaaagaatgcagtaaatgaagcaaaatagtttggggaaatgagaaaatgtaaacaggccaatcagatgctgtttaatttcctggatagccagaagttttctcaaggaaaaatgagatcagagtttgataaaaggaaaacctacttataacccattgctagctgagggaagttttctcaagtatattgagattttaattgatactacaccttgaaatgtttcatagcaacagccaatgctaataagttacttagcactattgcttgatagtccataaatatctgttctgtatacacaggaacagtcatcactaatattttggatacaacttactatagtaagaaacatagtattctgaatgtcaagtgttggaatattcaatactttggccttttttgctgtttattaatattgatgaggttcttcttcagtaatgctgttggattattaattcctgttaaattctgagaacactaaattaaaatagactgttaaaaatttaactttttatatactaaggcttaatgtaataggcttttggttagtactactctgccataagatgctaatgtgcttgagtaatatctctggaaataggttcacaagacggaccaccaaaattatagaataaatttgacatcacactttgcttgagacggaattcattttttatatttatataagttctgcaggagcatcagcgatagtatccttttgaactaattagtgtcttcttttaaattcagagtaggaaatctcatctgctggttcccaaatcaacgttgactaattaaaaagttctagtgcacaacacaatcaagatagaaagaatccatatatgttaaaccttcatgtttggttgtcttgttttaattatagtttgtttctatccttgaaagattgtaagagatggtgaaaagtggtgcaatattgagctactcaaggtcatatgtgtgagaaaaactgttgaatataaactcttgctcattgtacataaagattataaagtgtcgcagtaaatttttcaagctatggtaggcagagcatttataaagatgagtgacaataatttcttctgtccctatacctacagtttttgcgatgtgacattgctcattttcctactgagaggaggagcccttttctttattgcttgaatccgggctggtcttgtgacttgctttgagaaaaataatgcagtggcattgatgggctgagctaacacctcatggggccttgctgattccacatttgacttccaggatcactgatgtccccatgtgaagtagtctggcctatgacttttgaagttgaaattactatgaggggagagtagcccagctgcccagctatatagctgccccagtgaccacaaacagcaccaactacctacaaatgtaaacaaggccacctttggccattcagcttcagtaaagatcccttgatgactgtagatgaatcagtgtccccaggtaagatcaagagaagaaccattcggcaaagtcggccctaatctctgacacacacaagtgtgagccaatgaaataatttttgtaagcccttaagctggctttgttaagccactgagttttgaggttagcaaggcagctagagttaactaatggatacaccttttattatgcgtaaggacaggtattagtctgcgtacatttcactgcctggcacagagtatatattaaggaaaaattattgaatcgaaatgaagtaagtagaaaactttatttcaagagactggcagcttctcgggggaactgggcaaaggaaccacatcccttattgaacttttgcctgtaagagtcacctccagtctcttgctgagctctgggcttgagaccaacattaagcttttcctcaaaaaatcacatataagagccaagttaaaaacatttatgcacaactctatgtgaaaaaaaatcacatgagaaagtgtgaataaatttattatctatttcatttggtgtgattgtgttggtttatttgaagtagaaaattacagatatttataggtatgtaaaaattgtttataaaagttttagctctttaagttttgtagaactactttgaaaagaaaggtaaacatttctaagcatactgagtattcaattagatatgctaattgcttacatgaaaaggtgtaaaaatcataaaacatggaattagtttgttctttaaaattaacattattaaatattctattctataatgcaatattaattaaaattttccaaagaaaacttgagcttgaagttcatagaatgaaataagcactttagtgactaaagcaaatggtcattcgggtcatgaaaacaagatagtaatgagaagaatgaaaaggtctgtatttttaatttccatttttaaatttttaaatatgcgtatggggtaagtgaattttaggttgttaaatatgcagtcagattggcaaatatatatttagggatgagaagggataataaatgtgctgtaagtccatacatcttgaacaaaatatgcgttcattttaatcacagagaggacacttttggttgagtttcattcaaaaaagggaagaaagaaatctgcatctttcattaaaatctccatctagctgtgtttccattagagttcactgaaaaatgactcataaaaccaacaattttatgcatcaggtgacaggttttgacagaaacagcactgcagtttttgcgatatgctacattttgaatgcttaagctgtgtgattaggtgtgctttatatgacttccacgtgcttagctagcaaaatctgagtttatttatataaaattattcaagtgaaaaaaatagtgtctctcacagtgagcaaagtcagatctcaaaaggggccataagggattggctagcattttatcaccaagtgagtccagctctgttaaaaacaagccacagaccttcttgcgatgcacaatgggctttttatttttaactgaccacagagtaaaaataataaatctgccatctgcctgtcaatagaaaataaaataattttccatttcagctctagcaaaataaaaatctgtgtctcctgtaaacacagaaaaaaaaaaatttgtaaagtaataacatgtgtgccagaagcttttgtttgtccatatgagaaatagctcgttgctaatttttagatactctctagacagttttctctgggcatattttagaataattgcatatttgagtcagctggttttatttaaaattgagaatccagttgttagaatattcaaacttactttttttactttgatgttaaatgagacactacactacttgttcttaacatgacatgttgatcacgcagcttcaactaatgttttctagtaagggaagtgaaaagaatgcatattttagagaaaaagggccctggatttccatctctaagcttaatgacctttggaatatcactttctgaaactcagaaatgtacatctagagataataatcccttgaaaagtgaactagagataataatcccttgataagtgatgtgagttttacagattattggccaatgtggtgcctgctgtataatagatacccaagaatggtaattattactattagtactggtatatttaataaatttctatttgtcttacttggatcccatcaattaatatgaaaaagttttaaatattatttgtggatacttatacgtgagatttctactttgtcaatatcaaaatggcagaataagtacagcaagcctaaaggctttagtttttagaaagactaacgattttcttgtgttattcataagtcgaggcaagttaaaggtaaagatagtggaaggaaaatgtctttgttaggtattgtatatgcagaatcgtactttgagataattgacggtattcaagctggataattagagaacgaaattttggcctttattaattaaaattcggagtatagtgaaatttatgaaagaattgcacatttcattgaaggcatatttgaaattctacaaagtcaaaaagcatgttccaaacaccctagttttcttgtacattttgttatattcatccgtcagtttcagcagctatattcattaagctttcctgataccacttttcaaaagtctaaatgcatttgagaatggccttaattctcaaagggaatcagaacatacgctatgtaagtggattcctacaaatttttatttcccagttacatcaaaattttcttcaatagcttaaaatccagtgtaagcaagtttcactaagcagcatttataatttccaattctttctatttaatttgtttgaattttaaagtttgaaaaatgatccctatccatataaaaaccacatttttaatttatttatgctgaaaggatcctccaaacttaaaagaaataaaattcctcctcccattctaaaattattatgattttatagtatttttctttgaattcatatgcttttcactatttagatcactacctttggcttaatgtcctcatgagaagaaagtaatgctattttaacgaaggtccatagggtacaggtatgttttggctccacattgcatcccaatgctagctagctcagtgcttgcccaaagtgcagttttatttaatatatattaagtgaataaatgagaagataattgcaagatctcactctttgactattccaccattaccagccaaaatgtgcaaagtctagttcatttcctctttatctctcccctctcctgccctttgattctcccttctactctttcttttttttgtgtgtgattcttttcaatcattctgactctaaaaagcaaatcctttttttttaatttttttattatactttaagttctcgggtacatgtgcacaatgtgctggtctgttaggtgtgtatacatgtgccatgttggtgtgctgcacccattaactcgtcatttacattaggtatatctcctaatgctatccctcccccaaccatcccacaacaggccccagtgtgtgatgttccccttcctgtgtccaagtgttttcattgttcaattcctacctatgagtgagaacatgcggtgtttggttttttgtccttgggatagtttactgagagtgatggtttccagcttctttcttcccttcattcttcttcctagcttccatctttccccctagacaaaaatgaatatctcattgaattatattttaaacaaggaataattttgaaagttgattcataggcaaaataatgtaaaaatgatccttgaaagtccttcaaatcatttgcaaagtatcatactcattcatcgtgagcagaagagtgagatgttcacatttcatgtgggaaacaggactgcaaagatttccaaactttatttcataggaatattgtttggaattgactgaattgtggaaatattatctttttctcccgctctctccttctgagcatatatatagttaaaatcagataaactaaccatgtttgtgtcaacctttatagtgaatacgaaaagcatgcttataagtgcagcagacactcattccaatcccccaggtacccctttgctatcactggaagtggacaccaattatacattcgatattctcattcacaaaatggcaatataataatacgtaattttgcggttcttttaaggttaaaaaagaaaatgcctacaaagtctttaaacagtactcagtttacagcaagtgctcaataaatagtagctgttcttattactagatccagcttacaagtgacaagattagcattaaatggattcatttcttgaatgtgatattttgtgtcctaaaaccaaaacatgttttttttaaataaaaagcagaatttaattatagaaatcaatgggaaaattaatcccagttgcagaaacaggtttgaatatcaaaagcacacatacaagccaatgtgaattgaattgtaatgttttttgcagttttcacttttcctgttgatccttaaaatgggtatttctcagggttcttgtcaggaattcatccatctcctcaagtagtgtcttctaatctcatgtcttcagctactacatggctgacatttccccaaagtatgtctatggcctaggtatcacacttccgtatagccaagtctactcaacattgccatttaaaaatcttaccaacatcttattctattttcttatttatctaaaccattttactgccttctctattaaactactatgaaattttggaagaaatactcataaaacaaaataaaaataggatatcttctccatcaattgtcttctgtgtcatttttcattcaacatttattgagcaactttctcatcactgcagttggctttgaggcacagagttaaagagaacatggtatctctccaaatgcccatctacttggattgattcctattagtcacaattttaaagcctttttttttttcacttcaatctcaatggctagtcatatccactaactggaatttaatttcacattcacttactattcctgcttgtttccattattgttttatttatgttataggatataagggttaaaaggaattgtagataatctactctgatttcctcaatttacagatgctaatggagcttcatataacttgagactttttcctttgtcaagcagctataataaatcctctgttagaatctgtttgataggaaaaaagtatgtaaaatttagttaatattcctgattatctctgagaagtattaaatgttttctcttgtttagtcctagtttttgttagattcttagattcttgaagacagaaactctaccttattactgttattttccaggttatgtttgagtgcatggcttggagtagtaatttagcaattatgggattaatttttatcaattgactgccaaaatcaaaaccaaataacatattgacctttttataatatgagcttccaggaagaacagtgaagaaagatcattagaagattgaaacatttctgatgtgttttaagtgtcttgcaaatacatgtttttttgctcccccgttcaatcagcacatctattttcaatcctcatttcccgttaatgattggaccagacaccctcattagacattttaaaaaatagaacttgtatgtagccttcttcaagattagcatcttcctcaaagtcttcttactctgggcttttttttttttttaatacttgccggtttatggtacaaatatttgctagcttatttctcttctttttaaatcttgtctgggacactgatattttaatggttactgttgtttaccaatataaacaagattgtgtttgagaaaaagataagcgttcaatttggttattgggtttttgcattttctggtgtcctgccttggtaaatttgcagagtcttcagttggcctcgtcaatttctacacatttccactgtcgtagtcatataggtcatgcccttatgctaaatccctgactcatttgcaatcaaaactctcttgattgcaccctaggtgttatattaagacaccctttcatttagtcattcttatacatttgaggcagaaagttggaaatatttgtattaatctcctgcagaatgatgtttatgctgtgacatcactctaactctctactggcatcatttgtacagaaaattatttttaatccatagtgcatctgacttataatacttcacagtttggcattttgaaaggtgtttcctttgaatatttttttcacatctagttcataagaagccatcatgcactcttaaaaatttctaggatgatgattatttttcattctaaccaattttacttaattgtgtcttctctttttcaatttatttatgttatttgtttatatccattcatttgtggtagaggttgacataatgctaagatcatttgttaggataccatatgaattatcatagtttgaagatcatggttgagttagctttttcttatagtgaacacattcctacagccaggctgagactgtaatttagtctaccatctcctgggtgtataaaagtggcttaaactaggagatggcgagaaaaaatggattagtagtttgttgttgctgatataaagtagatgttaatagtcactagcttgtaatttcaaaaggtaaaattattatgggagaacaaatagaacaatgaaactctaatgctgaccccaaaacagtacatttaactggctttacaataaatagaattactagtataaatagcaaatcttgcatgttgtttgattaatgagagaacattttttcatacctttgagaaggaaatactgaatcattgacggaaacttgaaaaaagtgtttcagcagttacaatcatttacgaaaaacttttaagttacgctaatgaaaagaatgtatggaaacaaatatggaaaaattatgacactaaaaatataatcgctgacatgtgaatatacttaattagggcaaaacagaagtccgaaattaaggaaaagcaaaaatcgttatactctttttctttttgagtcttgctctgtcactaggctggaatgcagtggcacagtctcagctcaccgcaacatccaactccctggttcaagctattcacccaccacaccctcctgagtagctgggattacaggcacacaccaccacgcccagctaatttttgtatttttagtagagatggggtttcaccatgttggccaggatggtctcgatctcctgacctcgtgatccgcccgcctcgggctcccaaactgctgggattacaggcgtgagccaccgcgcccggccttatactcttttttttttttttagatgtttgaggcaatgactaatatgcatttttattcattcattaataaatatcaaatgccatcatcctatatatcatctcatttgcaaagcaattttcacatgtgtttctctttatagtaatgtcctttgaggattgatggcaactaaggagctttgccagttaaatattcctaaatgtggaaggaatctgcaaagtaaatgcaaatgtttatttccctttctcttattaaaaatgaattatcaaggcccagcatgtcttcttgtagtagagtgatagaggaattattcagaaagtattgtcagtgctcatatgtaaccttgaattcttagcatcctatttaatactgtagtatgaaaatatgccataatatcatagcacattctatagaaaaccacacataaatagaactagtaaaaagcaataatgttgaaagctatattattttgtacttacaaagtgaacttttttataagttgaaacaacaagccaataaaattagccatcgaagatcccaaactaagtgtgaacaggagttgctgtctgtaattatttatgttttgttggagatataagaaatctcaaagcttggccctgcttcaaaggaaagaatattggttaggtaggaaagaggtagggggtagtcttggaactgttaaggaaacatttatgtgaaaaaacacttaatgatgttttaataaaagctaaaggatatacagtgtgctggattttgtgtgcaaaactttcattttgttccagttaaatactgagttctaatgtacagaagtgagaaattcagtggcgaatccaaaaagaaaagaaaagaaaacaaacagacttctcttcattctgaagtgccaaggcagccatccaagtggtagaagatcttaggtgccatatgtgctgttcttcctatggggatgacattttaaacttaactgaaatgactgggcttatttgaattctgctggattcttttcacttcatctcaacatgggatggctcttctcagtagaatatattcttagaagaatccacacttactgaaaaaggaggcatatcatggccagtgtcctttcatgtcatgcagttcccatcatggaacacaactcagggtcacagtgtagatatggcaatgtgaggcatatttggagggtctgcatctgagcaccaatttccctctctccccatttacacatcttctttctgtctcaagggtaccaaaggattatttgttgcttttcagataaaccttgctatttgcttccacactgaatagagattacagtcccctccagccctttaaaagtccagcacaccaagctttgccatatgtgagcaatctacaggcactattagccccgcttgagtagctcttgataacattctctaggaagtcaattaaagatgtcaggaggtgggctggactgcttttcttttactaacaggcattcagagagtggaagatggaactgtcagaaacaggtgattttgggttgtcaagaaactaaggctcctgatttgttttgtcttttcccctcattatttcaactttttttctttctgtgagctcttttagtttttaaccagcaatagctatataatagggaggacaaagcacctagtgtaataaatgacaataacatttgcttagtgtaagtttaaaatataaagagagataaagtcttagaaatttgagcgtagcgaaaatttctattaaggagttactttttgtgttaaaatgcctatatataaatacaagttaaatggttattcactaagaattggtcataaaacttgatcggtattatattagagtgattctctgcccttgcttcccatacaacagggatcactttcttttgctacaaatctcgacccttttattttatgtgctttcactgagaaagactatccaaagaagtaaatgactagattttattctaaattaatatgaagcaaagtgtcacaactatttatctaagctaatgaatttaagtgtttaaaccagattattctgtcctcctaagtattattttgttcggtcaaaatagtatttgttaaatattatattaatttaatatttgttaaattaaagtaataatagagaaatagacattttattgtttgagctacaacctagttatatgtttatatactaatcaggacaattatcactgtgggcaaataaatactttataagagactatatataactttaaatatctctatttgattatgcaaaaccatgataatgaatgaaccttgctctttgccaggtatgtgctaaatgccaaaaaactatttcacttaatcctcatcgccgccttagataagaggcgccattatccccatttcacagatgaagaaacaaaaaattagagagggtaaataacttgctccaaatggcatagctgttaagcaacaataccaggactcaaacaaaaggctttcaatcaccaaaacatgtgggcataacctccagagggcaaagaatagctgaagacgcaagattctgtttgtacttgcaattgcagaaaatataacctataagaattatgtgactctgagaagttaactgtctccaagatggtaacatacagttttgaatgttttaataacggtgaatgaggagacagaaaagattgaggctggctagaaggtttgggtttgttggaagaagaagctggcttaaatttttcttaaaaagtgaagaccagtcctgagggtttccgcatacctattaggaaaaggtgccatagttggttatacagaagaagaatgtaacactgatcagcaattcactcaccatcagcttttgttctccagtttttgtttttcttttttttttttatgaaaaaaaggcaattgtacagaatcaagctcatattagggatttattcaaagaagcaagtgtcatcatgaattttgaattaaaaatagatttagcttaatgttcaaaatcaccatctcacagcatggcataataactgattataatgaagaccttagttacaaagctaaattatttttagtatactttgattattaggttaaggaattgtaaaatatgcctgttatatcttatttcatcacaatatttttaaagtataagatctagaataaaaaattgtctattttcaaatcctggccacttttattaactagatgaacttgacatcttggaacttctgtcttttcatttataaacctgcccacctcacagggtcattgtgagtattcaattgaccttatagacaagaaatcttgaccatttagtagacactgttttattccaccccactagacaactgcaatattttaaaataaacattcagaacatgatctttaaaaggttatggatgtgataagaagtgatacaagctactggcttttttctgatcatttgaatacatgaaatttagaagttagtttttacctttgaaaataagaaactactagcatttcaagatcattccacagtgataccttcaatgcatattacattccttactaaagcaagagataagcaactacccatatattgagtaaactcaacaattagaccaatataaggaactttctactaaagttgcatatgtaataattaactatatccggtttagtaatgacaagaattgaaattcgttattcatctgtttattcaatgaacatttattgcgcacctactgtgtgctaaggataccattctagactctggaaatacaacagcaagcaaaatgaacttggttcctgcctttgtggagctagcttacattttattaaaagcagatagataacgaacacaaacaagaatacttttacacagtaatatgtgatattcaggggagaaaacagaggaatatgatatgtgtgatcttgctgcttctttagtttgggtagtcctaacaggggaaactgaagaagtgataagtaaactgagatttgactaaaagaacaggagaggtgtaggaagtcatggggagaataacaattcacaggccaactaaataatgtagaaacaagacccaaggaagtaactggccttgctagaagaagaaaaaggccagcatggttgggaaggaagggagcagaaggggtagatactacgagatgagaggtcatatctcttgaaccttgtaggccaggataaggattttcacttttttctaaatgtgatgggggtggtggagtgggtgggggggtccttcggagaattttatgtaaaaagatgttaacatttatttttataattttgaagaggttcctctgtctgctgcaggaagaattgactgtagtgtggacaggagtaagagtaagattgttgagttggctgctgtgtactctgagagatgttggtgactcagacaaaatgacaggggcggaagtcaggaaaatcgggtggattctgaataagtttcacagtcattggagcttacgaatggtcaggatggtgtgagtgtgttcatgggtgacagaaatggaggagtaataataattccttgagcgattcatagaagatgataccatgtacaaagacagggaagattgcggaaataaagacttgtatggcgaaaaccatgaattccattttggtaatgttgagttactcttagacattcaagacactgtcaagcaggcaggtggacacaagactgaagttccagagtagctcaggctggaggcatgcattttgggatcatcagcatggaggcagaaccagcaggggttcactcagaagaatgtgtggctggaacactccgttttaagtactgacgattttttaagggcaggaagcttttggcaaagtagatggatgagtaatggctagttggaaggaaattaagaaaagtattccagaagacaaggtaaaaaacacacatttaaattagatgcattttaatgcaatgctttcgtggtaatgatttcattatgtaggaattcaggggagaataaaaaaaaactgtaggaattttccacatattaactcttagcaaatatatatctagcacttattatagataaggtgcaatgggagagaaacatggagttattatatctgcattggagataatagctgatagctaatttcccatatttttttccatggccatctgattcttcagtcttataaggtactgatgtattatgaaatgaaggaaattaatcactatattttattgagccatccgctgttgtatggaagtcttattcgaccaaatattttaaatattgaaaaggaaataatggctatattagtatacttttgtaccattttaaatgattttcaattactaataaacaccatctttcatatgactattttttataattgaaaaaaacaacaacaactgggactctgtggtaaaaaataatatgtttttagaacctgcaatttaattattgggctgcttaatatttgagatctattgaaaatatagagtgaactttttattatgcaaatttattcagttctaaaaataactaaatgataataaaacattcttttttctttacatcatattacagtaatgaagctgttacctctcagtatgcattttaatgaattttaactaacattttaatgagccaacattattatagatccaaggattagacaaaattgaatttactggtattgagaaaagttcaccaagagttatattgtttaaagatggaatataatacattttatgataaaccatcaagtatcctgtatgaaaaattgtgctaatggttgaataacattatatttatgctatacatagatatattcttcatcacactttaaaaacattaatgatatttttgtttttgtatattcaatccatatgaaatataaaagacatagcatatcaaagaaaataatattttataatattagatttttaaaaaaaattttctttaaggaaatctctatgaagtatcattataagtttttattttttaaaggaggaatcatttataattttcttgatgtactttttttttttttgagacagagtctctctctgttgccaggctggagtgcagtggcactatcttggctcactgcaatcctctcctcctgggttcaagccattctcctgccgcagcctcccatatctgggattacaggcccgtgccaccacacccagctaatttttgtatttttagtagagacggggtttcaccatgttggccaggatggtgtctatcttctgacctcaggtgatccacctgcctcggcctctcaaagtgctgggattacaggcgtgagccaccacgcctggcctgatttacttacatgaaatagatttatacactcacaacttataatttgagagagaaaaataactttttataaaattgataattttgggtaataattgatattttaggttctatagaagatgtattaataactgtaagccgctctcaactaaaacacagttagtaatacttgctccttcctttagaacctcctcactcaatattctgttgaggcactgaaaggacctaagtctcaaatcaaaaggttgtcatcgaattcgtctttatgtctcttgtgcctagctcgcaataggccttcagttaatgttaaatgaaaagaaatgtccttctcaatagcaaagtttgtgaatttttagtctatctttgaaaaaaactcattagttgaattgtacactttgatcaggctcaagttaaggccatgcttactagcatcctacagatattttattgacatttacatttcaaagcacctaattgtggaaaattgccatttgtgtcactgaatgactcttgtaagaaaccatgtttctatactctcttcgcaactctttgtgttgaatccagttgggaaagacagtataatttgaaaacactccgtcaatatactttttctttatacattgaatttatacattggtaaacatacgtattaataagtagttaatacatttacagggttttaaagaagtataaagtagatgcagggaagtcttcctcccttattctttactttccagtattttttttttcctgcaagtgcatttgttattattagtttcttgtgtgttctttcagagattgttttatgtgcatgcaagcacattccagcatgtttcttttccttttctaattaattaaagcatacaatgcatattccaaacccagctctgaaactcgctcctccaaaaagccttccttatgaaaacaaagtttcctccattttaccttacggcattttaagtatacttgtccccaataattcatactttcatctttcagtttgtggtttttgagttaggtatggtaactttcctaaatctctttagcaccatgaggggaccatctttcattgaaatatcttgtactcctaaagtgtgctatatagagactggaacaacatgtgcagtacatacttgaatttaaaaagtgggtgattgagaaataaaactcttctgttacctcacagaggtagtctcaacaactagagctggttgaaaagtgaaaaacaaatatctaagtttgttatcaattaaacagagcaaaattaaaggtcatattaaaatcaacttttaaaatgaactaggtaaaactcactgggcaaaatttatacttttagattgggaagaaccatggatattagtactgtataacataaaatagtacctctaaatgtgtttgtttttagaattatattatatataaatccctactcgcttattcatagcgatgatcgcttttagcaattgcatagtaattgattgaccccaagacattaaggcctgaaaaattttatatatgggacagggttattgaagattattattattattgttattattattattagttttcttgagacagagtatcactctgttgcccagactggagtgcagtggtgcaatcatgtttcactgcagccttgaccacctgggctcaagcaatcctcccacctcagcctccaaagtagctgtgactacaggcgcacaccattacgcctggctaatttttgtatttttggtggggatggggtttcaccatgttgcccaaaatggtctcgaactcctgagctcaagggatcccccgacctcgtggcctgtcaaagtgctgggattataggcgtcagccaccatgcctgtcctcttgaagatcattaactatttgatagtcaaaggaattaaaaattgacagccattaaactcattgaagatcagatgcagaagtaaaattcaaagtctttcttgtttactatactacttctaattcctaataacagtgattcttttatgaactacttcctttacttttcactgtactttacaaagatcatttgttcaggcttcataacaaaccaaagacaaaggctttttttaaaccttcattttacagatgaaaaagctgaagctaaaatggctgaaggacctgtaataatttaataataaaagtagataatcatctggataataaaagtagcagaacagagacaaccgaggccatctgactaagcccattatctttaccacagtgctgtgttgccttcctgccaaatagtagtagctccataaacacttgttaaatgggagttccaagtccctaagaggaactggcatatggtggaggggatttcgagtgcattccagaaatagagaacaaactgtgtttaggccctaaaaaaagaaaagagcgtgttacatttcaggacctgaagaaaggcctgaggaaatgtgggttgaatattatgattgaagtgacaaagaagaggctgtagagacaattttagaggctagactacttagagttacagggggaggaaggggactattcagcctgaatttcctggaactgtcctgcaataattattaatagtacttccttaggatttcaaaagtgttagtttggaaggtaaaatagaaagttatccaattcttaggtaatgttgaagatttttttttaatttcagaatgaatgaatgcatttcctcctttgctacttgggatattagaaggaaaatgaaaagtctgttagtccatacttcatatccagcacttttatcaactgagagcaacttcagtgattggttctccagtgatatattgaagacatttgtcataaggccctagccctctaaagcaaaggtctttcctttaactaaatatggggaaaatatgtcaagggcagtattaaacatgtgcattagaaattactgaatctgtatataacatttgagtatttagtatccactaatttatttcaaaaattatcccatttgccaacttcagattttttggttgttgttgctgacactttagacaacttgccctacattcacaacagccgtaatttgttcatcaagagtaccgagaaaacaaggttctaattttactatttgtagacagtttttagagggagtaaggttaatatggtgcatgaaaaaagccaaaaagagattaaggcagtttgtgaattttagtaatatggcataatgaagtgcctcgatcatgtcaaaataatggaggtttcgtagactttctggtaaatcttatttatcaagtttggtaccatcccagggagagaaactcaaaccatctcatgcagctaagtaagtagtaactacaatgtagagatttgcttcctctctgcacagaaaggaaatggctatgattattttttatctccaagcattctgagaatgaaagtgtagtaagtcctcaggctaggagaaacagggtagcccagggaatagatatatagctagagactcagaaggcagtactatttgttttcttactgctgagcacatactctatggatggtcaaggtgactccagtgtgtatcagaggaaaagaaggattttattaaaactctactgaagaaggcttctttccagtttcagctaagatgtgaaggtttgattaaagcatccatgagttttaaaatatttacatacttttgggtaaaacacacatataattaattctcttcatgagaactcagtattacttataccttaaaaagatactcagtatctgttgtttgatatcagtttgtctttaggaatgtaagaaactgtgcttttcataagtaaacaaacatcttcaagcacattgttctccaatcactgtcaatggtgtaatatgagttttctgagataatttaaatttggtatttaggatatttgcatgtataaaaagtacttggatatgctccttgcttcctcttctcctgctgaactgtcagaagatggtgatgcttttgaagatttatggtagatgggtaatgagattgctgaatgttaactactgcatttggaattcatttagtagcaaaagaaaagaaggttactgggattgggatagagtagaaaagtgatagagctatttttaatcagtgaatttaaaaatcaatatgatacgttctgaattaggatacatttcaagtctcttgtcatgtagtaatcaagtagaacatttcttgaagaatataggatgtcaaattggatctaattcagcaaaattcatgatagtgtagtgcccatattttgtgatgtggacatatcaaattttaatattggaagactaaggctaaaaaatccacaagcatgtggaatatgtttttaaaattcaaaattcgaatataatctattcagttaggctttggtttatgttctggtgcaaaagaggaacataaaccgtgtactctcaaactgctcatttttgagtttatggatgatgatgtgattcatgtgaaccccctatctaggacctccaatggttatggttacaaaatgtgttgttaaaatagctaaaatgatggaaatggtgaaattagcagaatcaagttgtgagcccatagatataattatatttctactctattcggagatttgttgagtttcgggtagaggggaaagaaaagataaagcaacaatagtgttaaagtaactggcaaagaaggttgaccttgaccttcttttcctttcaaccctcatttcatcagcaggggtgagattactttgagaccctgccaataggtaataaataacacataaattccaggacacccttgcactgtagggtgccctaatgtgtaataatccttagactattgagtttataactcatgacatctggcagttacttggcattgtaattcatgttgatcatgcacatcagaatacacaacagtagagaaatatcggagcaataacacgttgataccaggagaggctagaatgacaagagatgctgctgaaactgtgtacctctgtgaactgtgcagtggaatgctgtaaaagctaatatcttcagataaggactaataaggtgggaggagagaggcgatctgttgggatccagaataatgcagcacattaatatgtacttgataacactctttatttcctttattcaaatggacaactatagctataagtcagtaatgaatcctgaaatttggatttaaatatatacttagatatattttaatttaaaagtgcatgtaaacaaatgtattgaattcaaattttgtataaatatatgtaaaagagatttaataatttaatttttgttttctttggtctaatggtaagggctaaatgaggaaggaatgcagagagttagagaaaaatgagaagcagtagggaaaccaggcaggcattctacaaagcacctgtaacacacctacctggtacctagcagcctaactactttgtctgaagacccgaggcccatgggacatgaaccagactgaaaagctagaagcagacagatggttatttgtaatcatcctgtaaatgtaaattctttaaaactggtgggcttgctggctttatcatctatctgtctgtatctatctatctatctatctatctatctatctatctatctatcatctatctatctatttatatatctatacccaaacccagatctaagaaaagtaggaggcagtattataaccttaaaacaatctggtgtttccccttgttaccatcttaaaaagcactaatataaaaaaaaaaaagccagcctgtgtagttcttaattttaagttgactgtattatatcttctaatgcccaaagttataagcattgctttgagcaagccaagacagttttgtccgaactgggcaggtgctgaaagacagttgcctgtggaggagaacagaatgtgttgggagcatggtgagatgggtttttgttctgcagctgagcaagacattgccttgaacatgtttaggttaatactagcatttctagaaaccatcctcctcacatgctatgtttggacacaatctctaacttgatctggtttctttgagctttctgtgatttcggagacagcaatgccacgtgaacaattctgtgggcgatagctctttaagggagaaagaaaaggaactgattaaacattaatcagcttcaatccacagcttcctcataagctaatggataggctatgcagatccctgtcaaatatcacatgctaggctttgccaaaaataggacttccaagtgttgaaggcatgccaactgctggctctttaactgcaaaccaaagcaaatgattgccagagacaggcctagagtctgccgtggtcagatgtcaccagtttgcagtgccacatgtgatccaagagtttatgaatgatctcaacacttggtccccaaggagaacatatgcattacagaggttatggatacaaattacagagagcgcgatgtttccatgcaatttctaagaatccttcagcaagttttaaacataagtggaaaacattaaggaagacttggcactcttagcaggacttcaaattatattgtgggtgaggacagaacacggctaaaaaaaggattcaagaataaagacttggctaagaaactcgaagctggccattcctcctgtgtgaattatgtttgtgtttgtgtgttttattccctgcagaatactagacttcacaaaatgctatgacttgaaaatgaacaagtcacagggcattcttgtttattcaacatgctccaattcctaccgctggtttatctggatcatttgctcagtgaatgtgcctgtgcacagaatctcattggaggtgggggtgagagcttctcattttggagttgtcagcatgctacagggtgccagagtgtcagcttgcacagcggcccccggatgtctccccactgagttctttctttcccattccccttctgtgcagaagaaaccacttatgacttatgcccacatgttcagatgttattgtctatttaactggtggctagcctgcccatcctgaccatattttgttcaattgtaccaaatgtaataaagtagtttcttgtgaatgacaatctttatcagttgtttagtcattaaaacttcagaaaaatacagaattattatgcgatgtcagtggggagcttctggttgaaaaaggaaacttacactggcttaaatataaaaggaaacatacctagaaagtccagagttagcatagttttcagaattaatttgtccagccatgtccttaagagcccagatttttttacactttgtacatagctccagtttcatcctgaggatcggtctccccctggggtcaaagcgtggctgccacctatagccatgtagtccaggaagagatagggtgcttttttcatgtgcagagtagaagttctgagctgcatgctggttggggttacactcagtcattccctatggtaactggtggtggtggtggtggcagtggtgttggtagggctaggggaataatctgtggtagttttatgagtgaccatcattgttttttctcttagtccattggaataatttaatatgatatacctataatttgtgctaccagtttttttggctgacataaatctgttctattccttgagtcgttgatttctgaccttcttgaactgtctggcttttattttacagatatatgagtatgtagataggcaagccaagaggattctatttcttaaatccaaacaattcaaattgttcttcataaatgacattttaaaatcaaattcaaacactgtggtctattttatatcataaaaaaggggtgcagcacacatcttgaaggagagcacatcaattcaatcaaccaatcgacattatttggttaacttttctgatacccttcaactagagagctctttggagggttacccagtccagttaagtagataaggaaagacttcagatgagtgagtccaaagttgacactgaatgaacagtatgtacttcagaaaggcacaggcaaaagtaagagaacaaagggacagctaggagttacttgcaggcagaaagaccatcatatgccaacttacaatgataattaggtgttccttcatatccctagggcatggaggttacagaaatgtccctgatgagcctggagatatatgcagggacctggttccaaacaacatttgaaatcatattaaggagagaattttatcttaagagccattaaaaagtgttaaaaagggaattgacatgatcacatttgcattttagctaactcataatagctacaatggaaagtttaaaggagaaattagagaaaaaggtcaaataggatattcttacagtaattcaaggaagatataaggacattctgaactagggcagtggagagaggatgaatagacccagatgatattgcaaatcagtgcagcataatgactgtgtataaattctagtgtcagacacactgggttgaaaccctgtgcttacctaacacaatagatgaggctccaatgacctattctatatccatgacgctatctttggcacatagtatgtactcactaaattttagctattatcatagaacaagttattttaaaaatagattaaaagtgtcattatatgtgcctgttaattaatttttaaaagcaagtctaaaaaattcttactgaaaatcagcacataattacatatattatatatatggataagtaaaggctcctgagtatgcttctatttatcataatttactgaaactgtattcataaactaaaatgtatgtcatataaggaactgcttcgggctagaggtcggtcttctactgagaagtttggatgtcattgtgccacataactccagcagttctgatacatacacagagagaaaacctgccggcaggaaagacttgtgttcagtgttgtttgggtctcctgcggttttcaactgctgttggccgtacctttcattacaattatttcttagattatctttctcgtaatgtttagttggttgtggatggtattctttattcaatgatgtgtgccaattcttttatcagtaacattttaggctttacccttctaataactttagttgggatcatgtgcacattgtggtttagaaatgtatctttcagaagtccattagttatacagtctcacttcattgtcattgctaatttgttttaataaactaagatggaaatgactaagtagtgatttgcctagactgaggttaaaaaaaaattctaagaactattgatttaagacaaaacagagagggtttggggtgggaaaggatatgggattataaggaagcaggagccaaagatataagctctaaaatcacagctggacataaaactttttaaaggcactctgttagttacctattgcttcataacaaattactacaaaattcagtggtgacttgagtcctcaagggtttttggactgagggccttggtttcttgccagctgttggctggaagctgacttcagatccttgccaaatgggcttctccattctgcaacatggcaccgtgcatgatcagagaaagtatatgaaaagagagtaagagaggagttcagactttccctctaaagattcaataacttagtctgctgaaatacactgacaatagacatattaacaggagaaaaaggctacatatttactatgcacacatgtgcatagaagccacacaaaatatgagactgaaagaaaggtcaaatacttgaagcttaattattctcctcatagaggagaggaaagtgggagacacaggcaattttagaagaataagtgatttttttgaggagatgaatgggcctgaagaacaaagggtggcctgggacaacatttccctgggctctgggtgcggtgtcaactctggtctttcctcctgcaggatgcgccaatttcccctggttaatgagatatctgagaaaggaattaattgaataccttctggaggacagcatctttaggtagacaggggatctttagagaaagctctttcttccatttgctactcactgggtgctcttagtttaaagtctgaagtggcgtattttggggtatcattttctaagccacaatgagagagagagagagagggcaaaaacatgaaggtcacaatcttttataaactgatcttggaagtggcatcctaccactttgtaacattctgttcatcgaaggtaaatcgccaggtctagttcatgctcaaggggaggggatatacaaagggaataaataacagaagggagtgaccattggagaacagaacaagggtctatcacaggcactgtcatgtcattcttgttaatctatttcttaaccagttcataggagagtgtttgtcacattacagcattcaatacatacttgcagaattttaatttgtcaaaaatctctatgtcgtaaggtagtaatttagaatgttccaattttccaaaataatttcctaagtcatggtgcatcccaatgtaaaaaaacatgcaaatataattcaggttatattatgactagctaagtgaactatttatatgtgttttccagctcacatatggaagtgaatattcgggttctagccaattacatatcccccccacctcaccccatggagatttgaaaccctgtattctaacttagatctgaaagcaagttctatattagaatgtacctaccatatcccttttctttttaaatgaagttttaaaaattctatttttatttgacaagcaatcgtatatattatatatttactgggtacaatgtacacctgttagaaaagctgttatctgaaagatgaaagataaatattggtaagggtgttgagagaagggaacccttgtatattttgttggggctcagaaactgataccctgaaatatgtcactgaagcagtgtccttcgtctggggtaatacccaaggttcgttgcctcgtgccaaggaaatcaaggacatggacacacaaggactgagtttaagaacagaggtttaataggcaaaggagaaaccctcccttgtgcagagggaggggttccgagcgtatctcccagggtgcgacgagatgcggttggttttatagatgagcttgaggatgcggtgtctgattcccacagggtttagaggattggttggggcaggtgtgtcatttacacagagcgtgaagaagttggccaccccatcccaaccttttattatgcggatgagttctgtacctggtcggcacgatgttgcctgcttttttactgcacctgtggcggaagaaaaaaataataataagaagaagaagaagatggagcctccgtgttgaatagacttggcttccaggtatccctttctatcggcacagctgcggcattcacccgtgcaagcttccggcttgcttctctatgtctgcagttcgattttacaaactgctctttttttttttttttttttttttttttttttttttttgagacaaagtctcgctctgtcgcccaggctggagtgcatgaactcgactcactgcaagctccgcctcccgggttcctgccattctcctgcctcagcctcccgagtagctgggactacaggcacccgccactgcgccaggctaattttttttggtatttttagtacagacggggtttcaccgtgttagccagaatggtctcggtctcctgacctcgtgatccacccacctcggcctcccaaagtggtgggattacaggcgtgagccaccgcgcctggctgcaggctgctctttgttagaaattatttggggctgttttttgttaaaagggaagcctcgctgaggacttgtttaccctcactatctgcctaaataatttctagctcctatagcagcacttggacatgctgaactgaagaggaagcctcaagatctctctgaccttccttcctccaaacccccatctctcaatcctctgtgtctcttgaagcacaggatgaagttgttctccaaagtttcttacctgcctaaagtccggacctaccaaagaagaaaaccattacctctggccccttccctgaattttcatgagctcaaatgatatcgcagaaaggaagactgaagttggacaacaaacctgggcaaactttcgtcaaaaaccatcgtccccttgtgagccgaaaagacttagtcccaggctattgtatgttctttaaggttattgaatccgcctaaaaattatctatacttccccatctccctttcccctaagaaacggagtatataagcattggtataccatagcggtgttaggcaattactctgtgattctcctcagggtacgctaataaatttgtgtaccttttctccaattaatctgctttttgtgagtcgatttttcagtgaaacatcagaggcaaaggggacgctttcccttggcccctacaacttggtagaaatgtaaattaatacagccattatggaaacagtatatcctttttctttaaaacacaactgctgctaccctgtcatcgaatttatttctcttcatcatatttaaagactttttggagagttaggtaacacacactgtggtatgtgctcttcttttgacatacgtgtcaagtcacacttgaaaatatagttttcagttctttctagggtagaggatttagggggaatacacacacacacacacacacacacacacacacactcaatttagaatttaaaattgctttgctattttctacatttaccagaccattttagttctcttaatccgacacatgggaatacttcaccatggctaacactttcttgtttttatcggctacgataaagagcacagggcaaaatccaaggcagaaatgaataattagcacaaaaatgggaactgatagatattattttattttacttttcttacatttatgaatgtaaatacagaccccagaaacatataaacaaatatcagaatatacatatcttccttcaaaatttgagaagagtaaaaatgattttactcctttttctaaaaataagttctaggctgcctatggtggaacctgctgaaaagcatgtttttcaactgagagagagagagagaagaaacatattataatatcctgaagacttagggttaaataaatgatatcactaaacacaaatggatttactgagtactatacaaaccccaaagagcacattacaagttgaagagggtacagtatcaattatatcattatctcaccctactctctgggtgaatagtctgaaagcctaaaattacagttgatgttagatttcttggcttcatttgcaaattggagtcattttccccctttttgttgaatgccataagcacatgttttattgttgaagagtaccagtccttatagtttgttatgatgtttttcttctttttgtcctacatgtcaaaggacctttaaaaaaaaatggattgtggaaaattggtgtaacgttgtatttctgaatgatttgcaatggtattaggtactacttgtgcttaggctttttggcataccattttttaggagagcagatctggagaaggcccttcaactggccagctgtgccattttggaacagattgagggcctgcaaaaacaccatttgttgccagtaccggatattgtaggggtgctcatcaccctgttaccatatttttgcacttcttaacattgcataaataggcagctgttctgtatttagaatataaatgagtcaccagcttgctctccctggaggatttacctgcaagagggaaccacggtgttaaccccttctcatcagttgcatgaatgtcacatttaaatgcacactttcctcagcccactcagaagcaaatcctcatgcatataaatcacacctttcttgccagttagacaagggggccaaaaatatgcagttcacagagctaaaatggaacacatttctttagcagtgaaatcagtaaattaatcagcttataaactgagagtgagcaatttgtgctgaattatttcttactgctccttcaataagagacaaggtgctctaatctcataaagggccatgacttcattaagatggaaaaccatgttaaagggtgtgttgcaaaatacgagaaaagaaaaaccctgaagtcactgagttgactctctggagctcttttaaggacagggttttttatttatttggggaatgacaattaacctacagacttggcacaacaaagaagcagagtgctgaagtgggtctcattataggacacggaaggcagttggtttgacctaatccccagtcgcggcacatgatttacataacaggctaccacaagctgcctaatgttgatttcaaacagcttgatgtgtgcatgtgtctgtgggtatgtgtgtgtgtgtgtgtgtgtgtgtgtgtgtgtgtgtgtaggttcattttacctcaaggtactttggaaccaaacatgtcggtgttggaatgtccaagaacagaaatagtaaagccagtcaggaaaagcagaggcagttgcagtatatggtacatttgctgatctcaactacttttttgaatgtttaccctaaaattaatgtagctctgatttaccacctaaatgcagtccgatagggctgagccatctctccaggcttttcatcttgtcaggagcagagaagcacaagtagatagataggtgacatttggagaggcaggcatgccagattttcggtggttacagcgaaggtccaacctgctgttctccttaatgaaaggagggaaatttcagacaggcaaaactgctataagggatatctctgccctgaatgtcacactgcccagatgtcactcggcaggtggagttgcagaatgaaaatgtagccctgcgtatgtgggtgctagtgtgctgcaagggtgaactatgaatctgtcttctgaagtgtaatgaaaacagtgtggatcttgtctatgtttgtgtcatgagaaaggactttgtcaaagaattctcaccccactttccctcacagatcattaggcttgcaggctcacaaaccacatgcatatatatatgcgtgcacacacacacacacatatatgagtttctatatagaaaatagaattatactaatgaagggttctgcaccttgcttttttaattaatcgcagaactgtacatgaatatttctcatttttttgactgatttcatttttaaagttgaatttttgaccaaaggtgcatgataatttagtcagccattctcctgttgatgatcatttatgttggctccagaatattttaaggtggatgtagctatgttctcagtaaaaatccaggcaatttttactagaacaaggtaaacaagacttgaagttaccttgtacaacaaaaagcctaagttactgtcgttgagttttcttttcctgtaattatttttcctcagtgttacgagatgacttccgacaaaaccccacagatgttgtagtggcagctggagagcctgcaatcctggagtgccagcctccccggggacacccagaacccaccatctactggaaaaaagacaaagttcgaattgatgacaaggaagaaagaataagtgtgagttaaattaaaatcatggcccagagagattgaattttcagtctcaaaatacaaaatagatgtattttattctttaacattattaatacaattgtatttgaatgttaattacaatttatactgccttgaaaagatttaaaaacatttggatgagactacaagagacaaaaattatgtaaatcaagtgtacatgaaatattaataattgcaccaatctgagttatatctttacactgcaatattgatattttagctctttttttttttttttttttttttgagacagagtcttgctctgtcacccaggctggagtgcgatcctgctcaccgcaacctctgcctcccggtttcaagtgattcttctgccttagcttcccaagtagctgggactacaggtgtgcgccaccacgcccagctattttttgtattttttgtagagatggggtttcaccatgttggccaggatggtctccatctcttgacctcgtgatccacccacctcagccccccaaagtgcttggattacaggcgtgagccaccacacccagctgatgttttagctcttttataaaatctccagaagcttctgttgatcatgcagtacctgagtgttaaagtataaatgatagccataaaccacattaactacatctaattttgcaccattttcaaaaattataagagaaattaatttaaggtgatgaatatctcaaatgctttttccagtttttccaattgaataatatttataacagtaaaattttatacatgaattgatttaaaaggaaattgaatagatgtaaaataaaatggaaatcaaaacagctgactgattctgcatgtagaaaaataactgttttcaaaggaaatttataatcagattcatcagttgattaaaattcaaaatgaaacacacagaaacaggcaaatggcatgtaatcattttatttcttcagaggatccacgcaacatttgtatgtgaagtttttaagtgagaaccaacccacagaaatagtatgtaattgcttaactttctgatattattcagtagtataatttttatattcaatacaactgagagtgaatacatttaagataatttctcatttgactgaataaatgtgccattttaataaaaaaactataaagtattggtatctattatcttaaaaatatgtttattacaaatgaggatttttcctctgtgcacagtgagattacaacataaaacagaactagataggctgtggaagggatgacaatgtatattcatgcgtttctggtatagaggcaaagatattttttcccttcaccctctaaaggtttaagtcttttagtctgctgaaataaactggcaatagacagtttaatggaaggaagagcatacaaatgtatttatatgtaagtgcaagggaatcacacaaagtataaaactcaaagaaaggctagatggttgaagcttaattaccctcttcataggatagagggaagtgggaatagtaggtgattttagaggaagattaaatgattttcagagaagataagtgggcccaacaaatagacaaagttcctctggcctctgggagaggtggtgacaagttctgggaaggtgaggggcagaactgcactgcaagcaaaggttgtcttattatgtagataaagtctcagataacaaccccaagaagaatagttgaacagtctgtccagtaggcatggtaatgacctttagtttcttctttggtgattaatctttgcaggttactgagatttcagacaggggatttaaggcaattgtgtttcttttggaagaacttttctcagtcagataaggaaacttcagagagcttccctctctgttcttggggcaagtggaggggagaaacaaaggaatgtcagagagacattgatgttaaggaagtttctaatgacttacaatttcctttagttcaaagtgctcagaaagccaaagcaccacattttgggatatcgttttctgagccccaacaccagtctcactattaacactgtgagatctacattaccaaagagagttttgttctcagtggtcttgcttgggtaccaaatttatgaaaatgtactcctgatgatggagtaaaatcattgtttatggattggtagtttatgtttatagcatttagctcttgcctatttaaaggtgtgctggcagctgaataatccaggatgaccttacccacaagtctggcaattggttgactctcagctgggtatcttcgttcccctccttatgatctctaattttccagcaggctagttcagtcggttcccatgttggtctcagttccaactcagcaagagaaggcaagacacaatgtacaagaacctttcttccagtgaagtatttgctgtagttccattggtcaaatcaagtcatattacctagctctcagcttcaaggggaaggagaaatggccttcacagccatttttataagctctcattttattctaccagacagaattgagaacaggttaatggtctttttcacctatgtaaaaaaaagttgaaaattcctttctagaacatgacaagttgtaaatcttgaaacatctctgataagagccaacgtacatgagttgtgtttgcctgtgaaattaaaaaataatggagaaaaccaacatgttcttatcttgtatttcttcaagaacactcaatcattgtaaagctaatattgaattaaatgagtaccaaaaaaaaaaaactggaaaagaaactatgagttatagatttactgaaagcctaactctgctttaatgtcctccttagcaaatacatattttaatattattgcatttgtttttatcagccaataaatgcttctcatttaagaaatcttgaaggggaacctattagatgctaatggtttatactaatacatattaccattttataaactgtgtttgtttttatccaacctgccattttctccaagaattatctcttaaatacaattaagatgaaacaaagatgattaatattaacagttgaaatgtgaattctagggaggcaaagatttttaccgtttgatttaccactgtctcttaagtgtccagaatatgcctagtaagtatggatatatatactttctgaatccctctgattcagcaggattttattagattatttaaaatgaatatctagtatttctttctgatgacaaatgacaatagcaatttattcaaatgaatttcagtgtgaagactaactactgggatttagggaggtcagtcacaagactcaaaatgcgatcaggaaagagaggacagctgccttaaaaaatattttctatgaagaaagtatggaaacttacattgagggtgaatttaagaaaagaaaacatacctgcaaatgccaaaataatgggagagttttttcctttgggaaacaaatatgctcaaatactcaaaactatttattaatgacctttattttctattctgttcctttttcttcccttctcttttctttttgtttgattttaacagatccgtggtggaaaactgatgatctccaataccaggaaaagtgatgcagggatgtatacttgtgttggtaccaatatggtgggagaaagggacagtgacccagcagagctgactgtctttggtaaaactttcttctaaattataaatttttatttttatcaatttttctttgcttttaagtattactaacattaaaaactgggccatataaggacagttactcatgactcatggtaagcagtgacaaattagaattatcttgttttctgtctttctaatgaaagcttcgatgtaaagaaaaaattatttgaaactttaattaacttacattgttcatgtatttgtaagattttgcagttcatcaaaatgtaacgttctttctcaaagtctatttgagatattacatctatctaaagtttatcactcattcaactctcatgcatttatcaggtagctattatgtgcaagatacagggtaaggatttttaaaagttagagagtatagtataaaaaaacttgttttccagttcttagaaattcaaactgaagtatttataatttcaactcttgataaatatactatgtatgcacacatataaattcaaaatcagaaaatggacccctaaaatgagatattttgttatgatattcatgttccttcaactttaagaaccaaggctctccttagctggttaaatgcaattaataggttaaaaactgactagaaccatatcatataaatggtggataaagtattggaaaggagaaaactggggacaaataaagatggccgaggaaacaaatgtaaggaaaatactgcagggcagctgtggaaggttgaaagagagagaaaatgacaaaaaattggaaaaaatagatatgctaaagatactcaaaaatgaaacactcttttagaatacattctatttaaattctatttaaatctctgtatagacatacacatttatagacccacacatgcacacacatacatgtacacatatgtatgtatgtgtatgtacatgtgtatatatacaatcttcattaaacattttactatagcagatattatgtgattttttaggagcaaaaatatcattgtgattttcaaattatttttcagtagcggtaaaataatcctctacttctgtgcatgatttaaaatccctatttctggtcatttcttcaggacacacccaagtgtggcaccaaagccctgcataggtccccagagaaacgtattttgctggcttgggagacgccatcccaaggtgtaatgggagtgccactatagaagagctgtattatgacttccactatatttcaagagttaagattgtgctttgtgcatgtgtaccagaatgcaggcctctcctttcaatcattctgagcaccaggtaatctctggtaacactccctgtggctactaagcagcttgaagtcccaaatgacaaagctaggagaaatcccataatttgttaaaggaattgaatagaaaaaatagaattgttcaaagtatgcatgtaaatttctatcctgcagagctcagacaagtgtcagtttgcccctacatttcatgcagtcctctataagagtctcaagatgtgctccactctgtaatgaataaaacacagttttgcctggtaagaaatgatattagtggtcactgaacgttagcattgaaagcccacaagtatagctcttctatttaaagaaacactcattgctatttttctgtaactaccacaaactctggaatagaaagaaaaaaaaaagctatattactgcagtatagactgccttcagaaggaaattgaaagggtttaatgtcattacagaagcaattagacttaccactaatgagacatccttatgaaatatttactctactttccctaaagaaatgatgagaactactggggattcctaaacatgtcaagagttatgtgggaacttctaaattattttgaaaatagctattatccaaatagattgaatttgtctagaggcagttcccctggcagaattgatttaggaaacggagaatgtttattagatggtgtaagctagtcagaactgacctgaggggttataagtacaagattaagttgaaggaaaaactagctttccattattggtaagaaaacaacatccaaatccaaaagaaaaacaaaaaaaacaaagtgatggtccaaatcaaggatgtgacaagtattgcccgagaaaccccttctgtatcttggctccctattcttagagaacataaaagaaaaaaaaacagtgtactattaatagggaggtcttctttattttatgctggtgctcctacatctaatacacattttccaatacaactctttatattttagcattgttacatattatcatttttgaccaaatatttatataagtaaaactgattgtacttcatactctacctccctcaattttattttcatggagcagcaatttcacttttaaaggtctagctactataaccactctgtagctacagaaggtttttaaaggtcctttgcagttcaatctttatcttaagatatgttttacagaacaagttacattttgttgttcaaaaaaataagtatatatattattattataaatatgatgtaaatatattatattttattgatacctattattattataaatataataaaaatatatataataaagttacatttaattgttcaagaaatataagtcacttgtaaatgtcaagaaaaacaatgaaaggaataaagggttttttccagtataatagctgtctactttccgagacatattgctaggaaaaagaattttctgaattcttcaagtattttgattctagtgggcttgtactttgaagttgtatagtttaaaatttcagcattatatattttaaatgtgccatttgatcatatcaaagatatgatcggtgtaacctaactttaaaaagttactgtgccatactccatgaatcacatattgtggttgatcttctaatagtttttggtcatgaaataacatcctaattaactgggcattatcaaatctaaaaattagaagtaggtatcatagtctacagtagcactgaaatctgtggcccaatctatacaccttcctgaagtatagtccctagaagtttacatatgttaagctctgaagatcctggatggcagagaaagtagagttgaagtaaataatacaatttctaattatgagtagatttcagaaaactgctgtccaaaatttgggttttaaaaatgacatgtggatttcaaaaatgatttttaagtgtttatgaatgcaatacacgaaaacttattttatgtgtaacatttgtaaaatataataagtattacaaaacttagaatgaaatacaggaatctcttgccccaacacaaacacacacacacacacacacacacacacacacacatatatttctcatcattttacgttctgttttatctaattattctgggatttgtttccatatttctgaatatgtgcttaatctgctatttattgatgtatcaatttcatacattatttgacttcctattatagaagatgatgatttggcccacttatagctccttccccaccttctcacctccacttttccttctttttctctttttagtctatgaactttcaaaacattggttatattaatattcagaatttgagttattatagtcatgtcaatattattgactgtgagttgaatgttatagtattatgaccatatttcttttctggtactatttttgttcttctttgaattaataataaacccattttcccatttacttatgctttctatacctgtcatgaattcttgaaatctctaacagaaactataaaatcttctataatcatttttttagactttagctattaagtccccttcactacagtcttccctgaggctgcctgatctgacttggttagacattccttaggtcaacaccgtaaacctaattctgcttttgtcttccttgtctggaatgctggatctgctgttttctgcatcctatgtttgtttctttcttggttaacccctcttttcagaaggggttctcaacttctttctgcttggctgaagcttggagcacattctcaaccaaaatgccttcattctctccagaccttagagttctagtttagaattatactttagttagggaatttgactgaaataatatttttgctcagagtattacagttgtgactctaacatcatttagcatctcatgatgctcttgagaagtctactgtgattctgattcctgtatcctgtatctttgtatgtgatcagttttctttttctttttcttttcttcccaaatgtttggtggtctctttaccccagttttctgaaatggttcaatacattaccttagtttgacactcttctcttttctgtgctgtaagttgatgagcagtctcaatctgaaaactctcaaacaaaacaattcaatgaaatgtttaatttttttaaatttttctttgtcaaacatgttttcatcaattagattttaaacctccttggtttttcttttctctaattcctccttacttatagcatcctgttcttgtttcatgggtattatgacttctcttgtagcagagagtgttgtttttgtaatttgaattttgttttatttttttaccagcttttattaagccccaggtccatgtgcaggatgtgtaggtttgttacctaggtaaacttgtgccatggtggtttgctgcacagattaacctatcacctaggtattaggtcccacatccattagctattctttctgatgctctccctcaccatgcccttttgacaggctccagtgtgtgttgttcccctgatgtgttcatatgttaccattgttcagctcccacttataagtaagaacacgcagtgtttggttttctgtttctgcagtagtttgctaaggataatggcttccagctccatctgtgtccctgcaaaggacatgatctgattcctttttatgactgcatagtattccatggtgtatttgtaccacattttctttattcagtccatgatgggcatttgggttgattccatgtctttgctattgtgaatagtgctacaatgaacatacgtgtgcatatctatctataatagaatgatttatattcctttgggtatctaccccgtaatagtaatggtatttctggttctagatccttgaggaatcaccacactgtcttccacaacagttgaactaatttacattcccaccaactgtgtaaaagcattcctatttctctgcgacctcaccagcatctgttgttacttgactttttaataattgccattctgactggcatgagatggtatctcactgtggttttgatttgcatttctctaataatcagtgatgttgaactttttttcatatgtttgttagccacaggaatgtcttcttttgagaagtgtctgttcaggctctttgcccactttttaatggggttgtttgttttttcttgtaaatttgtttaagttccttgtacatctggatattagacctttgtcagatgcttagattgcaaatattttctcccgttgtgtaggttgtccgttcactctgatagtttcttttgctgtatcacagaattttaataacacttttttttaagtaaaattatcttgtgatgcttctctgcctttatttcctcttagtttctcttccccaccatcccccaccaccatggctccataccacattgttctttgtcttttcgctggaagcttttttcaaatggcacatgatctattgttgttaattcatatttagttgttattctccaaaaagattactggaaactctgtgccaactgattattttcacagtacgatgttcagattgagaactaaccattttggggaagatgaggacagagattggggttgatgatactggttttcagtctttgaatgagagataatagttgataccatgagagtagttgaggtattcagagataacgctatgagagaagatccttaggacccacaccttaagaagtatctgtattttattagtagcatgtggtataagaacatgaggtgttattaagattgttgtcggcaatataatcctttcttgagtatatttattgagcatctgctatgtcccatgccctgtttaagtgcttaaatactaatggtggaatgaataggcagagcccctgctctcacctggactcttatatcatgttatcagcaataacatgaaattttgcctctaatatgtggtgagagaggcattattttcctctgagaacatttatttatatttgtctttacttcataggatgaattttctcaggcaaggaaagttctagccaaaaagaaactaatgcagtcaggatttatttaatcacattcagacagcctgatcattatcattcagtctttttctggaagggcatgacaattcacattcaatgactatcaaacccatccttacctcatacatgcccagttaaataaaaggagacctaccagggccatctgacttccaatttaattgacactacagggtggcaggtctttctgggtgagctgaagtcaagataaggtttacaagcagtggttaactctaatgtccttttattacatagctttggtcttacaggacttaaagaactctacctatgtaattattgccataacactaattttataatgttaagcgaagtttatttttaaaattttatggtcatttgagaaatagctgttaccacacagtgattgacaattttaaagccattttcaatgactgaatacagttaaaaagagaaatttgtttgctgggcacttaattttttcatgtaactaagtaacttaagagatactatgcaaccacatttcagatttatggtattttgtgttaaattgtatatttgctttctgaatatttttgacataactacaagagacttggcatttgattttattatagctgtatataaagttggatttttccaaaacgccattttggaactaaattgacagggctgactacttgagagccatactttacagaaacacactggcaaacaacactactgtcccaagagagattaaccttgtaagcaagttatgcaggtgattcaaatcctgttaatctcacataaaaaaatgttaattgcattggcaaagacattgcctctgatcactctgcagttatataattagagatcagcccattcagagaggctctgatctaattgataagcagtcagcaaacgacccttgagatttcttccccgtttttcaatatgtggtcagacataaggtattaacatgaaaaaatcagtgaccttgttttgacatgttttaaaattaagtttgcttgttattcaatagtttaagattttcatgcatacttattttaattgtacagagctctaattgtccaaactctatggagcattaatagatattgagtgtgatcacttatcaatgtattggatggttttattatcaacttactttctaatccacctagcttttcatttttttggagatgattttgagtcaaaaggggagactcaagttacttccttataatttttaaaatttgtgtctgaaaggggcttggctttgtgtttggcttattgtaacggttgccactgcagatccaacgcatttgaaatacatttttggcctgtacaacttctttagtcttcatatttatgtttctgattctcagattttctggaaataaagttggttaagaaaagtggaaaatagttcttacaaaaaatttcttccatttaaataaatgttaggcaaacctacagtttttaacataatgttttctgtgggtaattatgaaaattgcaaagcagaaggtcagtttagtataattaacagaaaacaattggaataatgaataacacagtttagagataattgttagaaagggtgctatggaaattctcagaataatactttaaaatatgtgaccaagctccagtatctcaggaatttcccatgtcacatgttggacagcacatcctaatacccaggtataaaacccatgttgatgtgtcatgtatgtgcaggcgactttcatctcatttattctttgcctttgttttgctttgatttgtttttctatccattgaattacatttttcaccatgagccaatgtcagacttccaaaaattgtataccacatatgctcctgtggttatccagttgctaagcaactggactctgcttgagggtagcagggtagagagaaggttcattgtgaagtcctgcacccctgctgagttcatttgaacagcagcagggatcctgtatcttgattcttcttgaaattataaatcaagtgcctccacgtgtctccatataaaacaatgaggcttagaacaagtaccatgactaaaaaacccttagggatcctaatggtatccccttgaggaagggacagcttagttttgagacatctctgatgtaacgtttgccatttggattaattatatgttgtgattttgtgactgttagcatgttaaggaaagcatacacaaactttgcctgaaaatataagtattttaatggaactggtctcacatattgtttttcaatttattttatacccagcataatgtcatgaaaacttttcatgttagataggtagatagttttaatattgcaatgacttaacagtttttcaatgtataagtttgctgcaatgtatcctaaaatctcacattttccaatattgtcagttttgctgcaattatcctatggacttcttagttttgttgcagttatcaattatcgaagccactgttctgcattgttatattttgcagagtgtctgcaagtaatggtggctttggttcttcttcagggctcatatttcctttttcttactgatttttaatgtcggcatgcccgtcttgttccggacttcaatgggcatgacttttgtattttactttttttttttttttttttgggacggagtctcgctctgtctcccaggctggagtgcaggggcccaatctcggctcactgcaagctccgcctcccgggttcacaccattctcctgcctcagcctcccgagtagctgggactacaggtgcccgccaccgccccagctaatttttagtagagacggggtttcaccgtgttagccaggatggtctcgatttcctgacctcgtgatctgcccacctcggcctccgaaagtgctgggattacaggcgtgagccaccacgcccggcctgtattttacttttaagagaattttggcatttaatttcttgcaaaatatcttcatcacgtttaaaaagtctgtttgattccttctttatttagatgatttgtaatttgatagctatatctacagatttgatcatatttatcttcatttctcttcctattatataagtaacctcctttatctcattgaaaatttatttggcttcaagtaatataaatctgccgaacaatggcttaggcataagaggttcatttttctcattcttaccatttctatgatgaaaggagcttacacacacaaactcacacacacatgcccacactcacacacaatccatgttttacctgccagtctgtttcaatttgctaaatgaaaagttgagacatttccttgagtttccttttcaccctatgcgtctgactgatcacccagttttgatctctcttgtctgtccccttttcgacatcctatgaaccattgtgtcagtttaagctgaaataatttcttacaagaacgctttgacctaattcacgactttatgtttctcttctaatttatctttcacagacataccaacacgacctttttcatatgcttattcaacaagttgcttacttgcttaaagtccttcaatagctctctatcaacctcagggcagagctcacagtccttgagtggtgaacagggccttcatggtcttatcactcactctctgtctagctttgtctctcaccactttccccaatgtaactaacctgctcactattcaccagcttgaccacttagtgaaagcctctaggagtgggtgcattaacatgtgctgaatgagtcagtggatgagagaaagacttctctagcttgttcatcccagtgtcaggatgtagtatgctactcccactaaaatcaaagggaacaggaaaggtctcctcttgatgaatcatttttcaatctggagtaatatcaatagtgtctcaaacctctttaacattgggttaatgtagtttttggatgaatagctgcgcctgatagcacagaagaagtcgatcccgcttcctatgtgaatgatttattttttactattagcatttgggaccctcataaggatatattaatcctattgcctatttaactaccagaaatgatagctcaataccaactatgccagccccaaaatagctgttttgggcacatagtgtacagagttgaaaaaagtaacactaaattattttatccgacatgttgtctacagggcacaatttgctgctaatttattcagggcgtctaaaatctttagatgcaaccgtgtttttctttagtttttatggatcgtttgtcaattctgcatttacaaaatttttcatgatgaaattctatttgtcttgttttattgcttgggatttttgagtcccagagtacggatactctagcatatgcagaaaattttgatccctactgtcaaattctctggagatatacaatagtcttccttctaaatgccaatggtagttggttttattgcaataaaatatttatcttgcaacttacacatttgttttataaatatggatcttgatttagtcaataaaatcaaatactcttatttatactcttaacatctattatttgaagtaatttattttctttgaaggtttcctgccgaatacattttagtttttgtgccactgtatacaaaattttaaattagaaggtttgaaactcaagttctaagtggctaaatatgtccagatggccagaaaaattgtgtcagcttcctacagatctcatctttcttttccttggcttagttctctttctacctcagtaagtagcaatattgaatttgtttgtgatttgcagatatgggctaataaaatttaaatgacaatttttccagtctcagaccattatccaaaagggaagaaactggacaaggaatgccaatgtctggtgatacataaaactactttttgatttgtatcctcagaggctaagaatcttatggataggaaaagatttttatggatacagacttatttttctctagccttatgtagaagagtgctagaatacaatttaacagtgccaaatacagattaataaaagaagaaaggatgaaaacagtaaaacagattactgaagaaataaaaaacataaaattaagtaaaaaaaaatgggtagatatctcaaacacttaagagaagaccattggagaaaacctcaaaaaattgataaataaatagtttgcaacaattaataatgacagtctttgtatttaagaaaaaaaatcaggtagacatctttccatacatgaagttaaaataatcatgggaatattgagtccttatcaaatcatagcttaagtgggaaaatctaggtaatacatatgtgtgaaagtacacattttttggttttctctagcattcttgaggaatattaatatttgttttttaaatgtttttatccctttcaacttttagttttcccactttgaaccctgataatagattattgtaatcatttttaatctctctttttcctgtagaattcagtgttctgattttttatgataggatccacctgatttagctcagggattcactgaaaaatcaatttaatatttttttccaaaggttgtatggtcttatgtgcaaactgtagctattcctttgttccaaaatatcttattttattgaatgacattggattcacaaggccttattaaaacacagctgaggtacagagttaggtacctgtgtaccaaaagtaaattaggtttcctttgcttttttcataatgtacttaaagcatgcataatagtttatctcattttaccattgtttcattttttttttcaagaacgacccacatttctcaggaggccaattaaccaggtggtactggaggaagaagctgtagaatttcgttgtcaagtccaaggagatcctcaaccaactgtgaggtggaaaaaggatgatgcagacttgccaagaggaaggtaagaccaacatatggatggaagattgttagataaccaatgaataattagaaaataaaaggacagctacaatgccaccaccaaacactcctatgtcttggggtactttcactcatgtgatttttacatatgcaagccacatatttactgtttgtatgttaaagtcctccaggctttcaatgtcactctttcaatgagtatctacattaatgcttgattcttcattccacctcttatccccagataccaaggattcctgggtgccttctttcccctggaccctttgaggtataccattctgttcctgcagaatgccccctgcaggcctccatcaatgactgcccgttcccatgcttcatcccctctggataccctttgtcacctctgtggcccaaagcataactaacaaaagactattgcatgtggctgactgtaagtcctggagtaaaggaaaggtcagcataacactgaaatggtagcaagtagttggcatcatttttcacataggggatttccaacacagagaccttctgtcactttcttttttccatctcttcatggagaccttctcttccatctccttcttattgttcttatcacaaaacccccaaacccaatctctcaaactctaacctgtattcaaaaatgcttttcatcatatataaaaataattttgacttgttgttatagaaatttccttaaggccttgccatttagaatgaaataagtaattcaagtgttttttgttgttgttgttttaacacaagtaattttatctttaagatttgttatgccttcctgctagttctacctgctgatattataaccatcatgcattctccaattactgcctgcataaaattgtacaggctgtgtttttctaatttttcttttttttaaaaaaaattttttggctgggcacgatggctgactcctgtaatcccaacactttgggaggccgaggcaggtggatcatttcatgtcaggagttcaagaccagcctgacaaacagggtgaaaccctgtctctactaaaaatacaaaaagttagctgagtgtggtggcacatacctgtaatcccagctactcgggaggctgagtctggagaattgcttgaacccgggaggcagtggttgcagtgagtcaagatcgtgccactgtactccagcctgggcgacagagtgagactgtctgaaaaagaaaaaacaaaaaacaaacaaacaaaacaacaaaacaacttcgtttctttcaactgactgatattaaccatgcttcctccgaagctgtataccttttatgtgctttcactgctatcagtaatttcctaaatgtaaacattcatttcaaaatctcaattttataaatccctagatatgattggatactttacttcaaaaggcatgtcactcatggattgaataaactggattcaaatgcatcaaccatttataatagttactgagaggttctttacaatctacaggaataaaacaagtgaaaacattaattcagttagtttttcagcctatgtagtggggaaagtcatcattgtgtttgtttcatcattttaatgccagacatctgtctttaaaggaatggtattagtagaagaggtttgtaaatgtgaggcttttcatgccctctcattggagaagcaggttagaaaacaaggagagtttacactattgaattgttactgtccatcctctatatatagtcagcaactttcttcaaatttgagagcatgtagtgaataattttaaaatattaatgtaaggtgaagagattaattctatagtaaaatttatcctagtgtaaacacaggtttattttaaataactgggagtatatgcccttgtgcattgaaactttaaaaacctttaattttagaataattttgatttataggaaagttacaaaagttagtaacagagagttcccatttacactacacccagttttccttattgttaatatcttacatgacaataaaacatttgttacaactaatgagcaaagcttgataggtaataattaagtaaagtgtatacattatttggctctcccaggttttcatcattgtcctctttctactccaagtccagttcaggtaattattgggttgggtatcatagacttctgcatttgttctcatatctctccagtctcctccgtcctgttacaggtccttagtttttctagttttgtgaccttaacaaccttgaagggaagtgctggccaggtatgctatcgaatgtgccccaaacttggattagccggattagactgcgtttataggtttttaaaaagaataccttagaaatgacatgctcttcttagcacattgtatcagggggcacattatatccatataacagcactggccaccctgttaattttcaaacactgagcacgagctagttgacaaaagtattaaaaatagagaattgtaagtgtgcattgcattttaacatgtctatgttcctgaattaagataaaataaaaatgaattgagcctagtttgattatttccagcttaatgtaggtgttaggtcataaacctgacaacttaagctgctacactgttctctaaatcttgccaaattcatttgcttcaaagtacaaatgatacatataaatcaaacaacagcattaaagctacactatcagaaggtatgatatcaaggccactaaacaacaaggttgaaagcatgagaaatcttattttcactaacttcctttaaaacattttcatagctttggcctctttattctttttaccagcatattatggtagtactttgtgtaaccagttaaatattttaaaaatattagacaaatggaagtgctgtgtaagctttaaattgtttttgttagaaaggcttaaagcaaggataagtgcaatgtagaaactgaggtcagtatttcatcatgaaagaagcatgtactttttcttgaattcccagtctttaagtgatgtttcagaggagtttattcattcctcgatttgtatgtattagcataagcctcacttatgcataatgagagagaaagacacctctttccttggtgaggaataacagtaataacttttagccaaccgtagactaaatcaacaacattgattctattacattatttaggtctcagactagggagatggccattgttcttgtataagcaattggtgtggtgcatgacatttctttggcttaacatttaatgaaatttgaataaggtttgtgtagtggttcatgcttaacacatttatacgaaagctttgtagggcagctgcatagcctgtaattactatgtaagtaatatgtgactatttttcttttggagacaagaaaagcttttcaattcaagtttaaatttatgaaatgctgtgagagctattaaaaccttcaacacagaagaagatatctgtgccaacctttcagtaaccagagatgagttaagggagtattttttccccttgccttgaaaatattttttaagtagtactgatatgcctctttcttttatttagtcttaaactcctgacctttctcagtaactacctttaatgaaattacaacagactcttagtgagttgtattaaaacattttctgaaaagatgaatgtttcagtttggtaggaagcatagcaagtctaacaataacccttatgctcaactagggaaaattatttatgtggacattttccatgcgaccaagggacaaaatggaaaggagtctacattatacatattagtgccaaactgttaattccttgcagagacttctgaagatattaccgtttcacaattgagtatttcaggaagcatactgattctgtgccaagtaccaatactgttttctagaagatttcaatacatatgtgttagggacaaaaatttcataacactaacgtgagaataaagtgagtaggaggaacaagcaagtgaaaggcattttatagtttataatgattatgatttttgaagcacatttttaaagcataatttaaatagaagaagatgcacttttgggtttacctacatttagtgagtgcctactacatttgtaatgctcattgcaagtttgaaaaagtaagtcgttttaaacaaggtaagttaactgttatcagttctttagtttttgttttatattagtgagattgggtgacgtgggaaagtatttacattccaaatacagtaaagaagtaaattggaacagctctagttattttcttgggtactgtctgtcttttgcaggcaaatatccaacattttgcttattagtactgtcttgatagagtgccttcaatacatcttttcacaaagtgttttatgtgatagaagttgtcagtatttataataaatgaggtgagtttccatcttatgccatgttccctcataacataggtttattgtatattttcgttatataaatatatttatgtgctaaagctctgtaaaaaagtatcacatgaagaaacattaacataacacaagtaacatgccataaagaaacagtataatacatttgtaaccaaagatataaaaataaattgaaatatgacaacactacaatattctgttcaatttaatattaatgagaattttaaaaaaaatccctctcagaacttgggtaagagttagtgtgattaatctaattgtgaattcttatctgtgcatgtcagcagagtttgtatttcatttcattattagcagtctttaaagaactgtaaacaggagatttaatatctctcatcaatcatataactttcagcatattaccattacctcctttatcttttttatttcatttttattttctaaactaactctaaagtgacactaagttcctcaataagaacttctctcttccacagccgagaaaggaatgttcataatagcttgtcagaagaaaaaggaaataaaatatgccatttacatttttacgtatgcctgcaaattctaaatgcagttgatggcttgcacatagtggatataattaatgaatatttcataaaatagaaaagggagtagagaataagagtttcaagatatatggagcaaaattctatcaattttccttaacccactgacaaaatttccttttctaaagtgcaagtctattttaagagagaattttcagagtttttagttccatgaaatgtgagatttgcataagcacatgattctttaagaaaagaaactgaatggaactacttataattcctttttttttttttggatggcatttttatacaaagtggctctttcttcttagccctgcaaaatgtgtttagattaattgtttggaagctctattgtttagagcatgtgcttctgggacacagagatgctgaacaggtgctcagctacccttaggaggcaatgggccttcttcacatacagtgtatgcatcaaggacatgggataatttgagctcctgataaataaccacactgattaggttggctggtaaagactgggcaagtgaaatggtcttagcaaaagaaggaaaatctaagaacaggagaaaagcaatgaagcaatgtgtacaaaatattgtaaatgacatctaaaaaatggactggttcctaaaagtcacaaatttaaagaaaaagtgtaaatgaaaaatctttattttttatgctatacagatgtcttatccatgtctgtctaaaaacaattggaaacttcatgagcaatgactgtgggaccttttaatacaaattacaataacatacaaatatttaggccattgccaaggggttttagactttaggccttgttctgctactgtttgatcatttagtttatttacactgccgttttctggaaatgatagttgacaaatttctctactgcaaactaggaatgtgatcttgaagaagctatttaaactctatgttttacatcctgaaaatatggcccagcaatgtggtaggactggtgattaacctatatttttactgatcttatagggtgaagaattatgccatccattctaactcaaagggctattaaaatgatataaccatttcaaagcactgtaaacattgtacaatggatgcacatacatggtgcctcagttttacaaatccacctgattggtggcatttattaataatgcagttaactacagggaaaaaaattaatgctaaaaaaatataaaatatataatttgtatataatgacacattttcctatctttggccatatgatttccatagaaacatatacaatattatttttaaataagtatcacttacgctttttttttttttttttgacggagtcttactctgtcacccatgctggagtgcagtggcacgatcccgcctcactgcaccctccacctcccgggttcaagtgattctcctgccccagcctcctgagtagctgggactataggcgcccaccaccacgcccagctaatttttgtatttttggtagaaacgggatttcaccatgttggccaggctcgtctggaacttctgacctcatgatccacccgcctcagcctcccaaactgctgggattacaggtgtgagccaccgtgtctggcctgcttttaaattatatagattcatttataaatgtttctagtgactttgccaagtctgaaagttgcctgcattttctacctttagtaagctatacattctcctggtattgtgtgccacctccagtgcaatcagtcacctgggttgagaccttcacatttcacacatactgttttgtttgtctgtgagtaataagcataaaaccattattataaaaagatgtgtaatgttaaaagcaagtatttagggaggacttaccatgtgccttacaatgcaataaatgctttttacatatgttaattccattatttttaaagcatagtattacagcataatattactcctacttgagggttacagaaacagaagcttaaacaagttaggtttttaaggccacatattaataagcattagggccagaactgaacttagaatctgtctagcatgaaatctctattttaaatgagagggcatgataattatatgattattaattatttaaggatttgagtcacctatgaattttatattttagatagaaacttagataattggttagaaatactatattatgaataactaaataaacatagtatacagcaatagagttaaggtaatttttagaccaacttcgtaagccacacataaaatgtcttgacattataaaaatttaaacttagaacagttcaagtttaccttcttggaaactgaagatatagattttgtttttacaaacaggattaattgacaactttcagagggatgacagaattgtagttttcctgtgttttcatcaaataggtgctaatagttgctgttaacacaaaactaattgccacctacggtggggagtgcaagttgcctagtcctgtgaccacattggcccatctgttaagaatctcagcttaggaacaatgctggaactggcatccaatttgggttctggccagtggtcaactaacaagctggaacacacatggaatatgaaatgccttgaagtcagagatgctctgctgtctgttaactgacagctcttgtgtgtgtgggcagagccaagaccaggtgccagtatgcagagcaaaaggatctgtctgtgtgccacctgtcattgccatgtgcgtaatgtccaaacaggagccacagtaggtgtgtttcttccatcaaagtgtggttgttagagcattcagttaggctgaggtagcgactagggcaacattttaccttaaaccaaactataggacaagccagaggcttaccagaaggtagctctcatatcccgccatatcacacaagtggatggagatttaccactggagacactctcccctgtacctaggttcttacattaactctaagcaaaaggtaaaaaaaaaaagttgtttaattaattatattaacacaaatacttgtgtgcacaagacaatttgtggttagaatcatgcaaataagttttaatcaccccaggggttattctaaaaatatatttctaactgatttttgttattattcttaataagttgaactgtaacataaggctgaaaggtataatagaatttaagagatcaatgttcttatcccagctctgccataattcatcatgttattttaagcaattcatgtaacatgtctgagtaccagagtccacatctgcaaactatgttggattgaatggtttcggtgctgtcctcaaattctgaaaaattgtataattctatgtcaatctctcgaaacaattagagaatcacggcaatattttttttcaatagaagaaaaaaagaaaccagaaaattgaaatagatggacataaagaagaaaattaatattacctgtgtatctattatccagtgacaactacattttatgtatagaaggcatcttgtaaacttatttatattttagacatatttttcattcaaaattgttcttgaccctgaatgcttacttaggcttttattgttaaaaagccggtactgattcaaaatagctgtttctgactgcattttcctttcccataaatataatattaataaatgatatttacacagtgcttactgtataccagaaataatctaagcattttacaatagtgctattttatttttagaaaatgctatgatgtaaacattattatacctataatataaatatcaaaactgatatgcagagagggtaaatatgccaacatcactgactatgggacctaggatgtctggcttcaaagtccacacttttggctactacatagtggtgctgagtgggaagaacttttcttcattttttatttgggattgaagataaggaaaagacagcctagcatatgcttgcctagaagtagaatttttatcatatagtcacagaatacatctatatagaaagcacatgttaaagttttgaaaatttttattataaggacacttatttcccataatatatgtttattatgtcaaataaagaagtttatgtcttttcctttaaaatcattattttatactacttattgacacaaaatttaaaacaaatctattttttctcatggaatgttttaacttgtattcttttcttctcaacactatattgggtaagaaaaaataatttcactggaaacatattagaagttaaagaagtgcttgctgaaagagtcaaatggtgtgagtagggtgtgattggccctctccatctatgggtgccacatctgtggatttaaccaattctgataaaaaacattaaaaagcaacaataaaaataatagaaataaaaatacagtattacaatgatttacgtagcatttagattagatatgataatctacgatgatttaaagttgcaggaggatgtacataggttatatgcaaatactacattattttatataaaggatttggacgtcctcagcttttggtattttcagggttgtggggatggcagtcctggaactaagccccagtggatactgagggaggactatgtatacatctagaatgatgaactcttctagggtattgatagtttaattcatctttcacattcactgtctaacaaagttctcagaccaaatttaagtgtactaaaatatggtaagtatagtcaataataacaattctatattttaaaataatttaaataatggaactggattgtttgtaacttgaaggataaattcttgaggggatggatagataccccattctctacgatgtgcttatttcccactgcatgcctgtatcaaaacatctcacgtaccctactatgtacccacaaaaaattttaaatataaattaaaaaaataataataatataaatggccaggcgcggtggctcacgcctgtaatcccagcactttgggaagccgaggcgggcagatcacgaggtcaggagatcgagaccatcctgactaacacggtgaaaccccgtctctactaaaaatacaaaaaattagccaggcgtggtggcggcgcctgtagtcccagttactcgggaggctgaggcaggagaatggcgtcaacccgggaggcagagcttgcagtgagccaagatcgcgccactgcactccagcctgggccacagagagagagtccgtctctaaataaataaataaataaataaataaataaataaataaaataataataaggctatttggaggaaaaaagtttcttcaaaaataaatcaataggtactaagagtatgatttttgctaatttcctgataatgtttgaatatcaatagttccatggatggttatgagttaacaggtaggactgagttctaggctatatattttctacccaataaatatttttttcatttttttaaaactatgtaatggtccctcaggaaaagttgtaatttgatactattattttaattaactggtatgaattaaaagagaagggataaaaaagaataatttctgagatccagtactacaattacatgaacaaggaacatatctttgttagtgtatgaaggagatataattgccaaatataaggaatgggaggacaaatagtttcaaagtatttcagggtataccctgatccccttcagtgaagtcatttttggggggatctctgttttagttgttacatagtataactcactggcgcttcattttaaaaggccatatttggaggtgggaggttagccctagggctcagtgagtccttgccgagaaattagaagtccctctgagaagtgattcatcatatagacctatgggataacatcataataagatctcagtataaaaattctgccagttattcttatgagcatgatgttaaaattacaaaaggtattgtaataccattcaactcattcatcagtatagacatttgaaacctttataaagatgatctggttgggtatgctatatcattgcaattctttaaataaatggcagttgttataaaaatatgtcctatttctgacacatggtactcaccagttaagacattcagtgcagtgcttctcaaaaaaaaaaaaatgttcaattaaacccataaacattctaacccactaactgacattttctaacagtttgtccaaatatttaccaccacaaataacagaaacaaaaaagtaaaagagacctgttatctttatttgagagagtatttaaaagtgagaaagaaaatgcttttgtcttcattatgaacataatttatagtaagacatatatatagttgattttctcaaacgtaaaccccaaatcgccagactagtcaaatattatatatcaagaattatttcaaaaataatcccattcattgaatattctgtgttgatatttcaaggaataaaaaaagatgagattgttctcaaggattttagtaggtagtgtgagatatgcataacattattaaataaggtgaactatatacaaactatgatatttgaggctctttatggcttcagaaaataaaagatagtctattcctatatgaaactagagataggtctgaaagggaaaattgaattttcataagtggaatagcaatggctatttcaaaagaacgaagcaggatgaaaaagctttggaaagcgtgggccaacaattagtgattcggtttgcctggaacatggaggagtggcacttaaggccacaaaggttagttgtggttctattatgaaaccctttaatttcaagtgaagtgtttatatggaatacaccataaaatggggattaattgaagcacattgaatagaaatgcatctttgtgtccacctttagaaaactgattctttcatgtagagtagcttggaacagagaaagtttggaagtaggcacacctggtaggaagctgaaatatagtttagggaatacattgagtgtattgtgtgagttacacaaatatggacattaatacaagtggtcatacaagaaaacctttttttttttcaattggcaaataattgtatgtcagagttattggaaaaagagaaattaaaaattaatgctgagatttgtaacttgggtgcctggtcaaaaggtggtgtgttcaataaatagagaagtcaaaaggtattattcagtctcatcatttttaatcatgtaatagtattttctatcactgaatccaaggtagaattgattgtgagatttagtagtattttttctctgagttaaggagaggaaaaatgaccaaatcaactatgatatgccatctatgataagatgattcctaattctggaggtgttaaaatataaaaatgtgcatcttaaaatatattaaatatgggagtaatagctaatatttacaagtgctttccttagaaataactcatttaatcttctcaattttcttatgaaacaggaactcttatcattgttatttgataaatgaagaatctgaggggcaaatataaatgagagagatttgaatccaaatccaaatccaaagcccactttcttgactactatatacagtaatttatttctagtaaaacatatttaaaaataatggcataaactaattttattttaagggctcactggctttctgcttagtggctacacaatatttttaattaatgcttccagcagccttaaagtttgagtcccttctttaaacagaggagaaaactgaaggttagagacagtgaaaaacatgctcaaggtcacaggaaacatggtaacaaaactggattcaaacctcaggtctctctaatattaaaagcttgtgctcatggcttatgttggacccaggacgcccttcattccatgtgttagtcaatggctggtgacattttgttttgtatatttctatataactttctaacttgaacaaactcatacagagtccaaagttcagtaaacagaaaataaagtgattcttctgctcaaaatatactgcgtggtgtcccagtgtctccattgtgcacacttggaacaactttctaagagaaagtagtgctcagatcatcattattataattatttctttatctccccaactccctttgccttatttatgtttaatcctaacaatcctaaatatccagtcctatgactgtcacatggtgctcacgagttagtcctttagtgcagtgattctcacgaggggcaaatttgcttcccccatttcctgatatacatttggcaatgtctggagacatttttgattgccacatttgggagattgggtgctactggcatctagtgggtagacaccaagaatgcggctaaacgtcttactatgcacaggacaactcccacagtaaagaataaataatctgacccaaaatggcgatagtgttgaggttaagaaatgctgatttcatggaaaaaatcaatctgggcattgctcaagtagttattttatgtaatttttattttttgtttttaatgttagggcaaaaataatagaatataattcactgaaatacacttcgaagataataatctttttttgttgcctgagatatgatggttatacaaaatgagataaatgaataatatcataatttggtttgatataggcatgtcatcatttaacacaagaagaggacctgttggttttctaatgatttgagatgaatgtatatttttgcaccttttctagaatatataaggcagataatttttcttcatattccttgcacatcagatagttgctgaattggcgaaactagtaaagaatatcctaattagagaagtgtctgaacctcattttcaaatagacctacaaacccacaagttatgtgaaacatttaatgatcagaagtgttcctatgaggttgtatggaattcatgaattattccataaacacatttcaagaggaagtttctcttggcaaaagaaaaaagaagaaagccttttgaatcttccacagcatctcggactgaacatccctctgataatgtagtcacttccccagctagttctcagtttgaacactgatgaaggagacttcttagcatttttccaacaaagacagcaaggtcgccaaatagatggcacattcggaaatacattttaccaattttaccgtgaattggctgtctcttatcacagcatttcttcttgcacacagaagactgcaagaatgggctctgcctatctaaaaacttccagtctgagctgtgagctctgtggattcttgtggatgtgatccctaaagtcctgtcctgaaaggacttaaagttgggttaatttctacccaaacgcacaactatgagctatatctacttttccaaatctaataatgcaatttctagtcctattgtaaaaccagttttgaaagtatttaatccagtaaaacaattatttctaaatgaaaggataacttaacttgcttccacaactttatttgttccagtaggaacaaatgttcttcttagttgttcttcttagttgtaatatatttgtatttttaacagtaaatttccaagttctacttattcaagaacttattgaaaataatacctgcaatatttttaaagtatttaaaagtaataaattcaggaagatgcaccagattttatttaaataatctatgaaaagttactggaaaaattgccaaaagagtgttgcatattaaggacaataatgaaaataatgaaatactcctttctgatcatgataaaccaaagaaaccctttctctataatctaatctctataatgctttggatttgatcttatatgaatgtagaaagaagaagtacatgatttcacaaagcacatatgtatcttgttctcagaactgcagggagcttcaataattgttctgattttcactaaattgaaagttccagccacctctatatgtctttctcaaaatgttgcaaagatatctttatatttgaatctctaatctttaaatatgtatttatatagtatatatatttttaaaatatatagtaaaatcttgaacgttttatatattacaaaaatttatataaaacatatattattataaaatgttgtaagctatatagtgaaagcattatatataaatgtatatattaaaggtttagagatttctatatatatgtgatagtataagataaatatatacatattaaatatataaatatatttaaatctctaaatgtttaggagttctcaatttagtgaaaactagaatgactgtagttgatattaaagttctctgcatttttgggaacaataatgtcattgttagtgataggtcagtgcactatctgcagctattcatagtgtaatgacaaacaataatgaccaccatgtcagtgatttaaaatattctaagtaaattctaaagttgtggcaagttctttgatgttaatatttgatataaatgaagggtttatcaataatggaatctgtttataatttttatcatatgctttttaacttaaacttaatttttatcttaaaatttttttaaaaaacaacatttagaccttgctctttttttaccgctgaagatcaaacttcggtttcttcatctaggcaacaggggtgcatgtgtgaggggagaaaatgtatttttttctcaactctcataagtttgtagttgggatagactgcttcaacaaaacacagattaacaagaggaagagcaaacaggtttattaatgagtgtagtgtatgtcaaaatgagagaggggtaactcaaagcagtggtttacaagtctggtttacatattatcttcaacaaagaacatcaattttagaaaagtgacaagacaaagtagtcgtaggcttcaaagacaggagaataggaaagagtcgtttgctcctccggtgccatctctgagctgatgaaggttgcaagggagaaattacagcctgtcttcaggtgggaaggtaggaaggagggtagaaaggccttttgtatttgtaaatttctgtcctgacttcagcaaacacaaaggaaaagcagcaagttcccctgcatcttgtcttccccagcttaacaatcccgcatacattagggtatggtttccttcataaggttttcaggttaaacaatagaacaaagacaggtgtgagcaaggatattctatttaacttatatctacctcgaactagaggttaggggtggctcctgggtcctgtgaaaaactgtgttaattgtgttaatattcagaattgggagggattggacatagagagaatatttgaagtggaaaatgatgaatagaagatataacttgaacaaacttagagttcaaagttcagtaaacagaaaataaagtgattcttctgctcaaaatatactgtgtgatgtccccagtgtctccattgtgcacacttggcattttgtcatgagcaatatttgatgccgatgagagactataaccttccccttcctgcacgtgtacagccttcgtttattccctcatcaacaaatttgtcacggctgcctactaggttcaagtaactgtactaagttctgaggatacagctgttaataaaagtgacagggtcatgcttttatggagattgaaatctagaggtataagtagatattaaattaatcccgtgtcagcataagcagaagtagttgggctaaagggagagagaggtgggaggtatggggagtgggccagatgtgaaggctcagcatatgcagggatgcaagagacagcccgagaattctggggtatagttgagtgctcgagtataggaggggactggtgaagtggccagagaccaatgaggatgtcacatatagactgagttcagaagtttgaattattccctgagccctccagagagccagtcaagagtgaattggagtttttattaatctactgtatatatttaaagaagacagtaaactgttatattaacataaaattggggttttgccaggcaaatggaacattaaagctatggaacaagataactgaagatatagacaagcaacttatggaccacgacatctaagcagggtagagaaaataaagaagatacaaagggttgatagacatggaggaagaggttcagtctgtgaactgaataagtgaggaagacacaaccaagattatggcaggatccgacatttgaacctcagatttcaaaggcagagccatttcaaaagccagagaggtcagtggccaaagagagatggagacaataatatcactggaggaggttataagaatgaagtgagttcagctatggaaaatgttaggtgacatttattgaggatttactatgtgccttgtgcaaatctcaaaatgtattgagtcattaagttcttataacagccctgtgagatagggcctgttaattatcattttaaggaagaagaaattctaaatatttcatttgaaaactggatgacatgatactcaatgaagctgaattttgttttggtttgctgtattttatatgcacggcagaaaataaatatctcattcaagtaatatttattgagtaattgctctatgtcagacacggagtaattgcttggaatggttggaggcgtggtcttcattttccttcttcctccgcctttactccagagggcaaaccctcagtaaagacccagatttgcattaaggcatgaagaagaaatatctgagaaagacagataagaaggacacttcacaaatcaggaaacaggtagtttagcaagcacagtgaaaaatcctcatggagatgaccacaaaaattttgtgaggggttattttagaggagatgaaactcatttcagaggaaatgaaatacaagagaatgagatgacaggagaagatggaaacttgggcgatgaacaaaaacaacgagctgggaactttacagctggccacaaatttgccaagaaaattaatccctggagcctcccatgtctaccatgggaatgtaagatgggagagacgggcactcagaagacagccacaggctacactggttaaaacttgaaaggagttctggtttagggtgagcaggatgctttgatgtctgaaagagcccagctgaagtttggtttcattgcccacactccagagagaggctctagctccaaggtggtcagtacccaaattccttggcatcggttcaagtcctagtcttttgggcctagttaccttatgagctgaaatctgcacttcattaaatcaactattgtcctgttgcggtgaacatcttttttgtttgtatgtcttcgcttagttttttagctggaaaatgccttgctctctcagctgtgctaaaggaagattagcataggggtttgcgtttttcagtcaggccgaagagagagccagtggtcactggaggatgaaggtaagcaatggtagaatatgggaagtcaagagaggctaaaatattgtttggtttggctaattaagacaagataaggatgccatcatatttcaagtttcattttggttttctgtagaggctttcagaacagaacagcaagtacacttgaatgataaccttgcttcttactatttccctgcaagtgtaacctcccaggattttttctttctttcattttacaatgaatgctgtgaaaatttttattttcttaaaagggtatccgtctctcatacttctctaaggtgccctgcccagaagttgcttgcaacctcatccctaagagaactggcaaatattcacctcacccaaactgtgaacattagcctgcattataattatagataaaaagaaaagtgtgacctgtggttgtctaaagattaaaaacatagactcagtctgtaccaacaaaataatggcttattgtgttcgttttggggtcttagacctcaaaggtgatttaagtaagagcttgcctttagaatacaccttaaatattgaagattaagaaagcatcatatggaattagattgccgagaagtgcttatgtgattcttaataggagtttcaagtgttgcctgtgcaaagatattacttgaaaaattgtgaatggagagagcattttagaaaaattgagcaacttttcctattttcagctctcaaaattgaaagaggtaaaagatttaagtttctgcaggaaagtttatatttcatagaagcgtgccttgaataaatttgtgagttactaaaatgcatgttttaatgtaattgaataacactgtcactaagttctagatggatgtatctccatgtccataacatggtacagtggaactgattagttagtttgtatgtataaaaaatcagtacagggttccataagatgaataagtgattttctcctaaaaattcttctgttgaaagtaagacattacactatgtgacattttcatagaaagctccatagtgaaattttcttgaattatggaactatggaatgcctataattatagacctttactttctgaaagagtctgaaaggtataggttgaccttcggctatttgaattgagtggaagtgtttcaaaaattgaaaacaaacctttcaagtctccttaaagggaaagaaacatttactcatatagacattaaatgtttcctggttcaattcatagtttttactattggccaacttaacgattaatacagcagatgcataataaaattttaagtgctaattcaaaacacttgttctagaattggagccagaaatcttataataagaagtagtaggtgatttcaaaaactaaacatgttgagaaaatacatttccttccaagaaaaacaaaggtgcttttgagatgagaatggccagtcaggaagttttatagagtccttacataattcaaacaaggtgatgagatacacaggcttgaactgagcatgataaaattccagttggtaataaaaattttaatttatatttcttaattttttcctcctcctaaattctgtgttcattgtggaaggcttgggagtccctaaattgtctgaattatattcttaaaagctagaaaatcatgagaagttcctacccttgaggcttaatgtgcatcaggaattgcaaagtatgagtaatgaatgaaatgtggttataaaattttgccagttttcaattcctgtttgatattttaaaaataaatttagccatataggaaatctttccactaggtaggaaagcaggtatgtttatgaggaaaaaataacatagattcttttatttaaatttggaaatgattttagagtgtagtactttttttcttaaaacatacttaatatttctcttttgaagtgcttttaagattattcatcaaatataagatcacacacaaacagaatgttgcatgcaaactgtgggttttaagtattaaaataaatttactttgttttgtttgttattcagctgaacagatggtaatgattttgacacaattcagttttcgttttctttttttcttccttgagaaaaaaaccctgcaaaaacacagagcttcttttccactttgtcacagctggttaccaatcaatctcaattcacggtacagtgatgatagcacacgttgtccaggggccaaatctgattgggttgcatttttcagcagtgtttcatatcagaaaaaataaggtatctctatggtggggactgtcggcacacgattgtacaactctcattaatcaaacttggcaacaatgactgcatttatttaagtcaaagactagcagatttcaaaatgaaaatcaccaaatttctgtttgaatttcctcatcagtaatgttttttcatctgtttctttttttcttggttttaattacagccaatgataccttctacattgacactgatcattacatatgatcaacctcctgtgttgatcatatataatataatattataccatgttacaaagtagctgtttcataccaaaataaactccacttattgaaaatttattctagacttcttaaagaatgctaaatgcaattaaaagcaaaatataaatacctttgattgtttaataggagaataattttaaaggaaatatacatcaggaaaaacatttatgaacctcccagggttacatttggtgttagaggaatattgagaaaaaatattgataaagttagtttctggaggttttgaaactgaacacaaagtcggcagtacataaatacctacttgcccaatgcaaatgcacacagagcaataaacacacacatccaatagaaaatgcatgctgctgtttgttagaaaaataaatgtacttataaagagttccagtcacttcataacttgagagaacaatgtcagcattttctgtaaaattgtgtttggaaacagacattttctctaagttatttactgctgtgcaattatatgtaaagccctgttgtacactataaagatgtctttaaatgtaaggaaatattatttataacttattgtatcactctgtcaatatttgctttgaagggagaaatgcatattttcccaattttccaatgtaatggttacaatgacattaatattaaacatggaccaatgtatcttgaaagaaatctaagaaataaggccacatctgttagacctgggaaaatacttgaaacctattagttttagggagcaaattattgtcttagggaaaccatgacccatgagggaaagcagagactggtagtagatagtcacaagagttttttccccaactataactgcctccatatgtggttttgggaaagaaactttgtcatgttttgcttcagattgcctacatgtgaaattagtaatgagccaactatttacattctagattttgaagttacttagacataatttctttaaaaatagtctttatatttcttaagcttttgcagataggagttaatctgatcacaattacaggcctatcctttctctgacctgagacacttaaggtaaatattcataaaggtatcataatttgattgagtcttccgggatttttgcaggtgcttagcgactgccatagtgggtcggtgatgttgggaggaacagtagtgtctgcatggtgtacaattgtattaggtttgttgagtcagcagagtgaggaagccgaaagagcttgtactttggagtaagacatcttgatttgaaaattcaaatctgtatgttaaaaatgtccacgttttaaattatgtcaattgtttaaataattttaaaatattactaggccaacacgcacacacacaactacaaatttatacaatctaagataaacttcagtacccagaccatgagacctgaattctagtaacaacagccattaaaagcttaactgtgatgttaaccatttattctttgaacccattaggaaaaaattctgagaagcagctactcttttggtagtatatcccctgcttactttaatttccttatatggattcatacatcaggatttttaaaaattgaatgcctatattgtcccttggtaaaaagctgggtaaaaatctttgtaatatagttgatgaaaattgcgccagaagacttagattccaatacggtctaaacctttgctaccgatgaattccagggcactggataacaaagaactatttttctaatattaaaattaggacattagactaggctcaataattttgaaattctttactatgtctcagaatatatgatctgttggtgtcttgaaataaccaattttcatgtattttcttattattgcataataaaagagtatttttatctattatcatagaggtactttatttaggctccatatgttctcttttaatatgaataatattggattagctgaatattttcatgttcactcattcatatcttcatggttttctagactttaatgaagttctttgaaattgttatttttacacatgctataattcctttgttaagaaacgaggaataaaattgaaaataatatcccaatttgtgctatgccagattttataaacatctaagaacagctatatggtttgctttcaggttgaattttgtatatgtacattttctaatttttaaaatgggggaaataatagcttcccactttacctaccagaattgttaaaagtataaatgaaagagtatatttgagaatactaggcaaatatatttttattgtcatattttattttcataagacatgtgacttgaaagctccctgccaaaataatgagcttatatatttgaaagcatggaacaaaacacaaagcttacattgttttctctcagtcttcacatttgttttatacattctgctaaaattatttcatttattttggcggagagagagaaattatttatttgttcatgttactaatttacagagggtaatttattaatgataatatgtaaaccatatgtgtagattgccactcaaattgccaagttatctccatatagctagtagcattaacgaattaaatattccaagttcttacattttcagtatcatatcaatatgaatttaagttacatttcagagctaattgctggtatataaacacaacattactatgcttcttgatacaatatcttgttatatttcaaattagttaatctctcagtactgcatataattgttgcactggtaaccatgctataaagaagtagaggagaatttcaagcatttgctgatgcatcatgatattttcaataagcattcattgaacgcctccaatatctcaggcactgtttggttagacttgggctatacagtttaaagcaagagagaaccagtcctcattcccatggaacatacatgctcttggaaataaagaagacaagaaataaggaaacaaaagatgtggtaaagatatgtgctttgaagaaaataaaacgtattaaaaagtgacaaaagaaagatgaaagcaaagactaaaaagaaagtaattttttaaaagtaactggattggtggatagcaactagaattcttaggcaggaaagacatgtataagggaatgatatttgggtcatcctgaaattcaaaaagggtcagccatggaaaacacaagggaagaacattccaagaatttgcaaaagtactacaaagacacagaactggcttcttacattgaacaagtagaagagaagccatgtgactggaaaatagtgaacatgaagtttgagagggaggcaaggaccagattatctaaaactttaaacaccgtaaataaataggttttattctgagtgaccaaatgagaagccattggatagtttcgaagagttcagtgacataatcagatttatgtttatcaatcagtaaatctgtactgaagctcttaattccctttgaaacccttacataaaataactgctgttacagtcgtcccttctgatttgcagttttgtactttctctttgtggcttcagttacccttggtcaactgtggttcaaaaatattaaatgaaaatgtccagaaataaacaattcatcagatgtaaatggcacagcattctgagtaacatgatgaaagctttcactggccagcttcattccaccaagacacgaatcacacctttgtccagcatatccacgctatgcacactaccttccagtgagtcacttagtagaacttctcggttatcagattgactgtctcgtgtagtgtatttgtagttcagtgccatctgtggcttcaggcatctactaagagtcttggaacattttccctctgaataaaggggattattgtacagtatatggttgctgttattaggaatagttgacctgaagatgagataattcataagaaacccaaaattgaaaaagctgtcttgtaggagagagagtatacttttctgtttggcacaaggagtagtactatcagtagtaactttgggaagaaaagttatcatatgttatcatatatagaagatcttctaatagagatgttcaaagatagaatagaccccttgtcacaggagcaagtgggaggactgattggttgcatgctgcagacaggattcaagtgttgatggacagttgcagaaggtgaacttttaaagatttcatttagcctaacgagtcaatcactttatatatattcaaagtattctgatataaatacatcacataaactgctgataatacttgcagactttcctcaggcaaagattcagcgagaaatgagaatttaaaagattgtgagcatttcaataactaagtactcaaagtctgtttgtttttaaattacaacatcccaatgtgatgggacataacaagacatgtattgtagcatttacttctagttggagaaagacaaggcatggccctgggaaatgtgtgttagctggagagagccaaggaggtagctctgatctaccctaatgtggagacatcatttcactaggctctgaatcctatcaagttgtgtatccccaaattttggtgcaatgcgtagatatgtcatcagcatttcttgaataaaataatgaaatgtttattataatcttttccaacttcagtgatcctcaaggagaaattaaaagatgacaatgataatgagcatctactaattcctaggaactatgctgggcactgttataggctagaccgttaaaaattattacccaaaacttctttttactccaaagcatacctatctcattgggaatggatttagttactttccgtacttacatgttttctaacaaacctggcccatgtcaccagactattggccttggccatagttttacaatctgtatctgaaaacctgttctataggtagaaaaaaaatagatttgctgttttattttaatggcacagtctctttgaaaggtagtctcttttattaattgttaagattaattcattttattcttcccaagtaatatttaattttaacttttcacaaggaaggtaatatgcaatcatagaatgcacaattacttttatccctgatcaacgtaccattaattaaaaaacaaacaaacaaaatcttattcctattcttgtttccaccttcctttaaaatgataaaaaaatctcaggaagtcagatttcagacttagtttgggttcaaatattatgtatttagtaatttttaaataaaaacttttaattttttttaaatttcaacctttattttagatttggaggtacatgtaaaggtttgtgacatgggtatatagtgtgacagtgaggtttggggtacaaattgtgccatcacccagaaagtgagcatactacccaacagatagtttttcagcccttaaccccctccttctctctttcctctagtagtccacagtgtctattgtttccatctttacatccatgtgtacccaattttcaccttccacttataagtgagaacatgatttccttcttttttatggctgtgtagtattccatggtatatatgcatcacattttctttattcaatccactgttgatgggcacctaggttgattccatgtctttgctattatgaatagtgctgcaataaatatataaatgcttgtggggttttttggtaaaacgatttattttcttttgggtatatacacggtaattggattgctgggtcaaatggtagttctgttttaagttctttgagaaatctccaaactgctttccccaatgtctgaactaatttatgttctcaccagcagtgtgtaagcattctcttttttccacagcatcatcagcgtgtgttattttttgactttttaatagtaaccattctgactggtgtgagatggtatctcattgtggttttgatttgcagttctctgatgatttgaataaacaggtttttttcttttaactaaagcaggagatcacttttacattttatttagcttccgtgttgtcttctgtgtaatgaatgtctctaatgtgaagtaaaattttgtcatatgctataactaaatatttgctgaatatgaaattatttttgtccaaattatgtacttatgtgtcttactgttttaagttagcatttaaaaattaaactattttcttgcagagaagaagtacacatagaatgagaaaagtgacacattcagagtcagggttttaattctggtttttctatttattgataacatgactttgaacaggtcattttatttgcctaagtgtcagttttctcatctataaaataacaatttctaattccaaataaggttttgcagatactatgaacaatgtgtgcaataattttttttaactggaggtaacatacaatttttttctcaatgaccaatcgaaataatatacaatataggtatcttttattaacttggaatcatggcttcacatatatattgatccagaaaagactttttagaccattaactttatctcccctcttgtagctcttgaaaaaactcagctatagggcaatgtagagacttctgaaagtcagacaacaagaataaatagctaaacagtggtcaagaattcaatgtttttagatgaattggaaatggctgcaaaatacagtatttaaatgtttctatcttacagctaagcatgtcatgcagttcataggctaactgtagaaaagattatttttattagacatcaaatacatcaccagtaacttttctgaggccattatcaaaataattgtttttctcacatttttactggcaaagttaaacagaaagtgtttatctgcatgcattttagcctagtacttgctctaaactatactcaggtaaagtaatttgaaatattgaagccattcacagttggcctttatatcagtaggaaacaagatatgtatcatgtattcaccactagtgtttcttgagctcctagtagtggaataataatagctaacatgtatcgtgctttttgtgtgcctgttttaagtactttatatgtcatttaaagctcacactcactccacgaaatagatgttatctttagcacttattttgctaattaggagatagagacccagaaaatttaagtatattgccaactcttacaagcacattaagaggccaagtccatgaatacaactctggccattttgctcctgagcctgtgctcttaaccacttgattttgctactggatgttaaaaactctatgtttgggagtgtggatattgcagtgagtgaagcagacaagatgtctgccttcatcaaaatagataacaatacaaaatgtaactaagtgcagaattattgctgtagcaataagttttcaaaaaggcagtaattcgatttttatagtatggtaatggatggcttcacaatgaaagtagtggataaaaaagtagtggataagttttttccctaaccacttatgacatatttaataagcagaattttaaggcaaaacttgcagacagaaaagtaaccatgataattaaaggatggaagagtaagggtagttaagtttagttggcatgattggtaaatagacaatgctttttctcatgtcaaggtctataaattaggactgtattagttcatgccttagcctctaataaaattaagctgggttattcttctagctaaatctagaagtagaagacatctggttatggcagttttaaatgcaagcctaaaatgtttgtatttgtcctgaaaacaataggaagtcacagctagttttgagcagacacaaccaattaaaatgatatttggaaacatggatctaactgtggtatgtatgaggaagagaagcaaggtggccaatcagaaactattgcaaaatgtgtgtttgaaataaaaaccacaggtaaatatcaggaggaaagatcacatgtgaaaaaaatgatagctggattatttagtttgtgtaattataatttcttagaattaaataagaacatattctcatgcaagtactcccaaattttttggtgttataatgttttctgacccacttttttagtctgtttcattaatgaaatggaggtaaaaccataaatgcacgtgaacgagctgaggatgtgcatttccaaaaatcactccaaggcatgttgatgtttcaggagttaatattccttatttaaaaattgattacatacccttaattcttttaactaatgcccattttgtcaatttgccaacaaataagagaaaaattttgttctttaatatatttcggctctctaatagccaaggtgcctaaaaataaatcatagtattgaacacaatgtgactaacaaactaatgaaatataactcaccaagaaactgagatgtatactgttttctttagcagtcaagagctacaaaataaaggtcaaagtgctaattatgcctttgatagttgcgaagtggaaagaattctatacatatgtgaagtataggtaactgacaaacagctaaagatcagatatgaaattgaatttattagcaatatctttaatctaagtaattgcactttgtggctgatttgtgtgtgtgtgtatttgtgtttaggtaaaatacagtataaaaagaaaaatgaagatgaatacttaatgttattatccgtatagctactactatttaataaaaccagttcattttctacacaggtatgacatcaaagacgattacacactaagaattaaaaagaccatgagtacagatgaaggcacctatatgtgtattgctgagaatcgggttggaaaaatggaagcctctgctacactcaccgtccgaggtaagagatttaagatgtcaaagataattgaaccaggagactaatatttggttaaattggtaagtgaacttacgatcaaaataatgaattatgctgttttgttgtactaaaatgcctagattttgtgtcctctctatcattagttgaaataaaattactttcaatatttggttcccaatgatgataatttaaaaagattaattcttatttaataaattgcttatatggtttaacgttaatagtttatatggcttaaaagtaaatcttaaaaatagaaaagatctatactactctttcatttccattgctttcaactacttactgcttttaaatgtcatcagtttcaaaagtactctcatgctttctgtttactagtttgtcactttatactagtagcatactgttttgaagtcctttttaatgtcagcattcaaaacagcaatctgaaaaaactagcaatgcttccaaaggtgaaaatgaatacagaggagctctccagccttgagataatctgatttagagactgatttgtgaagttcattggccttaaataattgaaatagtcagtgctgctcttgtaataactttcactttctgggtgtcatgcacttcctcagtcatggaataatgttcatttatagactccctggaattgcttataagtgaaagaaagcattacttaacttcacagtgcactagaataaattaactgtcttttcagtgggacttgttgatcacgtgagggaaattacatagttcaaggtaccaagtagtaccaagtagacactcacactaattcttgaaacagacattagccatggcatcatctacactcctagaaaatcaaacaaagataggcaagcacatcctttctcccactgctaactgtgcctccttctctcatccttcgtgataaagagattggctgcatgttttcatccaagtctcagttacatcttaccccatttagtcatacctctgacccttgtgcagctttgctcccaaagagattcagaaggttaggaaaaaggttcggagaagtttgaagttgcaggaaaggtgtgagggattctcaggttagtccttcgcgtggtaagaaaaaggatttttaccaggtttatgatttgggcttcaaatcatacaaaactcaactacctccaggttattattaggagacaggcattttgggtacctggaaaaatattggtgcttttcatactactcaatatttcaccaaatccattttttcttctgtagatattctagtgtgaatttagatacaaaacatatttagacaaaattgacagctagttgcataaaaacattttcattcttcattagttaacaggtcataaaggactatgatcatatatgaattgaatatatatatatatatggattatgtaggatgaaaatctgataacctttgtaagccaatgaacacactttatttaacccacactctacatggataacttcatacatttgtcatatgtttgctaggcagctttttgcaaaaacaattcactagaccaaattatccccgaagttttctttttctttttttctaaagtaaatggaaaataataataaacaaccaaccaataaatgctccatccgaaaaatatttgctgactaaacaaatggtgagaaaacgtgaggagttgtttgtttgtagaagcagcagggtttcttttatacttgaatgcttggatgagtgagacttgaagtggtctgtttgctttaagacctttcccagctaattgttttcataatttgctgaaagtttcaggcttaacatttcatttaacaaagcatgctcctcatgcggggatgtttgaagctaacttacaaaactaatagagagcattgtttgttttcaatagttttttttttcttaaatcagcaaaccttaaatagcctctcccctaatctgtatactgtagatggattagagtgtttattctttgtggtatgaatttatcacctctctaagactgaaacctcaaaaactgggtttaaaaaaatctccttaatgcaatataatgtagagtaaaatactgtttaaaaacatttattttttaccattaggaaaagcatttgggttttctcatgctaagagattaacaggaaaaaaaagacaacactgttatctacgacttatttttttttctttgctaatttttctatgcacataaatgaaatgtgcagcctttctttggatcgttttattagaacagggtcaactgacccaagaggccatgcccattttcatccatttaatgcagagacacagttgtgtttaatttgctgattttgaaaacatccacctgctgtttttttttttttttttcaagatgaaatgttgctaatgtaacaaggacaaaaaaatgtattgtgatgtttctgctaaaattttatcataacattcacattagccaattggggaaaaggtaagagagtttattgtcaaaatttgaaacagatctactcagttatttcccatttcaaaaatatgctttaaaaaaaaaaactataaattgaggctgaacatcaagaagctccctttgctgacttggcaaatgtaaaattaggaagaaataaagccagtcaacaacaaacctcctagcattttcattctaatcaattaatttattattaataaaactttttaaatggcttaaaaatgacaacacaaactgcgtatttgtaagcacattttacccatttttaattttttaatttgctttgcataaagatctcattggaaaaatcatattgtttctagagcattaaagccttaattttttggaattattctataataaaataaaatagaaatacattttatttgtttaaaacatgatttctcaccacagtttcttttttttttttcttttgtcaatatcctacactcaaaacgcctttttgtttctgaaggaaacattatgttttaaattcacttgagatggcaagctgaaaagtagcaaattcaaagatgaaaaacaaagttctttttctactggacattttgcaaaattaagagaaactccatctgttagaataagccacaacttcacattattagtctgttatctctttttgatagtcaatcttgtattctgcccctcactcccctgcaaaaagaaagaaatcgtggtacattgggtaactcactcctcttttcctctggctatagcaaacacaccctatatgttaggccacattagggttccactaaaccaggcttttcgtaccactgctacaattgccttattgcctatggtctgaagcttccctgttttaattgtgaataatattataagaccatggctctcatagagatggattgcacaaagctagtattacgatgtatctgttaagtgaatatgtgtaaatatgttttcaatggctgttcctatcttgcccgaagagccatcatcaacacgaaactattggtatgttccagagtcacattacatatgcactagagctgtatctactaaggtatgggcgaaacactgttgaagaaattctatttttaatgtcagatttcatgaaatttcatatactactaagcatattgtttcttcatttggataatgggatcacatgtttcacaatatttgtctattgcttttgtataaaatggtttaccgtctaaattgatagcgtgttattcatttttaaaaaaggattatgaagcccatgtgtatctcttacaatttatttgcattaataacaggggcagcctattaccactgattttagtgattgaaagttatggtataataaaaaaatgataatttgttgaagcagcagtttgaaagccgttctcagtgtgaacaggaatcaacttgtcagtcattgtttcctgccctctgccagaagaagaaaaaagcttaacagtagttagggagctactgagttgaaatctctaaggatgttccaacctatctgttatattttcatccaccctgtccatggatgaaaagtgatgtaatctcaacttattactgactgaaaagcagcgtcaggggcttttctgcagtccttgtaatggttctgactaaccatgcttaaaatccaattgctatttaaatcagacagcgaggccttcttttattgacatgacatttgctagtctgtgacttgaatagttatattcatcaggtttttaactttggggtaacacaagactgtttaactcaagatctttgaaataataactgcagtaagtgatgatgataagactttacctaaaatatctctcaaattgcttacagtcagttctcaaagtaattattttcctagaattatatttataactctcaactttatcagactcagacatcttggtcatacttgaattgtgagactagaaatcactctattgtccatacttaaatgtaacattacacatcatgcattctgataatttttctttcttttttttaatttcttttttatgttctcaccacaccattgtaatgtctacagctcgccctgttggtaagtagccatccttctatccactaagcatggctttgcacagtgcttcataactcatgcatagtaagatttgacagaatgaaatatatttattttacccatgttaaaataatacttgagactgtatgctgtaaaagttgctcatgttttttttactcactttgataaacaattttgtagtgacttttgctacatagcaataagtaggtaacaatttttatgtaagagaataaatgaatgataaatgtttatgaactgctagcttttcttataggagaaaaatatattgtattaggatacaataagaaagcattgctctccttttttgtatgtataaaataatcaattattagttatgtttgatgttaagaaaaaagttatgaactaaattaaaaaattctacgactttccacacttcttttaagttactccgagtcccagtattttagggatatttttagctgctgcatatttattgcctgcatgcctatttaaacaaaattaagtaaaatgttttaagtagatgcttaccctaagtgggggagggatagtggagctgtgttctttggcatgaaatctgagtgtttgtggttttaatatatcttatttttcatttggctttgtgaaatctaagtaagttaacagcttgcttttgcagatatttaagtggtaattatttgtaaacatttggaagataaaatttttcaattcattgacttagtaagctttctgcatctcttttaagcttaagtttaattcaccaataactatgtttaaataaattttggtaattgtgttacatgtaaatgaatagatggatgcataaatggatggatgaaagagtgaccaaatttagtacactgcttctttaatataacaaaaaggtactttaataacaacttattcaattttgagggctttataaattgtccatctagcttcaaaagcttccttcatgtaccagcttgacatcattgacacctgatatatatgttggttcagactcacacatttttcccccttcggttgaaagagtcatggactttgttgctagacagtatgtttttacattgtcagcaaacacggtaaatatactttggtttcccaatctgactttctgatctggtgtttctgagcaatactcccttttgattagtaatttaatatcccttatcctcagtgacctcctctataaaatggagagaataatactgacttatcaaagctgttgcaggaggggactgagtttaagattgattttatatgtgaaaggcattctgtatgccaatgttggtagctatcgtatgcctagtttctgaggcatgacttcacatttcaatattttttaaataaagctatggttcacaattaattgaaacataaactgcagggtgttttttgaaactgatgaaatcaattgtggtttgtacaattgatgtttgaaaattgaagaatatattgtaataatttttaagccttattttcttgtatttgtagggattcctgttaatgataattttatgtatcttttgaatgacacacaaaattaagaaaagaatgagaaagaataagatgatgcagcaacagacaaagaaagagctgatggtagaatacatgaccactctcagatttctttttctcaacatctgtgagctagttttcaggttcagaaattcactcatttatgtgtcaaataagaaagcatgttattacatataataaaataaaataagtggaaagatttatatataaattatatacaacaatgatatagattatatataaaataaaatatatgaagtggaaagattgagaacgatctgacactttttcagatgactatggaatacaaaaactttgcaaccttatttagaagttttttaaagatattaagcattacagtatttataggagatatgaaaatagatgaatgattgaaaacatttctcaatagaaaggatgacagtaggtgttaaaaaatacaggttggttttgcatcggcagcagttgtacttataagctaatgacttttcaaatgaaaaggaaaaatcaccatttaaagtacagatctttgtacacagaaacctcatgccaatataccatgagcacttgatttatgttatagaatagtatgttaataatttccaatatatttaaaatctttaaatgtaggaaaaagtacattgatttgaaaatgtgatatacacagagtattgagatgtatctgtcatctgcaagatgtttccaaagttatttccattttttattcccgtttgaaatgatttcttaaattcccattggactggaactaaagaatagcttcttgacacattgtactttattctggggaagtctgtcatttcataaatctatctcaaatgacttatgacaatgttcagaaatataaagaactatactttaaacttgacaactactattaattttaaaaactgaatgttggatatgttttaattggatttccaaagaagacacataataaggcaattagcctcattttttttgtatctacttcttacatcaattttaattcaagaacatagatatctgaacatttattgtatggtcaaaaagtataagccaagtaaaataatgattacatattaaaatcatagaaaaactacattattatttatatttgttaatgcactaaaaagcacatttttcaactttgcagctcttagcaatagcataaagggcattctgcaaggtagaggccacagaaaggggagaaaaaaacagcttgtagttccaatataaattagatgaagaaatatgtaccaagcatataacgtttagagaaatttcagatcatagtttctgcctagagcttttgaatgaaaattagcaatcattgcagattctggaatacttagagattcagaaaccctcactacattactcactggatgaaacttcttgatggtctgtgtagaaagccccctttagaaatcattacaaacccccaaactgagaattttgtctaaatggatgactcttgtgcgatgcatttgtgttaaagaatttgcaactccttgcagtcacagttggaataaacacctctggcctgtattcagagttttcctctaggtgaacttagaggatgctctagtgtgggaggtattactgaaagcggacgttcatatacttgccaacagaggaaagtgttttacagatttcacttgctcatctgcagtgtcaccagtgggtcagaaagagctctttaatctaacgttcatatttgctggttgccacaaaatctaggcaactatcactttaataattaaaaatccacaagcccttcctgtggttttgacgttttactattccaaaggcattctttatatgaaaagaaaagtacatcgtaggatgtagttaactatgaatgctgaaatattcatttgtttatttggaaaactcttctgatgaggaaactgacagaagaaaatggtctaaattgggaaaaatatcttgcttcctatacccatctgtcttatttttctattggaagcctctcccaagcctaaaaataaaaaaagaacatctattttggagatgggcaccacattttttcccagcagcaactcaaaacatgatgagtaatttggaaaggaactgtggaatctaccagatgccttgcttacgaagccgtcctgttccgtttggtgacttgtataccatatgctagatgctgattgcctggagtataaaactgaaagctgagtacttcacgtgaaacttgtttaaaatatcaaaaaacaaactgacaattcacaacttgatggaaacttctaagtattttctaacttagtgacccaaaagtatgcttccttttgatggaagaatgtaattggccacacaagaatttagaagtaataagaagtacacatgctttttggcaaaattcaccatttaaaaattattttttaaaataagcagccactactctaaacagaaatctacagggacattttttttttaatgtttcaactgcttaaccacagtaattaaatatactattttagaaagttctgttttatgagtcgaagcaaagttttgttaaagcatgtttgaaagcagtctattctgaggccaccaagaagtccaaaaaaaaaaatggtttgtgattgaaaaattcattcagcatgaattataaatctgacattacttgaagaataatgtaacaaatattttgatacccccatctcccaccccaacttgaaatttggaaaatataatgtgctgtacataattggatattggaaaatcacagttttttaaaataagaaaacttaaaggtattatgtatgaaccttttcatgtttggatgcactttttgcaaaagatgttctaagtgtaccttgaaaggagacctagaattttgtttcttgcatcccttttctttggacaagctgttaccccatgacctgaggtaatcatctccctcctgagagctcttaatgtttcctgcacctggcactaattagctactttatgcagagtcccatttacttattattaagcatcaggttttccgttgctccatatgttttgattaaatggtaagtttaaaaaaggcattctgttttatcttctatattccaactgagtttccataatgtgaaacgtttaaaatatcttaagctaatgttcatttctaaagtgaaacacaagcgcgggttacttctcaggctgagctggttctagccttgtgtacttggcaatgtctgtccattgaacaggaggagaggctgggtcttaaattactctcacacttctttctttttttttcctctcagaacttggtaaaaatgtcctattgtcttggtattgaatggtattatagtgtagtctgaaacttaacaaaaaatatatttttttcttggctgggattttcttttaccatatgaatatgcatgtagtcctttctttcaagtaactttgctcagttatatcttggtaatgatcatcctgtaggtaatatttctaggacgcaacaagccacttgaatctgccagttctatgctttaacttgctttatttcaataaccttttcttctgttttatctttgaattttttttctgttttactttctcatttcttcaaattatatttcttcttagttatattggctttccttagtctcaatttcacatttatcaacttctctataataatttcaatcatttttatttcatattgtatgatttctcaatgacaatataccgcgtctctaacttttaaaattgcaatcattatatatttcttatttctaaaatatattctaatttttttgttttttgttattttcttgttaagctctaatataaaattctttatctttacttgtcttttagcctttgtaacccttttttcgtttttaaaagagagatttcattgtatataatttcatttagacgatgcctaagttatttgttttaaattgtttctgtgtttctttgagtaattcttggaagacacaggttctttatctctctttaattaattatgttcattttctgtcatgaattaaataagtaattggttaatatacaggtttttgttaaatttcgttttgcatagattttgttttggttcctatctgattattcattttctggttagctctgaagactagagtttgcatatttggagaagagaaaatgtgaagtagcagggtaattcaataacccttatttagaatgttgttttcaatatcttactaaaaacatactatgttcttctcagtattgtactaggcctggtgatacagaatcaccctttttaagttatgaggggtgtgcattttcctataagactctctcctcatcctcctttatactccctgcttcataataaggatggttttcaggtgtgtcagttttctattgttgcataaaaatgaccacacaatgagcaatttaaaacaatgtcattctataggtcccaaatgcaggcagtctcaacagtgttttctcctaagggtttcacagaccaaaatcaagatattggccaggttgcactctcctccggagactgtccagaggaatccacttcaaagttccttggggtgtttttcggaatctggttccttgtggttgtaggactgaagttcccatttccttggctgttggacagggtgactcactgtgttaagtggctgctcttcagccttcgcacattgctgccaccacaaccttcatagccagcgggggcaccctgaattcctcatgtgctttgctttgtagctctccgaggcctctttctgatttaaagatccagagtattaagtaaggcgcagctgatgaatcaacccattctgaggtcaactgattagtaaccttaagtatatctcaaaatattttttgtaacctaatataatcatgaaagtatttccaggaagggcaagcctgaggtcatggggcctcagaatgctgccaactacagtaggctttttttttttctttctgtcaatacttctttctccgccttctgaattttagcttattttctacagttatgtctcatatttcccatgtctcactcttgactttaagtatcatttttcccataaaaggatcatgggatgggctctcacaatgatgttagataatttttgtgcaactggtattgataaaggattaaggctagttatgttggtgtccagtgtgcatcctcagctttcttcaaactttgctgcatttggcaggggtacttcataatttgtggttttggggctatagtagttttttcttattattcatttcttttgttgtactcaatacaggaaagtgaagcctttactcaattatcttaacctaaacagcaaaaagtttgaataatcattatttttggagcctattcaaataagaataaaataaatattaagtatttctaattagtacttaaaattaaagtactataaatattaaatatcagaataatataaatacttaggcccaaaacggtatgaggagattagtattaagaagtttcactggctgtgtccagaaaaaaatcacattaactttgaattatgtattcgaagaaagtcagaattttcataagttgctgcactttgtagacagggatgtcatgatacatatactgtaaaatatatcttatgatgtgtgttacacctacatatgcatgatatttgaattgctacactatttgcttaaacatattaaatgtcactcaagggaatagtacataattagatttattaaaaatatataaactagcaaactatattacatttttatttcaaatatatctgaatgccttttaaaatctcacttatggcaagtattgctttccagatttactgaggttattattttcatctcccctacaaaactgttagctctttgtcagtaaatacattgttatatttatctttctgctgcctctaggtctagcataacacttacatgtggtgggggcacacaaatgttggtgcagttaattgatacacgcatatgcatacataggtagtacttgcctagaaaatgtttatgcaagcagctttaaatagtgctataaaaagattaagcaacattaatggtaacaggccaatcacatattccccattctgctggtagcagataaaatacaacaaaaagaaggcactaatgagctaggatggtgacttactaagcgtgtaattaatgttattaagaaacattgcagttgcatattaaaattccgttaactaagcaacccttcagcatcagtacatttgttccttggtttcaagtttttctttttctttttctttttttttttttctgattggcatcttcatgcaatctttctctaaaaaatgagataatgggatgtgatcagccctcgtggtttagctggagtgctgacatgacagttctggcaagttgacaggttaagtgagtgaaaatggatgtcttgtctcaccatttacttgaagagccattttaagctatagtttccctctctttactcccacacttacaactccttctatcccaggtatgagaagtcaagttttcccaatttaggaatttaggatcttgaaagaagtttttcaccactttaaactagtcttcttctgctggtcaaaaatgagatcatttctttacaaacaaagagttaatttctctaataatgaattcgtttttaagttaatagcactttttatttcatattaagagtcccttaaagaaaacaaaattttattgttttatttttagtattttaattataaaggcaggtagaaaagcaaagctacaaacgcactggtaaagtacagaataatatgggacaatggaatttaaaagttcagaacttgtttaatattttgacagattttcctagggatctctcaatttatacctatgtataatttaaaagttctgtgaaacttgcatggcgaatctcataatgatttccacagttacatgatttcctatagttacctataattaaggaaatctattttagtaatctgaaatataataaagtttaaaattacctgcaaatgtacccaccttatttacagtgtgagtaaactattactattgattgcaatgtagaaatatttaatatgattataggattagagtggacttgctaaacccagtaaagaccatttagatgaaaaaatacatggttccacccctacaatccctcagtttaatttctgcctggcaaactcgaactatgagcaagttcatagtcgaactatattacttgccggaggccttcaaatacctaaactgactcaaggagcacacccatctagactgccacaggccacaaagaagcaggtggggggaatgtgccttaaagcagtctgcaaaattcctgtctctaacatactgcctttgttttcccctctgggaggagcactctcccacccttccttcctttccaacttaatctaaaagaacaaatcaaatttgtttctctctctctttccctctctctcttcttttctctctccttcttttcttctccctctctccctccatctctttcctctttttcttcctctctctctttctctctctatggtttctccagctgtagaaggccaactgagtcaagttactcttttgcttagtatgtattgtattacaaccttcattgtattgtaacatgtcacaacacaattgtaaaatgtgttgtaacatgcttgattgtttccaggaatgtctcttgtggtaggaggtgacttccacaggacagagatcttagtaccctctgacagaaaagaaaaccactaatgttgtttaaaaaaataattggatagtattatgaattgaattgccatgcaacatctgaattcatttttgtagaaatttattactgtggtacgttccagtaatattttgccttcaaaaacaaaaatataagtgtgaaggcactggcccaagtataaaatggctatgtgcttatagctgttcattacaacactgtttttatgtgcctgcttatgagatctaaaaatgcaagacattttgaactgagttaactcttttcagaagcattctttccattctagattattgtagaattatttcattttgatatttacattgtggcatttcaggcaggagcacattatgtgtgactctaagtgaaagcaaatggtttgaaccactttcataaaacatatacatattttgtggggggggggtgtattacacttaccaaaataaatccaatgcctccttggaattgcctttacagttgcaacacatggcaattcagaagccacttctgttattttgtcgtcatactatgtaattattggctgacttcactgcctttttaagtaatcagattttgaataattgagagttttttttgtggggaggaggttctgatattatatgaaccctccaaaattaatctcaccatcaacaaattccaagactgtttctaaactgtaaagagtaatagctgcataatagtaacatgttttgctcatacaatgaatgaatgtaatttgtatgtatatgtgagacctctcatgggtgtagagtagaatatgaagtctaaatagatgaggaatctaaggattatgactcatggtagtcattctattctctttgattattttttcatatttatgagagcaatatatcatttagtgcttttccttttcattttgacattgaagaagcacatacatatatatgcttattgttgaaagaaaaggtattattgtattagtctgttctcatgatactaataaggacatacccaaggctgggtaatgtataaggaaaagaggtttaatcgactcatagctccacatggctggggaggcctcacaatcatggcagaagagcaaggaacatcttaaatggtggtggcaagagagccctttgtgggggaactctcctttataaaaccatcagatcttgtgagacttattcagtatcacaagaacagcagggtaaagaccctgccccgtgattcaattacctcccaccgggtccctcccaagacccgtgggaattgtgggaggtacagttcaagatgagatttgggtggggacacagccaaaccatatcaggtatagacattggtattttactatggaataaggatttttattattagctacaaggaagtagctggtggcaaagaaagtgtatcactcatctaaaggatttattgccatggactcaataaaaaacaaaaaaaatagttaattagaaaggtaggtaatttagcaatttgatcatttacttttttttttttttttttttttttttgagacggagtctctgtctgtcacccaggctggagtgcagtggtgcgatctcggctcactgcaagctccgcctcccgggttcacgccattctcctgcctcagcctcccgagtagctgggactacagtcgccgccacgacgcccagataattttttgtatttttagtagagacggggtttcactgtgttagccaggatggtctcgatctcctgacctcatgatctgcccgccttggtctcccaaagtgctgggattacaggcgtgagccaccacgcctggccaatcatttacatttcttggaaatagtgacaaatgagtaaaatgtgattaagtagtctctataaaagtgattattttaaatcctatatttctaatttatattttctattataaatacattgcttcctctgagatgaattatgtgttaataagcttcaaatccaacatttccatggcagtgtgtatgcatttccaatattattaacagaaaatcttttgaaatcaaatgaagcattacatagtaaaaattaaataaaattaaataagttgaagaaacaatcacgtatcaattagaacccaaactgagttgaatataaattgagtaaacatttatctcttactactggtctataattgcattgcaaagaaacgatttctcactctctgtttcttgttggtggaggcaagcctattaactaatttttgcagaaactttttaattttttttcttctttttagagacggaggcttgctctgtcgcccaggctggagagcagtggcacaacaatctcggctcactgcaagctccgcctcccgggttcaagcaattctcctgcctcagcctcctgaggagccgggattacaggcgcaccctgccacgcccagctaatttgttttgtattttagtggagacgaggtttcaccatgttgcccaggctgatctcaaactccagagctcagacaatccacccgcctcggcctcccaaagtggtagaattacaggagtgagccaccgccccccggccttttgcaggaacttttaaaacccattgttacacaatgtctttatttgtctgtagtgcttttgttactctggaatgttggctactcatttataggctttgggtcatacattttcaacgttgtgtagcagcactctctacaaaagggcgtatcagaatcggttagatttgtattcaggtaacatacttgaaacaacacatatcagaatcgattagttttttttcaaatcacatatatattgttttcaaacactatatttactactgcaatagtaagtcactgtcactggtgggtatgtgtataggtataatggaataggtataataatgcagatatattattccttaggtataatgagatggaaaaaatattgagtatttgctttagatcaagaattctgttctttttaaaatgtactattccgaggcattcatttagtgttcactgttttgggcttttctaggtgaaaaaaatataccatttatatgctaaattgtagacagcaccccataccagtaaaatcttcaaactgaactaaggaagtcagacatataggctggggaaaaatagagaaggcaatgcaagcaagagcaagtaccttaaattggaaagaacacaagacaagcacaaggtcagagattgttcaggttaatcattgttgacaaagaggaccaaaggataattgatatcggggtgggttaaccacaagaccaagcaaatactagtgattgaaagtagactgctctgctgaaatgctggagctagtttggggacaaatgagtgtcaggattggaaaatcttagatcagctgatggaagccagaatgctacacggagaagaataatttgcaagcattgctatggtaagtattgtaggtttcactgtgatgcgatgaaaagcactataggtttatgaataaagagtgacttgaaggaagtgtgcttaagaaaggttatacttacaggtagtatagaaagagaaaagtaatgggttttatgctaccctaataataaaaacaatcattcagaagaaacgtaatgttattattttgcaaatctttgtagcatattggaaataatagcgttaaagttctatcattcttcttcgtattagatatgacaaatttttagttaatcagatcttggttcgaacggaaccaaatgaatctggcatctcagtgtttaagagttcctactgtggcattcgaataagccagaagtcaaacctgtcctccaatctaatttaactaagaaagctgtatttcttgcatgttgtcacttataagtggaagctgaacaatgtgaacacataggcacagggaggggaacaatacacactggggccagtcgggggcagtgggggcgcgcagggggagggagagcatcaggaaaaagagctaacgcatgctgcggttaatacctaggtgaggggttggtaggtgcagcagttcatcatggcacacatttacctatgtaacaaacccgcacatcctgcacatgcacaggggaacttaataaaccaaaataaattaataaagctgtgttactcatgccctgagtaagattcagtttactggttttacatcattatgatagtagttgaaacataaggcttttcaaatattaattgagataatgcctgtggagggtttaacacaaaccctagcacataataagctctcaatgaatgttaattattgccattctactaaacagtttgtgactaagtgaaattttaactcaagcatatgaaggaagagaatgcttcttaaatatgcttatagaatatgttagtatttaacaagtaaatatatgaaatagcaaaaaaaattctacttgagtttgtcaaaaaattcgaaatggcaattatagaattaaaagtttattcattcaggcataaaattatatccaaagaaaaagagtggctgagcatgactgtattcaccctgtgccacatatgaatgtacgtagctgttgcatgactctctccatgctaatgcctgccataggaagtcatattttcctgttaaaacaactctgaacatgatgtgattaacctttagagtcccccatcccctcatctcaaagcccaactcatgcacggcctgtgcttcctactcatgttcagccatctgatttccatgtcacccactcactctcaccagcaggcattagcataacagagctgcagcgtgactttgattgaagccagcttgggctgaatgcagtatcaaagcatcatttagcagaaatcaaatctaatttactgtgcattgtatttaaattctcaaaacacagtttcaagtgaactgtcccagacctctaatcttaattgacctttttatatttgggtctacttctctggaaatcacacaacatactttccttatagagctattgtttttcagcttgtaagtgttgattaaacactaaattgtgtcattctgtttgcttcgtctcatttctagttatagctgaagcaataaggtataatcacgtgacagattaagcaagtaggatattacatcatagttaacaaaagatttttccaatgctttcaggttttagacagaatataagtatatattttatagtcttctgtctcagagacatataggagaattgccatttttataacaggcatattcttctggagtttataactcaatctctttaattcacattgggtttaagcatgtgtttggaattgtcgtcttgaggacctagtagttttttttttaatacttaatgggagtcattatagaaaatctattttatgtatagcacactttgtgctattgtgctgtgttgataaaatgccacatctgtctactccctctctttggtgccatcagccaaatactgtcttttcagaccattttcactgccacctggcagagacactgaaactgtggagggttattagaagaattattgatgcagtttttcatttaaaacctcaaaaataaattccttcagctgatatcccttcacagaagattgcaatatagatctagggcagacagagagtctacaaaagtaaaagtgattgatgcaatttgtttctttggtccaccttcaggtgataataggaaaggatgtgtattttcacagacttgaatactcttcaaattttttgctttgataaatgtttccattttttcattttttaaaattaaaatatgattagatgattttagttccagcaagatcaatgtggcataagttctggtgacaatagtctattgaatgcatttgaaatacaacacatttccgacttggagtaaatgtacaatatacataaacatcacgtgataatatattttataggataaataacagatgctgacagttttttgttagtggtctttaaaataatccagtattgggtaaaagttccagaaattataatttcctgtcctttttagattataccatcagtggtaaatattatgttttgattttgcagaatttctttgtcctttaaaagccctgatgaaatggtatctttaggtgctactaaaaataaaaattctcaactggattctctgccccaacttgtgaagatttgccagctctttgtctttgctctttctctaatcctcatctacattgcttctaaagcaccctttccaaaatataaatctgattatatctttcttacaaaaatgtctttgaacagatctttagagttttcagaatgaaatgttacacttgtttagcagaaatcatctgtccctatctatatgaccactgtgacctagatttcttttattctcagaatcttttacatgcccctaaaaatccagttcagtgggtctctgccttatgtgctgcttctctttgtcccaagtcaccttaccactcttcgcctagtcagctcttagttgtcctccaaagtacagctctaatgtagccatgccctagcagcttttctctttttttttctcacaacatggcctgattggttctgttccactctttctcccccagtgccatctgcattttttctgttttcattgaaaaaaatcacattttgctgtttttgtgtatttatttatatatttacttgtaagcctctgccacagggcaagaacaattttatttggcttcccatctcctgtaccaaccagaatgtatcatcatttttcgtcaatcagtacattttgtgtgaataaatggatgaattatgtcttttcagaaaagtggatgcatagatgcggtcatttgccagtccttattttgaggactatattttagcagtggtgttaaaatcgtattatctggatgccaaaagcattttgcaaaatcactcatctacaaaaaaaatgtttcaaaagtttgaaaattaaattcttggaagtctgtacttctaaagtacacatggtaattttagtgatagagatttgtaattttactggatagatgaagaataatatgcttaaaactatgaaatacataaatatatgttgatatttcattgatttcatttgatgatttcaatcacgtttattctcagttaatatattttaaaagtttgtaaagaaggactgtatagagtatccaggactctaaggttttactaactacttttgtgaggtaatttaaattctttctggcccaaagcagtacaaattaactaatcagctaaataggtgatttttattcaaatcttttaagtgactgattttgaccaaactgagttttgagtttttaataattttcgatacatgctaaattattcaacactcctcacttggcaagtgtccatgttggcattattatttttctttataggatcacaaagagataactatatactcattcttaactttttcataacaaatataatttttctacaagattgcagatgacggaaacaaaccttaagtgtttttttttttttttggcacaaatacctggtggtttcacatttctattgaaaaaatggtcactgcagtgttttaagagttttctctaaaataattttttaacattgatttacaccatcatttctatgagaaaacatggaacaaaaatcaatgtatctgctgattcgggagaactgtgtggaaataacaagaagattgtaagaagcaactaatctcctgaaaatacaaggcaacctataccacgctctgttcaaacagattcataaatctgggttttccatactgctagaatgagtcttctgttaatctatagttatagaagaaaatgtcatttagtagatttatcccatctgtccctgggttatgcgttagatgcgttgaactaggaggcggtataatagaacaccaaaaaataagtcaatacaaatcccagggaattgtctggaaaaatgctgctgctttttctacgctaggattcttgtaaggatgaagaattggttgcgtgtttggggctgatctacgtttaccccattcttggacctgcacttcttttctcctgaaggactgaaatgatttccagtgacagtttttaccagacatcactcatggttagagggcattaaagtgccactaggttctaaaaattagagttgattttaaagtgttttcttggtctcagttttctagcctaagaagcgagttaaagtggatatagattattagaaaagtcatggaataaacactgtgttttctgctcaacaaaaatggattttggtagggagacgcccttgtgaaaacttccaatgatactgcctactgtctttcactttattctctctcaagatcattagaccaccatttaaatctgaactttcttaggatttttacccccatccctttcttttattttctgtcggagttacttatgtcttggtctcattagcttcacctgtaccattttactagcctcccagccagacttcttgttttatagactaagtggcttcctctccaatccatgctacattcatcagagggttaaagctgccaaaaattacttttgcatctgtcacttttcagcttagaaaaaaatcagaataaaatcctcagtttgacttctgaaaccctcctttgtagccaaaagtgtttacataacttggaccctccatcctgccaaattacacactgtatcctaagcttgttcttgcttcttatactttgctccataatctccttgtttggaatgtgttcatttttccatttacctcaaagctcccataatgcccattttctacacagagccttctgtaggttttacaacaccaagggatttctttctcctgagtcttattgtgtttcgtatatatacaataacttaaattctcttccactgtggtctgagattacctctaccattgcacttaccacagtcttagataagtgttgatttaatttcgtttttgtttttgtcattgtcattgtgtttttcatttcccttagactctaagctctttgatggcttcaggataaaagcttcccatctctgtatctttagtgcccagtaggggaacatagtaattacctgactaacctttatctatctaaatgaaataaattagattgagtcaaccatttcaatacatttatttatattgcttattacccttgtatataattcccatctcttcaattcttcaatgtctttaatctttcaactcttgaattctagatataagcacttttaagaataggggtcatattttataccctttggtatccctgtgccttatataattcttgcagtaactacaaaaactgccaatgcttataaataaattgactttagaggaaggagatggttgagtaagagagtgattcttttcttatctttatttatttaaaaagcagaaccaacttgaaaatccatgtttttccttaaaaatgttaaaatcatttaaaaatctaattttctatgcaagtatatgtaggccaaaggattacaatgtacaacatataaaatacgtctgctaaaaagtttgcttctttcctcacattggattgaatataatgtctttctttttgtgttttgagaaatgtgtaaaagtaaataaaaaactgtagtctctctctggcactgaacagtcaacatagtaccatattttctccttgacatatttttatttgtctatggttgatatttacacgctttcttttcttttaaattatagctcccccacagtttgtggttcggccaagagatcagattgttgctcaaggtcgaacagtgacatttccctgtgaaactaaaggaaacccacagccagctgttttttggcagaaagaaggcagccaggtgagtgtgaggcttcactgcttttctgaaatctctgaacttctactgtctctgctgctcctgaaagcttgccttgcttctcttgttctcaatgtttgaatttattttatttctgaaaaagagactggtgaatgtaaaaataagtaggagtcagatgttctagcaatagcattctttatttgctagtattaatcttttcaaaattctgtctcttacatagaacagcaataaagcagtgtaacaaaattatcgttaaaagtccaaccaaaacctctgtagctatttaaaatctgtgaaggtaaagctaattttgttttcttgtattgagatacgtggtgtgatagagtcaggacatatgcagtacttagaacaatctctgtgacatggaaaacagtcaaatatttgtttaattggcccagaatttcaatcctctctcttatatacacagcataaatgacttttcttacccttaattaaagcatgcttccatttaagagtaggataaatcttttccttctccattcctcctggattcatccatagtggggttagacaggaaataatacatagtacactagaaggaacccatacctgtcttgtctttgttctgccctggtttgtcctctccagggccctctctgggcaacatggcctctcagagtctctatggaaagtcaactggatacactagttttctcatttagaactctgtctaaagttggacaactgcttagcctctaggttcgtagtcaatgagtgaaatttccaggtaaaactagattaaaaattgtgttgtttgcaaaataatttatctgtgcattcccatgggacctggagatattttccttctaaactttctagaaacatgcactactaggcatattctgaggaagagacctactggtggtcttcctcatcacattctgttattactacatgttccagaagaatttccttgggaataatggaaatcattattaaacatctctggaaatctaaaaccttggccagagatgggaaatgtaagttgcattagaagactctgttgattaaagcttacatgtgtttatctgcaacatacatgtgtgcaaggaagcctgtagaagttctgtgcagccattatgtctaattgttgtgggtttctataaattcctgtaccagctcatagtgagcagttctaacagctcagtctggatggacaaatggccttttattcctcactcagctctccttggtggagtcattcctcttgtgatttgtggaatgtaaacgtagtgacgggaatgtaaggaaaggtgatggccactgccttatcccacatcagaactgttccaggccttaactctcaaatcttctttctaatttagtaattacaaaacaggtttctacacatagagttctttaactgtttgctttaaaattcttttcagatgttagcgtctcagactctaaagtaagtgtaaggcagcatgacaattaaacacatacacacacacttagacacacacacatatacacacacatgcagagacagacacacatatacacacacataccacacacatacacatacgccacacacagagacatgcacacatatacacacataacgcacatacacatagacatacatgcacacacatagacacacataaacacacaccactcacatacacatacacatacatacacatacacacacacacacacacaaaaaggagagaattcaaaatccagtttcctccttataaattgtacaacttttgtagtgctatttaaatgtactggaactcattttcttaatctaaaatacagagctaacacattttacttcacacaaacaaagtttaaatgaataagttgctttacacattatgaaggttaagcaaaatgttatgtcactggtagtaaatataatgatgtaaagcaatttgatcattgcatactcacactttaaatccatgtattgagtgaaatctcattataatgtgacttgttattatatagctaagaccatatcaggtgtaaatcacattccctaaagtagctccaagttgaattacaaggtagtgcataaaatgtgtattggccttgtagcttaataaacataggatatttaaatatgctacatctttgttaatggtttcaaaataaataacaattaaatagcatttcagtattcctttttctgtatttgacgaagtggcatataattccagagatattaatgttaaagattacataaaatcttaagtctagttttcttttcctcacctatctctctcccatcagagagatagaggtagagatagagagggatgtggtgggagagaaagagagagagagagagaaagagaaagagatacacagagagaaaatactgtgaatgagaacaagagagaagtgcttgagcaaattataaattctcaaatcatgaattgggatattgggaaaaaataagtcggtcttactatttccagtatccagtttttacagttatctatgaccatccatcagtagaaacagttaaaagcctgaacttaatggtccatatttctcaatatatgctgataatgccaattagctctaataggatacccaggcactctccaaggcgggaagagctgtgaagttcccggtttttgcttgtaatccattttcttttgcctatgtcatgcaagcagagaagaaaaatgatgggttaaccttcatataatgccattttccatgtcaacgaatcatttagaaggtggactgatggtacattgtagaggaagccatcccgtagagaataaagcccatctgatatattagtgctatgtaaattagtattctaatggctaattgtgggaaagtgtgcactttgagttattgtatcattttcaagtgacttcaaaatttagactctctcttttagctcgtttattttgataatacatttggaatctacagtagaatcagctgattctcaaattgtgtttctatgcatgaaaatgtctagccttatataatagtacacattttataagaggtcaatagcatattgaaattacattcctgacatgctagcaaacatcactcgttttagacggagtttaataacatggtaatgtttatgtaaagtgggcttatagtgtcacacttgaatctaataaagtggacatccatcatgttgcaataaagagaagagcttctaattaaaacaggacatcatttgcaggattaaagtcattgagcataattgaaaagtgttaataccctattttatcctcttccattggtattacttcaagggtaaaaacattttaaggtgaaaatgtgtcctgggcctttaattgaatgttattgcctcctgattgcaacgtattgaaactgtttaattacaaacctggaaaattaattactatatggagaaacagatcccagagggttaaaatgtccttttttgtaagtaaatacaacataaaaattgatatctccttatttataatccaacttggaaacatgccccaatataatttattatactcaaatgtttttcttaattgaacaacagtaaagcaacacagttcatccaaattaatgttactcctctcatagatgaactttcacaatttgtaattaggctatatgtatatatgagatatagagtaaactaaagtaattttgttttaaaaagaaagtaatattatgaaattgtttaaggtaacacacttttagaaacattctacattttctttttatcttcagtaatttgcttactcttgcttaaattgtagcatttgtttataaccccattcaaagctgcaaaaactttacagcagaagtacagtcagctctctgtcacacacttttgaacaactttgggagaaattcagttgagtccatcaagtattcaaaatgatcaacagcaatcatattttgcattcttcagagctgtgcggtttatacaacccatacacagtcaatgttatggccagatcttcatgaggccttagtagttgagtcagataagaattgttttgcccattttccagatgaagaaaaaagcttcaaagatattaagtaactagcagaaaatcaggatgagataaagatccccattctttaaaaacacagatgattattctttcaactagaaaatattgacttcttagaggatattattccaccatgatttggaaaacctttatcagtgaaacccactgtgtggcatttaaacatttctgaaccatatatattttaatctgtgtattttctttttcccactgtattccttaattgtagtagcttttattcacataatttttttaagtggaaaatgaatattgatgagattgtgcttgcttccacagaacctacttttcccaaaccaaccccagcagcccaacagtagatgctcagtgtcaccaactggagacctcacaatcaccaacattcaacgttccgacgcgggttactacatctgccaggctttaactgtggcaggaagcattttagcaaaagctcaactggaggttactgatggtgcgatatctttactagatttgtcttatgaaaacattgatttttatttctagatacacgttaaccatgtggagtttgctgatttgttaaatcatttctatgtatgcttatcttttaagtttgaatccaggtcacattcttttggtagtttctaattctccctgattgaataccacttattttccccaaagaagaacttcagagataatttacttaattcttaaaaatagaatagtgcatttttttaaataaatgtcatcacactcactgcatactgaaatgtaatctgtatatttttatttagtcttaggctgacatgattggctctactagacattaataattttatttcactctaggaggaggtcataccacctttaatattatcagagatgagattttagttagctaatcacattaggacattcctatgattttaattatgcattcactaagttaaattaactacctttcaaagtgctgaacaatgctaaaattattatttttattggcacatatgcactttgaatcttaactgaggcacctacattcatagtgaaagttgaaaaggatgaagggctctgcgtaatctggttttttcccagcagtttatttgtcacaattgacagctagcaaatttgagatatttcatgaacctctgagcgtgaatttaatccctattctttgatgtcttaaactgaaaattatttcttactctcctttatttgtgaggatttttacttttgttttctcccctaatgctggcttctgagatacaagtgctttggtctgtggtgtcttcttgatccccttctttctctgatggtgaaatttgatgtgcttttatacaatttaaatttacatgtagattaaaaggtcatttaaaattaatagaaaggcagtattttttaatatctgttcatggtatggcctgattcagtgacatgtcaggaatgggaataaatagaacagacaaacattggctgcagggacattgagtcgttaatggctgcacctgctgatgctgcagagatttactgctatggaactgaaaggagaagtcaggttcaaggatagcagtgatgagaaattcttccttagatgggcaaggtctttgattctttgtacctccatatttctttaaaagaataaaagataattattaatcattaaaaagatcttatgttttcacctgtcaacaaaaatgtccagatacatacacttgaaaaataagatattctgtccaaagcctatgttttattctatattcctaagaacacaccaaatgtaatgcttaagataccggctatcatttaactacttataatattttatagaagattgactctcaaatgtttctaaatgaagaaattgttatggaaaaggcaaaccatatttgtgggaagcaaagttgatgaactagaagagccagttaatgtgactgttatcgttcataaaacaggtggatattcagaattacgtctgatacaattaatggaaaacctttgaggccttacactagctcatgctatattacaaaacagtagttagtctagctttctttctgtggtcaaaaataagtgatgaccaatgttaaatcttctgccaactgagattgctctaaacattttgttacaactggcttgagtattaattcctatattgatttttacttgagtaagcaattacaaagtcaagatccttttgcagagacattgattagaagttacagtgttgttgattttgacagtaaagaaatgaaactataagaactaaatatgtacacacatgttatcaattaatctgtctctaaatatgaagttgccacattggctgatgccttaagcttctacccatagttttgatttttcatacaggttaatgatttaatactatctgagccattatttcattttgaacacatttattttgatataattcagggaattgtagagccatttgaaattccatggtagaatgaaaacgtatgtcatgttcagagaaagaagtgattacaggcataccttcctttgttgtactttgcagataccatggtttttacaaattgaaggtttatggcaaccctgggtcaaacaagtctgttggtgccattttactaacatcatgtgctcacattgtgcctctgtgtcacattttggtaattctcacagtatttcaaacaatgccattattattccatctgttatggtggtggtctgtgatcagtgatctttgatactactataatttttggggggtatcacaaactgcacccatataagatggtaaacttaactggtaaatgtgtgtgctctggtttctttacccactggtttctttacccctgttgttctgtctttccctgagcctccctattcctcgagacacaacagtattggaattaggccagtcagtatctctacagtggcctccatgtgttcaagtgaaaagtcacatgtctctgactttaagttaaaagctacaaaggcttaagtttagtgaggaaggcatgtcaaaaactgagataggccaaaagctgggcctcttgttctaaacagttagcaaagttatgcatgcaaaggaaaagtttttgaaggaaagtaaaagtgctactccagtgaacacaaaaaatgataagaaagtcaaacagcctattgctgatatgaagaaagttttagagtctggatagatcagtgagtcacaacattcccttaagccaaagcctaatccagagcaaggccctaactgtcttcaattccttgaaggctgagagaggtgaggaagctgtagaagaaaaatttgaagctaccaggggttggttgatgagatttgaggaaaaaagccatcttcataactaaaagtacaaggtaaagcatcaagggctaatatggaagctttatcaagttattcaagttatccagaagttcattcatgaaagtggctatactaaacagattttcaatgtagacaaagcatgcatatattgaaagaagatgttacctaggactttgatggctgaagaaaagaagtcaatgcctggctttaaatgacagactaactctcttgtaagtaactaatgcagttggtgactttaggttgaaactgatgctcatttactatttcaaaaattctatgacccttagaattattccaaatctactctgcctgtgctctgtaaatggaaaaacaaagcctgaatgacagcatatctctttacagcatggtttacctaccgaaatattttaagtacagtgttgagatctactctgcagaaaaaaaaattcctttcaaaatatgacttctcatctacgtgtaccttgtcacccaagctctgatagagatgtacaaagagattaatgtttttatacctgttaacacaacatctgttcagcagcccatggatcaaggaataatttcaactttcaagtcttatttaagaaatatattttccaaggctatagctgctgtagacagtaattcaactgaaggatctgggcagggttaattaaaaaccttctggaaaggatataccattatagatgccattaagaacatttatgatttatgggaggagggcaaaacatcaacattaccaggagtttggaaagttggatgactttgagggggttccagacttcagtagaggaagtaactgcacatgtggtacaaatagcaaaagaactagaattagaagtggatcccgaagatgtgactaaatggctacagtcacatgatacaaattgaacaaatgaagaattgcttcttagggatgaccaaagaaagtgatgacttgagatggaatctacttctattcaagattgttgaagtgataacaaatgattcaaaatatcacataaacttaattgataaagcaacatcagagtttgagaggattgtctccaaatttgaaagacattttactgtggataaaatgctataacacagcattgcatgctactgaaaaatctttcctgaaaggaatagtgaatcaatatggtaagctttattgtcttattttaagaaattggcacagctaccccaatcttcagcaaccaccaccctggtcagttagcaaccatcagcactgaggcaagatcctccatcaccaaaaagattaccactctaggctcaaatgatcattagcattttttagcaataaagtatttttaaggtatgaacttttttttagacatagtattattctacacttaatagactccagaatagtgtaaacatagcttttatacgcactgggaaaaaaaatttgtgtggccttccttattgcaatatttgctttattgttgtggtctagaaccaaacctacaatacccctgagatatgcctgtattccgtttagagcagtgtatctgttgtcacatttttgcgcttagactcattttctggaaatatttataattcaaacattcataaaagatgaaattgctaatgatgctgaatagtgctatgttgagcaacaattttactgatcatagattaagctaatatgtttcaatatacttgagtttcaatatatttctctaaaagacttccgcattagttcactggcattgttctgtatttcttctttccttttgctctatctttttctctcagagaattaggaaattgtaatcagcattctgtgaatagagccaatagaagttaaaaagactggggagataagatgtatttatatcttgtactgacaataaatgtcacatcatgatcttatatgaatggtttattgagtatttataatgcatagtgagagaaaaccgtggagttgttcacagatcactggaatccctaaatgttcatttaacctttgacttaagtgtcatggaaacctgtggtcatctttcacccataacatccttggaactgaaaattatgtctggccaggagattttcaattactttattgatcaattcattcaaaaggtgatgagctactcattagggcagtaaaaaaacagaaagaaaaaaactaattagatgacctttggctgcatctaatgatttcagggatatgacaataaaagcaggttataagaagttacctgaattctgcataggtatttaatttggaaaaaaaatcgtttaaaatttaattagtatgctttactctggtaacacagactcactttctcactgcattaaaaaattactcatagtgttttgttcattggccttctctttttgacccataaaaataagtcccatgaaacttttagtttgaatttctatttgcctaattactgacagatgtgccagaattattacaatattctacttcaatattttcttaaaatgttttatttagtattaaaagtaagaatttgatgaaaaaagcagtgaaataaatgattctaatttttgtttgtgaatgataaacagtttttattgtttttcttaggttttatcactgataaaataggtttaggttgactagaatctgcaatgtcttgatatgaaggtaacctgtatcataaattctagcttcaattaaatttggttggctttctcatgataggttctgaaaaggctgcttaactttaatcttttgttccctaaaactatgaactctagtaaatatgatgcaagtaaattggaaagatagtaattttaagctgccatttataaaagctggtgggcaaaggaaatttgaacgttaagcaaactgttttcaattgtatacattgcaatacaaggtgagttttttgagaaacaacagtttatcttcacagttgcttagaaattattagaatccatcattcattttttcttttttgtggaagtctttttcatatatattcttttatatactacatgtattttatatgttacatataaccatacacaataaaaagcatattttggataattaaccaaagtctatgctgtctatgccgaagtttatagaactttctctttagaaagacttccctggacctggacatgtccttttgattatatggtgatcttctaatgaattctaaatgaaatcttacctccggtcaactctatatttttcttaaccatgtaaataatactgtacattttgatgtccttcttaaataatcattaaatacttctaaaagcactgaaatgctactacgatacagttgtattgtactaccgaaatgctactacaaatacagtatttcataaataaaaagcaatactaagctaaacatttagaaattatggaaaatttatccaaatgaacacaacaattgatatacatgtaaacactgattttgcacaagcactgtttttgtcatatgataaatataatctagatgactttcctttgatcaattataagcactaattaaatcaaatcatccaaatgatatgactgtaatttgatgagctcatgtcacaattttggaaggaaattatttataatctaatattttaacatcagcagaaatattttagcctgtataaatacagcacataactggtgccataagggggaaattatgtactatatttatgataaatgcaaaagtgaaaattggctgtactcatatgatacttcacacactttcttaaatatgcatatgagataaaatgaacatttcataggtgactgactgccataagctattcaaattttaattttaatacgactaagcctttttatacaattaagtctttataaaatgtcagaatttatctcaatgccattttaattataggtaatgcagaggaagttattgacaataaatagtatggccttagtatagtatatatgtatgtacatatatagatgatagatatatgatagatttagaatatacatgaccaagaatatacatattgcttagaataagttataagtaatatatattgtgttggggctttaaccttactttcagtgtcaatatatcaagcctactgaactacattgatgttaaaatacctgaaaagagctttattcttcagttttgacagatagacctccacctataattctacaaggcccagccaaccaaacgctggcagtggatggtacagcgttactgaaatgtaaagccactggtgatcctcttcctgtaattagctggttaaaggagggatttacttttccgggtagagatccaagagcaacaattcaagagcaaggcacactgcagattaagaatttacgggtaagtaatattggacttgtacatgaattatcatctacacataagtactgctctatggaaaaattgcatagtgaacttaaaatcttacatcctagtataattgctgcacgtttaaaaacagttaatgttattacttattttaaaaatgatgaaatgaaattagaggaaaggtcacagtttttacgttactcacacattcataacagaatctcgaaacttttattcctgtatcccattccatatgtatacagtcaacaaatctagaaatcttaaacacatagcattaatatgagtagtagggtattggaaatgacaaaaacaacaaatgcttctgatttactttcattcgcaaaagaaattgtaaggaaatgtagataaagtggcttggccaaagagttgagtagaagaaaaataaagagatgagactgagtacataaacggcgagtttgcctggttagtgggaaaccttaggttgtaggttaagttgttgtgtagtttagatttaaacccatggaaagaacaaggcattggtggttttttactgacgtttacatgataaaaaatgagcattcctggcaacttaacaagtcagtcctgcttcaggagcaactcaaaataaaatgtctacttctgaatattgtatcagttatctattattatggaacaatatgaacaaaaatacagtggctaaaagcaacacacatttattacatcacagtttctgtgagttaggagcctaggcatgactgagctgtgtcttttgcttctgggtcttacaaggctccagttaggtgtcatttagagttgccgtctcatctgaagattgacacaggatggatttgcttccaatcaacattattcttggtagcactcagttccttgtggctactggactaacaacctcaccttatcaatggctgttggcaggaggttgcctttggttccttgccatctggatcttccccatatgactacttgcttcctccaagtcagcaaggaagagagtctcctagtaagatgggcactacagtcctgtggaacaaatcacaaacatgacatactgacacttttgcaatattatattggccagaagggaaccaacaggtcccacttacactccaggtgagggattacacaagatacaaataccagaaggatgttatcatggagggcacctgtcctctatcagtacattcaactcattcaactaggtatggtaagtcccttcctcctacctgccatgtagcaagtgctatgtgaaagctggagagtatattttagtaatcacaagattggggatgagacccagaactaaggtagatgatgtaatagtgcatgaagaaaatttcagtggaggagaaatctgtagaatcttgggtccaggttgaaattcagagccaagatgaagaaaaacaaagcaaaacagcatttagaatcttcccattctggagctaaaaagaaaggcaaaaatttttaactacacatatttccaaatgatcacaatttggcatattgttcttttataatgggaatatgtttacaattatatgtttatctgattatcgctatatcatacagacgtatatcagaaaacaaagtgactatttttgctacatgcacacacatgcacacataagtttttactttatatatataatatttatctttaatttttgagatacaggcattaattattgctttaaatagaaaaaatgctgccaagttgagtttaaaaaagtaaattaatacagatattttgagcctgtctttttattgattgtaaattaattgttaaccttctttgaacaaaatggaagttattaaaaaattaatgccaactctctttgtgtaaacactttaacctctatttctgggctaaaggcagacttgggccatagaggttaatgcattttcactgtatcactgaattaaagggtatgcttgagtagtcaagatttctagtagtgtttgaaagaagcaattaaaggtgggtgcttgatgatgtcaaacaaactttgagccctctgacaggcttctgagtagtctctctgagatgccagctccttggggcttgtctgcagccaagtgcacaaggagaaaagtagatgatggaatttgcctgcacattaatctcattttaaagcaatttattaagggtaaaaggacaagcatggaaaagatgagaagcactcctcaccagaaaaagacattatttaaaattaaaggaataaaattaaaggaataaaatgtggtgatgatggtaataccaagagtgagttttagcaacgatatttaggtttatgaggaccccaaaatgaaaacgttgttcttttcctgtaacatgactgtccttacagggagacagaagtgggctttccaatagttcactcatacagtcaagagagtttctgtaggctgtattcctttgtgtctcactatttttttttcagtacttaatgcaagggaaaaaaataatgtgatgaatactgtgttcttctaggccagctaattggtaactgaatctttatcttttgagaagtagaatattccagcactcattaaaatatacctaccgcagctaatgtcatacttgtatctccacacaatgacaaggagatgcagttaagaagcattacctacatacttttcttttagcatttgcaagtaataacaagtgctacattttagttcaacagctataataaaatgcaaattcttttactctttcacagaccatattcaaatgaacatcccattaaaatccaacctcggctcattatatttagtttgtgagtgatgcttcttaaatgcaaagatttctaatgactataatgtgtgcacagccacatttgaaagaatggctctttctacaatggctatccccatcttccctctgtgtaatagaagacaattgtacagagataatatggcaaagaatgtcatgccagagcaatttggaacttaagttaaaatacataatggcatttaaaatcaattaagatagtgaaatggcagtaacatccaggcactaatgatttacctgagaatcaatcgagaaagcttgagtcatcaacacacttatagtttgaacccagcagatataatattccatgagcgactatatttcatcaacaattagactgatgttcatcacagaatattaattctacatcttctgccttgtctgactttgtttggtcatcagtttctcttcccagtgtgacttttcctttactcctaaattgatgagaatgaatgttgtttgcagtgtaagccacaaggcttgatcacacagaattttggagttgcctcttttattgatcttggggctttattcaaaatataatcacagaatcttctgcttcttgcatttgtaaaagaggactcttgattatattatcaactttttctgaaagtcctttgccactcttctgagaataataaaaccattttaagtgatcgatgaaatggcaagtttttattgtgatcaaaaaagagttatgaattatgatatatttatgttccctttcagcttgaaattgcagtcactccatagccacatttttttaatgatactttattctattcatttttccactactgcaatttacatataagtgaatattgaagtttttaaatgaagaagtttaccttaaaaatatttctttttctggctgggcacggtggctcacacttgtaatcccagcactttgggaggctgaggcaggcgggtcacctgaggtcaagagttcgagaccagcctgaccaacatggagaaaccctgtctctactaaaaatacaatgttagtcaggcatggtggcacatgcctgtaatcccagctactcgggagtctgaggcaggagaattgcttgaacctaggaggcagaggttgcagtgagctgagatcgagccattgcactccagcctaggcaacaagagcaaaactctgtctcggggtaaaaaaaaagttctttttcttcttcacttttttccatgtctttcaaaagaaagaaagtgtgatcccttattgtcttattgcttatttactcgggtatgttttattcattgaaacatagtttatttgagacagaacagttttgcattactgcttctctggaattttgtgagattctgaaagagttctgttctgagtcattcataaacaacttagatatagtagagccctgccataaaatggagttaagaggtaagagtattatcacagaggaagaaaaagagaggggcaaattgtttatcagacaaattaacattgaggtgcataaatattattttaaaagccctttggaccaatgttatgaataatattatatgagtttatttcattattttatgtatacatatgattgactctaatgcataatttagacaacaaaatgatacatctaattttaagaaattaaatattgcctggctgtcattgagtaattattctgcaaattgactgaaacaatttaattctctcccttctgtgcacactagatttctgatactggcacttatacttgtgtggctacaagttcaagtggagagacttcctggagtgcagtgctggatgtgacaggtgaggactttgtgaattaggagaaatcttgggccccttttctgatagctcaatatcaaataataagttaaggggggatcaaagtgtttaattcactgaatgtaaattttagcctttacattcaatgccattttttaattcatgcatgaatttgcacacaccattacatttgtggaatttaatacacttgtctttgataaccttattattttatttcctctgaagtgtaaggaattctaatgatcctatgtaaaaacacagcttacttttattaacatgtaggagaagcaaacattcacttacatacttctgattcatggagatgaatttctcactgtctaggtcaggtcctttagtagactgcttccttcttttaggcagtattgtcaacttatgcaatcaggaatgaagttttttctgtctgtcctctatagagtctggagcaacaatcagtaaaaactatgatttaagtgacctgccagggccaccatccaaaccgcaggtcactgatgttactaagaacagtgtcaccttgtcctggcagccaggtacccctggaacccttccagcaagtgcatatatcattgaggctttcaggtatgggacaattccttctttctccactgggttttgtcttagctcctttattctaaaatgtcacctgaactatcctgctgttttattaaagacatgtccaatcaatgcattttaagaattgatctcttctctctgactttattcaagaacagagttaattttttttagtttacaacttaattataagatttaaatatgcattattcatgcctaggtctatggggatccagttcataacataatcacttagctccattctttacccagaccattgtagggatttaaggtgagaatttaggcatctgaactgggtagaaaatattttaattaggcataggcacaggcactttttaaagttatgtgacatttattgaagcagaggactctggcatttatattcctaataattagagcagaacttaaaataatcccaatatttttataccatatattacatacatctattagatatgcctgagagaaaattaacaacaataattaataaatttattccatgtgcttctagttgcttaatggaaaagatgtttccacgtgttatctgaaataattgttgccaatttaaagatttaaatgtaaattagcaaatatcagtataaaattgtcctatgaaaatttgataaaatgcttacacaaatggtaaaatatgctttcatattccctttcaaatgtgcttctacgtgacagtataaattttaatggataaccactgttttttttaaacattaggacaaatgatcactttcttataagcttctctaatcattatttaaggtaatgctaggtacttaattttcaaatttcaaaatactacgtttctatcattcttatgcgtggacagttaagcatatcagaaaaataaactgaccaccctgaaaattacatttgccctttcttctgagcaaaagtggcatttgaccttagacaaactgttctaaaatggcatccatctgtggctggctgtaaatgggtcctcacacacaaattcagagagatttcaccgttctgagatgagaaatcacaatactgtataatgtacaattttattaacaatgtaaccaagggaaaatattcattacctgcttcctctcttcttttacagatatgtagtttagaaggctcagttataatattgcatgtggaaatgatgcaaaagaaaacacaccttgtaacaggaaaatgtattggcataatttactctgtagtccatttattctttctacaggttaattcttttcaaggtatatatatatatacatttacgaggaccatacttattgtataaacttgatgttgtgatcttggcctctgttccttttacaggtattcatttagtgggctgctgtgcattagcaaagggctgtcacatctcctgggctgagtttaattttgttgtgcatggcacttttgttaggtgggctcggctttgttgtggaataaattgaaatcatccaaatgtttcatttattgggctgaatacttcaagtgttgtgtgtgtgtgtgtgtgtgtttaatttccagccattaacctttgtcattgatacccaactccatttccaatcttcaaatgactgttctttaaatgaaatttctgttcgcgtttcagccaatcagtgagcaacagctggcagaccgtggcaaaccatgtaaagaccaccctctatactgtaagaggactgcggcccaatacaatctacttattcatggtcagagcgatcaacccccaaggtctcagtgacccaagtcccatgtcagatcctgtgcgcacacaaggtactttcaacagctgtcaacaagactggttctaggcagaaacatcagatatttaagaacgaggggcttgatgaggaaatatacatgtgcctgcattgctttgtatgatggctcactaggctttatccagggaaggagaaggtagcttgctgtttatcttggtgagatgtgttctctttctggagtttttgggtttattcagcaaaaaataaaaataattgggtacctctacgtcgaatgaattcactaaattagagctttactatatttcaaagggaggaaaatgtttctccttctttaaaattaattacacaataacagaaaagtggtctttaatgagtagatgcccaaatagaggtataaaaattatgtcctattgtttcggaattctgtttttatagtgcagtcgttctcacagtgtggttcctgggtaagcagcatctgcatagcctgcaactgttagaaacacacattttcaggctcaaattcaaacgctctgaggttggggcccagtgtttgttttaacaaaccctccttgtgatgctgatgtataagttttacaaccactgctacagtgaatttcgttaaatcagatgtttaaaggagcaatttattacagacagcaggaaatcaagttttctttctaaagaactcaattctttcgactataatgtaaaatacacacagagtattaaaatataatttcaaaatggaagatttcataattttatccttattacctgtctcttcaaactgagaagtcactggagtctgaggtttaatatacaatgctacattatagtttcccttctgacaagtaggaaaaagaaattaataaaatagaaacggtaattttattatttgttataacctacttcccacagggttcttcagaaagggttaattatttcttatttgtaaaagactttgaacaagatataattcaaagtagtatttttatgcaatgaaaagcaccatacagccataaaatattattataattacaatgtagttcggtgatagtaactagcatgctattataacggagaagggcaccttaaaggaatcgactgaaataaagtcaccacgtgactttgtaacgttgctgacatgatgacagtcaagggaggaggaaatgccattttgctattgttctctaagcagtaatgtgattaattttccatggcgataaagggcctgtaggtaaagaacctgtctcttgagaaagaaaaagcacaacaaggaatttgaaaatctgaaatttgaacctagtcatattttaccttccttaaatctgattgctttttactgtgtttgaattaagtgtgtaaattttattattgaacttaaaatggaaaatgtgtacaattttacgtcaagaaattgtagtaccgtgatcatttatacctttgtgcatagaaatagtttttgtgtgtagccagtgaaacgtagagagagatcagaatgggaagatatttggtgtgattgtatctggcagacctttttgatcattcgataactatgctagtcactaaatcttgactcataaaataactcgcagtgaagaggtcaagaaagattaatgaaaagttgtttgtggtctggtttgttccaatggaaagaatatatagagtgaaagacttctgtgctcttaacaaatacttaataggaaaacccacgtgttgtgtctgaaggtcaggattatttttgggtaccatactttcagcagctttgcaatctgcaaagcatttctttttcaaagaacactttgcactgtgaactcttatttttcaaaggtattaaataacagagaatctagaaatcttttatttcattaaaagtacaaatacttggattatcagcatcaaaacagaacatacatatataggcatagattaatgttattcacataaagggacttttttcaaattaagtaaaacttcattttactgtttatgttaaaaatgaaaaaaaaaaagtagaactggaaaaacattacctaagtattagtctcaattatttacgacccaatttaagttagtgctcccaatttaagtaatagctgagaaatgttcttaaaaatactttcgcgagagtgctgcatgcattgtagcctgagataataagaaaaaacaggattacgaaaataaataactttaaattggacttcctttcttaaatacaatagttggagaaaaacaattcaacaacattgtgtgccagcttaaaaagttaatctgagtatgtgtaaaattcaatgtttaatatcaatttgatggacttagctgcttacgatttatcattttttcttaatggacacagcctataatttatccttttttcttaatggaccgagaatataaaccatcatatggagaaatagaatagtacttaggagactgatgaataatgtggcataacaatgtgtgactgagggtataatattttaaacatgacctttctttcttcccttctccccaccactattcctaaacatgtctgcatgacctcgtgtcaggtattagagtactgctcaaaatgtattactttagaacatgttatcagtattataactatttctgtcaaaagtatctttgcaaatttgaggagctgtttcccctcttcccccaactctatttacctttaatgacagaattcactttcctagtccaccattacttctccatccatgctcccagactgaagtaggtcaagaagaaaacacaacctgcaaattgggacaagggattaacaggtcccttagcatcagtttttagatatatcccaatttacacatccagaaaatcattcaatacaccaacatctgtacaaagctgctctttctagagatctttctagacttctgtagagaagtcttacagcacatactttatcctttagtaataaagtaagtgatcttatacaacagtgtgtctgcatttgaatgcggatgagggattacaaatactcttctattagtatatttttaataaagatcaatatcatctttcattatgtcctaccacagtggtatatttatatatataggcttaaatgctttttgtcacaagagagttttcgttttgtttccctgtaattagttctaaagacatgaggttgatttacataaaataaattgtaattttaatatgaatttttaaaggtgggaatgattctcttctctaactgcagatatcagcccaccagcacaaggagtggaccacaggcaagtgcagaaagagctaggagatgtccttgtccgtcttcataatccagttgtgctgactcccaccacggttcaggtcacatggacggtaagctttcaaaggcaatgttaatagtaatctcttctctttcgggaaagcaaaacatggaaaatgcaaatgaacaaagagtgataataaaaattcccgccatttaaaatcaaggtgtaatcaatgatagtaaagaaaatcaacaaattaaaaagttactagaataaccatagtaagaatagattattatataaacatggcatatcctgtcttctgaattttctaacagctttcttgcgatataattagcataccataaagtgaacaacttcatgatttttagtgtatttagagtttctaaattatcaccaaaatctaattttagaacatttcatcatccccaaatgaaatcctgtgcctgttaacattgattctctcatttcccctaccgtagccctgtgtaacactaatctactctatgtttttgtagatttgcctattctggaccttttatatgagtacaattgtgcaatatgtggtcttttgtgtctagcttctttcactctgcataatgtttttgaggttcatccatgtggtagcgcgtatcagggctttgtttcttgttgttatcaaatagtattccattttatggatacttcacattctgtttattccttcttcagttgatggatgttcgggttgtttccagttttgtctattatgaataatgctgccatgaacatttgagtacaagtctttgggtggacacatgttttcatttatcttggtataaacctacaaattgttcagtaatattggtaactctccatttaatattttgataaactgccaaaatgctttccaaagtggctatagcattttctattctcactagcaatgtttcagtgttccagattctctcaaatccttgccatttttttctcacatccttgccaacacttattatcatctgccatttggattatacccgttctggtgagtgtgtagtggtatataattgtggttttgatttgcatttctttaatgactaatcatattcatcttctcatgtcctaattgaactttttttttagagaaatgtctattcaaactcttggtccatttttggacaaagagtttgtcttcttattgacttaacaagtgtttatatactctattttgtttgtcttcttattatagacttataagtgtctatatagtctagatacaaatgccttatcagatacgtaatttgcaaacattttctcccagtttggttactgtaaccctgttatgtatttaaagttgagtggcatgaagcctccttcttccttcttttttgcttaggattgccttagctattcaggctttttttgttattgttccatgttgttactccttaaagcaaactacataatcagtcaaattattggtttatgagtacaaaattgggttgtatatattttaaaaataagactaagtttataatattttaagagtaattatgattatttaggattacactttcttattccagttttgacataattttgcatagatttattctattttctgcatatattggtttctattcttctgttcccatgaagggaacacaattacgttattatttttacagtggcacagtagggggtattatctgccatgccttttctatctttcagtacccttgagtagatacaaaactaacaaagccaaaatactacgctgtatttttcacagcgtagtagttttcctcattctcaattgaaaaaagtctctgttctgttgcaagttataaggcggattcttttaagctgcatctaaatgtgggaagtctttgggtaagaatcaaagtcattatgttgatgaagttaatcactttaaagtcacttagtttcaagagtaaatagcattagatcaaaattgcatgacagcagactgggagttcttccaggagggggacgttgtctattcatctctgtaccccaagaagctatcattactagtttgcacatctatccccgtcatgggctgtaacttctgtgaggctacagccaatttctttcatttctgtttttttcagagcagagtgtctattatgaagtactctttttaataactgtttgttgaatgatcaaatcagttgttttcatacattttacactttttttaatagaagaaagaattcagttaatatcacggcatattgttctctatgactttgtagttgcacatgacataagtatgcatttgaaagagataaattaagtgaaataaagtcagactggggtgtgtccagtggtcaaataatttgtgtaactcttttattgatgtaatatttttgatttactaaatgcatgtgttatttaaattatcaaaatgttagcatttgctttacagaagtgttggggttgaagggagaaataattccccaccatgtgattaggttttgggccagctgaggaagtttcccagtggttggcaggattaatgaccaaaggcacaagacataactactgtagagaccattcgctgtcccccttctcaccaggctaaacttgaaacaatagttagcaacaactgctttctaaaatggctgcttttagaatgagtgtgggcaaaaatgataagaaacctgctgttccacaaagaaaaatagcaataagtcacttaccgaaaaatgattattctagctttactttttgtctttgttttgttcaaggacaaaaagaattacatactctttgcccattaagcatttttccacagagattgaaaagagtgcttcgacaaactagaatttcagaagtctgctaaaaccagatcagacccttagcagctaaacccatcaaagaaaattcactttgaatttttgctttatattgagttgttatgttgttttgttttgaaaatggaaaaggtaaatatgaagcatcacacttaaacagtttaactagaatgctgattttagggccacatataagccgtcttcttttttagcctgttgcttccttaacaattatgttttatcattgtgcatctctaaagccagcaaaatgctttcacttatatcagtcacttgattgtttctgtgcccttgagatatgggtattatgtgagcaaattaagtaaactgaggttcagaaagtttaagaggttgaagcctaattcaaattgagacctatggctggaagcctgaagttctcgtaatcattttatttttccttaagacaactctttttttattcatgtttcagaaaatactattttaaaaaaatatataaacccatgaatctgtggtcagactctgattgtaatcaactctaaaagaaaatcctctttcttagaatgttaataaaactcgtaacaaacatatggcctaacttgaaaatgaccacctgtcaaaatgagctccaaaatttagtgaggtagaacacacatccagtaaaaatctcacctattttttttaaagtaaatgttcagtgttttcatttctgcttccacctgtaacaacaaatttcgtcctgaaaaaaaaaaatgcattgccactgcacacaatcaagttaaactatttaattattaagccccatacgatatactggccgatgatagtgtacactgaagtgtgcaagtgtgcaaaacaatgttttgtggtaaacattagcttcataaagtccctaaaacacttaattaatgaaaaccaaacatggataaaaccaatttaccctgatttacagactcccttcatctggaaacagctgcttaatgttcttcttaaaaacacagcttgcttctttcagtattaacaagctattattgtgagttatgtctttctttcagtatataaattcacttaaagcaaatgcagagaagtttataaaatgcaaacttagtgttgttttaacatatactgcaagggtttttttgaacactgacagttttgatgaaagtcatctctctttggctctcataaatttaacttttcgcctcttggttgccttatttcatagtgtcagaaaaactcctgcttttcaaagaatgtatccaatggtagaaacataaactggtagcatgaatgaggacttgccgatcaccagcttccatgttacacctgggctcactttttttttttacctgacctcatacaagtgtagcactaatttcagaaagtctttgagggtgagaaagctttcaggtgggtgaaggaattcattcttgttgagacttatctgggaaactggaattagccgtacatagaaacacacacacacacacacacacacacacacactcacttaattgagggagttttctcgtttggacattctaagtatttccttttgttccactgtatttttattgaggctctgcatttttaactttctaaagccaatatttttagctaacattcatttgttgcccccaattaaaaataaataaaacaatactgcaactaaagaagggatattagtagttaatacatgaaagaatacgttttgtttataaactgccgacaaatttcaacatttcaacaaaagttgaaacaaatttcaaatgctgaacaaatttcaaatttcttggataaagaaatttgtttaaagctgaaattaataaccgtctccataattctcttttttatttcctctttctctacaaacttcctgaaatgaggttattccatttcttttccattaatctttacactttatttgatagtgaagtatgtcaaatttaagccttgttagactatagctattaaactatgataagggatattagttggaacatgctatcatagtttgtgtttaaatcaagtgtttctaaaaacatgacaaagtattaaaagatgcttaatttttaaaaataatttttaaaatccatagttgttttctccctgaaaatgaaacaaccataaaaccctggtaaatattttaaaataaatgtatacagagaagaatatatttcattttttaatcttgcatttttatatatttcatttttaggtgattgtcaatagcaaacaaaaacactttttaaaagttctatttggtatgagtttaatcttagattattatttaaaatagcttcttactgtatcttaaataaatgaagatatcaaaaagttgtcaaattttgtcaagaatgggacaattgaagagtcagaagttggtaaattagtaaaagtttttcatttaatatttggtaatgggcataaacgttcatatgcttttaaaacaaatgctctagctctacaactttaatctgtattatatgctttttccagccacagggactttatacatgatgtcctcacatttgttttcctgggtaaatcctgctcttcttgcctatctaagcacttacgaattcttcagggatgctttgcctctgcttcccaactcagtcacctttctctccactataggctttcttagctcttggcacctctcattcttaacatttgtttatgcttttttttttatgattgtaacttgaccatggttcagtcattattagaccactcctaccttctacctggactccatcttctcacctcagctcatgagggcaggggctgactctattttcattgtccattttatccccagagctcagcagaatttctggcacctatgagtaggaacccaaaacatgtgttttgattgagtgatgatgttagtgaatagacaaagaatgagaatggaaatccctgacaaagggcatattacatataaagccacataaaagggaattgttggatgcagaaaatgggtaagcagaggagacataaagttagagatactggcaggtctggcctttgagaggcccttgtgctaatccaaggcatcttaattaattaggttggtatcttagatactgtgaggtattttaaacaggagagagagttctcccaatcttcattttggaaacaatcttaggagcaatctgaactctaaaaggatagaagttattagaagcagagagattagctagaaagtcatgacatcactcagttgatagttatgaggacagaaatgggacaaatgaaaagaggacaaattcattgtgttgtctaaaatactttcctttagtttcaaatgcccttaactatgtttttcaggttgatcgccaaccccagtttatccaaggctaccgagtgatgtatcgtcagacttcaggtctgcaggcgacatcttcgtggcagaatttagatgccaaagtcccgactgaacgaagtgctgtcttagtcaacctgaaaaagggggtgacttatgaaattaaagtacggccatattttaatgagttccaaggaatggatagtgaatctaaaacggttcgtactactgaagaaggtcagtattcagatttcgaatataaatcaaacatgatgaaaccaatttctgttacagtacctatttgttatcttccttagaagaatggaaagatatcacctaaaagtaaattgaggaagtgtcgttttctccttttattctgagaattctatagaatctgacaagcagaaaaaaggacactaatgtaatttgaatttttcttaagtaaccatttgcaccaaatcttatgtttaagttcacttgaattggattattaaatattcccctatattttgtgtagatttagttcatttggatcatgaaagacagacgactggaaatttgagaacacaggctgttcattgtgactactcttcttttgttatagttaagtgtgacattttcttttattagccactttttcctatgggcactgccagtcaaacccatgatttctaatcaggaagggcacttgcgtatttgcagtagctttcttcttagtgaagttccctcgttctccccactttggaccttttcttacctaaaggtatgttaaagtcaatctgtgatgaacacaagctttccaccagttcatttagtagtatctctttcactaaacaagaggcttataataaatgttgtcattaaagttaaaaaaaaggagatgcgaaatgaaataaatccctccattctgcttttgtattaattttgtgctcacaactcttgtaaaaagccctttctttaaacatatttcatacaaaataagagaagcctttaaaaaatgtatataggttgcccacgttaacatctatgtgcttgaccaaagagctcttaaattatacatttcttacacaacatggcaaaaatgtcatcttcccattgttttgcagtgtgatacactggcaggggcaaaaatgcatattcaaaaaggcatcattaatctatttttaggatatgttgaaaagttgccagtaattataatagtatcttttctccttgccaacatgtttaaaaataataatcattatcatcatatctttattcatcgttaaatttcactctgtgttgcaaattggtagtattaatgagtggagcaggtaaccttaacacagaatgctctctttgaagcctgttaccaaaatcaatttcactgcagttagacttttcctctggattagacatttgtccctgttgggtatacattcatctccaatttctgtggctatgtgatggtaacaaatggaactcagctgggctgtgtctgggaatgatgagcggcgatttgggttctttcacatctgtagaacgaagctgagtcctggaataattgacctgtcaggaagcaggcacggtgttctcgccgagccagcagcaaggtgaatgagaaacccattctgaaagtcttatttttcaatgcattctacttaataactacaaggctcgtagacaagtggttggatttattcatcatgccatattttggagcaatattgtcacaaagaggaataggaaagaccagtactctattaacatgttgctgtgtgtgtcctatatctcaatgcaaatatggctatacctaagtgaaatatgtcatgacatatttacaaaacatgggatatctgctgtcaggcttttaaaatatattttaggatatttaggatagtttcaaaaaactaaaccatgtagagctatgtaagcattgatgattctacataaaaagccattaataccaccaaattatttgatattttaaactgttaagaacgatgttatgtaatactatgattttaactacccccacctttgattttaattcagagaatcactgagaatagatgaatttttccacaaagttattatttcttagttctcaggcacattaaatgagagatgtggcattctaaaatcaggaagagcttctctcttgccttttctcagtatggttgtaattagttataggagaaactataaaggcagagaattattgtaggaaatcaaaatcttcccatttcacatttgacccaacatgaactgttttcatttttatcatcagagtcccttgcccatccatataatataagttttcaatcttaacttgcgggtcaatttatagcagtcaattatttttcccagtatgggaagaaaaagaagttttttctgtgttgatgacatttatagttatgtttctgtttttatttagtaagcacaagctaaaagcataccaaaatagctatcaataatgccaccgttcagaaataacatgtgataaatactggaatatgtcttctcagaataattttggttagaagaagttatggttgtttttagaaagacagtctattagagtagagttctaaaatcagacatacaccggctcaaattctgacttgctctttgactttcctaagtctcttacagtaaccttctgtttcctcatctgtaaaaccgagataagagttgtttctacctcctgagattaatgcaagcattaaacctgacacttagctctgtgcggggtgtatagaaaacacttattagaatgttagctgtaaatttattattgagagcatattacaaaagctgttccatttgctttaaatctagatattgtatttaaagaacatttctcaaaaaaactgtcactgttgaacaccgtgtgcattcagaactcctggaagccagagtctcctgcaacttgtctttatactcatattctgaaagtagcatgaacgcacaccaaggcttatagtttgcatttattctaattacttcctctacagccccaagtgccccaccacagtctgtcactgtactgacagttggaagctacaatagcacaagtattagtgtttcctgggatcctcctcctccagatcaccagaatggaattatccaagaatacaaggtaggacccgggtgaagaaggacagctctcatgtaaaggttcccagagaaatctcagtgtctcacgaatgagacacatctctaaaggttctcttattcagtttaagtgtaaagtttttatttatatttctgtgtgacagagaatgaaacaaatgcataggtattagaacctgagttcaaggtcagagatcacacaaacccagttgaacaattaaaccacaccagtgaaatggttttctgtatagtgtgactctacaacctcaaggatttaaagagatgggacacagggtaggttgtgaagcctagaaaatggattttatctttgttattagaattctgcataagaggctttaaggcagctgtttttaaaccacgttctcagaaaaaaagatgcttcgggggttaaagaggtggagtgggttgtggcagcaccgactctcactctagatgctacttttgtgtatttattgaggttgtgtagaatatttcacctgaaaaaaagccactgaacatattttacaaaatactgacttacagaaaaaacagttgattgtctcatttttcaactgatgaatttttggctgtttagaaacatatgtatctattgtttcattgccatcatttggtgtgtaaagtagaaagtatgtctacgttttcaaaataagattctgtttgtgttgtgattagaccacatgtgaatgaaaaacccctcattaatctttgtaaaattcaaaactataatttattaataaatcatctattgatatcatttattaataaatatttctagatttctgaaaatagcatattctatacatctaatataatacaaaactagacacccatttcacctacaaaattcagagttggtatttaatattaagctgaataaatttactcaaaagtttgcagattaaattttatttctaaggaaatattaatttttacatacaattttattaaagaataacttgctaaagcaaatgaatggactaaatgtataaggctttattttaaaatgatttctatcatgttgtaaagacacatgcttaagaaacataagaataaatgcttttacaatacaataattatatagattctaagattttataagcattaggacattgttttaacagagtaacaaattatctactctgtgtgagtttgagtgtgtgtgtgtgttttaatgaggttaggaatttatttttgtaccatttggcactaaatatcctaaatttccatgtagttaaatattgttacttttttttacaacatgatgaattttttttccataagttgtaaatgttctcactctctaggcacttgccatattttggtttcaaagcacatatgtaggtaagagctaaatattccttcactaagaacacagataccatatatcaataaaagaaacacatgattcacaagaattattttttactgaaaaattctgggaacttacctgctccgaaacaaatcatatgttttcctacatatgtgtctacatgtagatttttaaatattgtataatatgaatacaaatgtggatacacagtggatttcttttcataacacatttcatcagaacaatttctatatccaagaagatgccctaaaatttgattcctacttgaaataaaagcctgacttccttaacatcaatatctaaagacttgccaccactttgttctcatgaatgtgtatgtgtgtgtagatatgtgttgatcaatattagatttattgctgtcaacgtaaatattggctttaatttcattttagtcaatacctataacttaggtcaattcatcttgttaactacttctgtgtaagttaatattttcttaaatgaaatataaattacttagatgtctacctatataccttagatattacaacttataatcaccatattttagtggattatatgcataataaatcttgataaataaaacagaggaaattatgtgttttaatccatacaaaaatgccatttgcaaccaaagaccacataccagaggtgttaaagaaatcactgtgctttctaaattactcactatgagcatgcagtgctgagaataagatataaatgaacatggcatagtttcagcttcccttattgttcttcctttaatacaggtgcatgtgcacacaaacacacttacatatacactcaaactgcagaggttgggctttagaagatgtcatttgcaaaacttctataagcctagaagatagacaggttatgattaaaaaatatttgatcagttacagtagtctcgttaccagaaacgataatcttatatccatgtgttattcactttccatttctgtagatctggtgtctaggaaatgaaacgcgattccatatcaacaaaactgtggatgcagccattcggtccgtaataattggtggattattcccaggtattcaataccgggtagaggttgcagctagtaccagtgcaggggttggagtaaagagtgagccacagccaataataatcggtgagtatcaaactatgtggtctgtgctttagaatcagtcagctgacaaggtggatgatgattttgcatcaacctactaatagtgaatatacacttatgaatgatagggtacacatatcatattgacaaatgggttaactgactagagttttttacaaaaatacttggtgcaattgatcatgctcttaaaagtcccagagccttattaaaattgcaatatttaagagtttaaatgctgaaaggtagtttaaaattacttttaatcaattgcctcattagcaattttggtgccattgaaatataataaaaatgagatagttactgaagagagaccatcatgtttcaaatctgtatgcttcctcttagtcagagaaatgtcaaaaattaacaagaaacaggtcagaataagctttgtaatctaaatataccatcccaaagaagaaatcatattaaatctaatatcatcattgcataaaattgttccctcttatcatagattatgtttgtctgttcttgagatgtatataaatggaatcatacagaatgtgattttttaaatctggtttctttcactaaggataatgtttttgaaattcatccatgtatgtattattcagtttatatgttttactgctgagcagtattcaattgtatgaatatgccatattttgtttatctgcttttcacctgacagaatgaatattactgtgtaaatgtttgtgtccttttggagaaatacctagggtctaatgtctgggtaaaagagttgtatagtttgagtttatgagaaactgctaaacaatattcaaattgttatataatttcgtactcccaccagcaagaaaaatgacttctagttgccctacattgtcaccaacatttgatgtttccagtttttgtgattttagccattctaattgggataacctgtgattttaacttaaattttcttttatgactaataatgtcaagcaactttacatgtgcttattggccattcacataatttcttttgtgaattgaccacatgtttgccttttaaaaattgggttgtctcttgttactgattagtaggagttatttgtacattctggatacaaattcttttccatgtatatgtgttacaaatattttctcccagtccatgacttccctattcattttcttaatagtgtcatttgatgaacaaaagtattacattttaatgaagtacaatttatcatttttctttgatatttagtgcttcctaagaaattgtggcttacctctagatactgaggatattttcttctagaagctttataattttagcttttatgcggaggtctataattcatctgatggtaactgcaatgtggttaaaggaatgaggcttatttatttccatatgtttttctttcatagaggttatttataagtgtattatttaatttccaaatgtttagggacttttccagatatctttttgtttctgatttctactttaattcccctgaggccagagcctcagaataatttttctttgtgtaaatttactctattaaatatggagacttattttttgacacaggatttgatctcattgaatgtttcttgtacacttgaaaagtatttgcatttctctgttttttcagtggaaggttttatctcaggtcaaattatttgttagtattatcaggtctttattgatttctatttgcgctcttaattactaaaaacagtctggaaatctattgtaattatggatttatgtatttccccctttcatctataagtttgtgtttcatgttttggctactttgttttacatgagtatgttttaagattattatatcttctttttaaatttaccctttattattattaaatggctacgtttattttctggtgagattccctatcctaaaatttactttgtctgatattagcatagctacatcatcttttgtaagtaactgcatggattgtcattttttcattctttcattttaacccatgtttctctgtatttaatgtgcagttctattaaattgcatattgttaggtgatctctgctcactgcaaactctgtctccaaggttcaagagattctcctgcctcagcctcctgagtagctggaactacaggcacatgccaccacacccggctaacttttgtatctttgtagagacagggtttcaccatgttggccaggctgctctcgaattcctggcctcatgtgatcctcacaccttggcctcccaggcatgagccacctctcctagccagtcttgtttttttttaatccaatctagcaatctttgcctttttaattgcatactcagaatgttattattaatgtaatcattggtgtgtttgtttagaattactatcttgctatttgtttgctaactttgttactatcttccaaatttcctgctttcttttgataaaatgagaaagggttagtattttttggctgctcttggattattaggtacacctcatttctttgctgacagttgctctaggatttgactataagtatcctagagcagtatagtgtcactccttttcctctcatcttttttttgttgttgttattattataccttttacttctatgtaataaacagcaatatacaaattatagctctagtgttgtttttgccttaaacatcagttatcttgcaaataaattcaaaataaaaagtgcagttctcatatttatctgatattctgctccataaattcagtccctggtcaggcgcagtggctcacgtctgtaatcctagcactttgaggggctgaggctggctgattacctgagctcaggagttcgagaccagctgggcaacatggtgaaaccccatctctagtaaaatacaaaagaaattagccgggcgtggtggcgtgcacctgtagtcccagctactcgggaggctgaggcagtaaaattgcttgaacttgggaggcggaggttgcagtgagctgagatcgtgccaccacactccagcactccagtctgggtcactgagcgagactctgtctctccaaaaaaaaaaaaaaaaaaaaaaggaaaaaacattttcagtcccctcagcttccatgagtgcttcagtcttttcaactcagggatgctgttcagcaatgtttgggttagtcttggctgcatcatattttaaagttatctgtaggtacaaagctgtgaaaatattaaagttgtccctgtttctttcccttctgtctgagatcacagccctactcttttctttcacatattttgcctagtcttctacttgtttgcaatgggagtgcatatcccaatacctgttatttcttcatgggcagaagtggaagtgtccagggaactggtcatttcatatattacactttcctgttctataacttccatttgctttcttttacacttttcatttccctctgatgttttccatgtaatcatttattatgaccatattaagtccatacacctattgtaatagctgcttcaagttcttttctccttatttcaacatccatcttgtctcatagtctacttctattgattatcttttctgctgaccttgggttatatttttctggtttgttgcttatttattttcacatgcctagtaattttttactatactgaacattgcagatgaaataaaattttgtgatcttttgaagcatgtttgtgtcctagcaggcacatacattactgtctggtcacctttaaccagtgatgtcttagtttttacattggttagtatgggacttcttatgtttgcccttattctcaagacaaaacctcagtaaaatactttcaaggcatgatcctctcctgggcttccggtgagaagcctcatatgtttatctggtcttcctaacatggtttggaagttttgcggtgaacatgagcttaaacctgtgctttcaccagatcctacaatcttctctttgcatgcacagttcagggttcacctttggatgtaaggggagagtatacacaaatttgagagcatcactctccaccatctccctctttcatatggttctcctctctattttaagtcactctggcctccctgaactccaccctgagacacctcatatcaataagattgagttttttcagctgaggtcctaactgcctcacactgtatggattgcggtgctccctaagggaaagaaagcctcacccctgcagatttcctctggtaaagcgccgttcattcaatacatgcatccccttcagttttccctgcttttatttgcttgccagtgcctttaaagaaaaataaacaaataagaaatcttcttcctagagtttacatgtttttaaagtgtttgatataagccgttctcatttttttctatttatttgctaaaatgatgcatataaagctgactgccagcttctagagaattctttctattacaaataagtattgtatatggacagatttaacattcagtcatagcgttaaaattttttagattctctaggttttctttcttttatatattaaaagcattgtagagaaaaagttacagtattaacttttctttaaattgtcttctctttcttaattagtcattcagactgaattaattccttaacctgagggaaacctacaatcttgtccttctgagattttctaaaataaattggaataagaaagaaatacaggtataccaaaaaggatttaacttacatgtgtgtgtattcatttatagtatttagaaataagcccttattttttcacttaagaagttatatatatatgtatgtgtgtgtgtgtgtgtgtatacacacatacatatatatacatatatatatatacacacacacatatatatacacacatatatatatatatactatatactggcatatatatgccagaaagacagtacaaaatatctatatctgtatatctttatgaaatggattggctgaatataattgttctaagtgaaggataactaagattgtcaagtaactgtcaaataacgtattttcctttcatagttttttttggttatctttagtaataaatactaaattcttaagtagagctttctgtttctttttcttcctagtgactatctgtttgccagatattttatctgtttgccagatatttgggggatttatttccttatagggaagtaaaaaattacaagcatacgatataaccaagctcatgtcatgacaatcacagttatgcactgaacaattgaactgtaacttaaaataataaagttaatgattattttaaaccaaatagaaaatttcacttaatttccctatcatttataaaagtctgagtcttcagatgggtaatgagtaccttttaatttactatttagcatttcatacaagtgttttcacatttttctatgagataaaagtaacctagaaaataatatatctatcttttgttcaaatagttggaatatgctgtactcaaaatgtaattataaaaatagaattacagaaattctattttttgtgtacacacacacacacaaatcacaattcaacctagaaaaggctatttgttcttcagagatttatttctttttaatatctactcttgtactgagaagccttctaattgtttctttaattactccttcgtatctaccttaacatcttgtctgatgcccttatctacacaactgttattccttagttgagaagtgatttagtgatggctaatcttcttttctgtttcaatttacactttcccattgtctattcagaactggaaacggcacttgaagtgactcaaactgtatcacatttcccctttgttttaattaaatcatgtattggcatttgatgtaatttatggttgagaattttagatttgtactatgccagaccatgtattgtttcatctattccttctcagtttagccttccttccagaaagttccattaaggaaccattaattaaaacattgtaaaaatgtaacacgctgccttacactggcgtaacattggtgttgttcttttctgtgcagtttcctatggtaagatgacttttacatcatagtgtccataattctgcatcattgcatttacagacacaaaaatgcaatcaaatacattcagatatatatccattaagcagcgtgtcatataaccaatttacattgacttaagagttttagttatcttgcttaatagtatagttattgcttctctaatcatttggcttttcacgcttacattacatagttggttataatatgtggaacagctgcaaactttcacggtaataggtacaatcgaatctgatgtgtctaattaatttttagtccaacaaattagttttgttcttcattactctccaatgggatgaagacattatatttcattatatttttttgtctgcaagaacaatggagcattacaggtcacacacatcccttgtctatgctctaattagtccaactgacaacattgtttcaaaaataccagcagcataaaaaatagcaatacaccttgagtaacataaatattgcaccttaataaaaatgaaatattatggatcctttacaaaaatgaaggccaaattttcttttctctttgttcaagaagttatttgttttctttctgataattcctaatagttaaggaaatcaccagataggtgtatgtctcatattgaaaatatgagctcattttaaatacagctttgactatgtttaataattatatgtataataatatataatattaaacatataataaatatatgtataataattaaaggcagacatagtgggaaaatgagccagatttactacataaatgacgctggtttttaaatctgaaatttaatacaaaagacctttcaggaatggattataagtatgtataaggaaatgctagcagctataataaaaaagcctgaattttgaaaagattaacaaaataaaattttatttctaattcacagctcagaccaatatgggtcagcagaatgggaaatggagtttctactccataccgttattcaggggttttggatctttcaaatcatagctctgccatttcttggaagcttaacatcctccaacagatcccctgtttctgtccaacagtgaggaaagagagtttcaagtcaaggcagtgttacggatcaggcctggagggtcgtgtgcactttttgttcctagttaccactggctaatgctcagttacttttttgaactctgctgcaaaagatgctaggaagtgtaggctaattttctgccttggaagaaaggagaagcagtgaggtaaacaagtgaattgagatttgcaggattctcaaatctagataatttatcactcatgacactgaggttgactgagaagcccttaaagcagcccttaaacttacatgggtcataattttgagtcaaaaactacatattagcctccacttcaaccctcccaaaatatatgaagtagacaatactggtgccaactaattgacaggggctctagaagatttagtgccctatataagcttactgcttacttagctagtaagtggcagagtggtttcatcaaaatcatgacttcaaagatcatgatctttttaacatattacagtgctatagctaaaacaaggaaaatcccacacattcctttgatgtgatatgctgaaatgtgccatttatattttgcttaccatttaccttttaaaagtctttcattaatcactaattaggcatgatattaacattagaaatcacttaattcccagcatctacatttcttaatctgctaaataagccaataaatcttatgattccacaagtttaagacctatttaaaatgtagattgagattttcttaattatctgagaggcctaaattttccaaacatgactagttctagaataatcttagttcagatttaaatgcatttctcagtaatggagacctcaaagttaatttttaagttgttctttaaatttagctttcaaatggattttcaaattagtttcagatactttaagggaatatatgagtttcatctttttcatattttaattatacacgctgatctctgtgaaggctgtttacataattgtcattgttttgtatagtagttttaatacttcccagaaaattaaaggatattggctcaaaataagttctttggtagaatattaaggtcaacattaagttacatgttcttgtgaattatgaacatttggaatatggaccgtgccttagcagaaaagcaatttgcaaataccccatgttaaaagttgtaattgctttcttaaaaatgagaactgtatttaaaaacacttgatgtaattcaagataagttattaattcaactcctagtacttatttttataatttataaggtgataaatcaactacgttgtgaatccatccatagcaaaccacaacacaagaggtcagtgttcttaatcacatttgcaaactcacgatttgattattcttttgaaaattatgggctatgcttatcaatacttgtgataggctcaaaactaaacaagcatttcctgccttcaaataatttttcttcatttttgatgcaccatgtttatattcctgtgcttattttcgttttaatatatactaatactatggttttttccatagggagacgcaatgaagttgtcattactgaaaacaataacagcataactgagcaaatcactgatgtggtgaagcaaccagcctttatagctggtattggtggtgcctgctgggtaattctgatgggttttagcatatggttgtattggcgaagaaagaagaggaagggactcagtaattatgctggtaagtgactatttccagctaagaaaatctcttgtctgtaggaatgtaatgaaatgaatggaaggaacagaaaggaataacaaatgagtgatttgggcttattttagaaacctgcactgtaaaatgcaattacactcaacatgctttaatgcattgctcttgacctatcgctttataaccataaggcagtctgtttgcttgtagctccagtgaagcataacaagagcacagactgataaaaatgcttaactgtttttctcaactagttctttgaaatcataaactcaaacacacacacacacacacatgcacacgcagactatgtgttacatgctatgaagccatgtttgagaagtggatttatgcatgagcattacttcaatgttcaggaaagaagaaaagtttgaaatatagcttttagtgtgtcaggatgcagattacaataggaaatgtccctcgtgaaaaatactgacaagcaaaaatctcaccagaattgataagactgatgaggcatgaattaagtgatttactgttcacttaaatagactcttattacaatgcaaatgaacagtattttaaaagaaaaggaaaacgaagaaaaagagaaagaagccgaagcagaacaataaaaagaagaccctagatggtctacatcttcacaacaatgttttcttcttagactccaagacagagtttcaagggtgtcctataatgtggccttcaaaatatctccatggtagagagagaagagagagaggacacacaaaattgtaaagtcagtgattgagagaatgaactcaatactgaagcaatgttcaattacaattttaagtgcactttattttaaatattttctccaacaacaatgataagaaatatctcacaacatttcacactttctagaattaataagggagcagttttaatttgacattattttacaaatatgtaagaagtttttgagacattatattcaatcttgtattcctaatattaaatttggtaggaagcataaatgtcttagtaactgattttgacagaggcgtcattgattattaagcttttacgatgctgtggcttgtaggctcctaaactgctgagaatgtggaaatagtgcaaaatgctaagtatagcactgacttggttgccttgtttgttatttgatgcatttatatgtttatgatcatttgattatagcattgtagcttgtgtctatatcttatgaagttaaaatttattagttacttgttagaagacatttccaggactagagaaagtactacagcatatccattgacaagaggcttccatgtttggtgacatgccatcattttgccattctcatttctcattggttgctgcctctctgcttcctcataatttgtcacccaagtgctatatcacttcaacagtgaaggattctttgcagaaaggggtgctaggcagtaactgagtgtcagagtctggaaaattaatgatactttaatgtaccttcttgttatgcagtccggttctctgccttcatcgctgaaggtattgcccatcaacctttctgtttaatcagccaccatgtcatattacatctctgtgatacactcgtataaatcatatgaaatataaggaagaactgatttaattcatggactattttgtgtttatccctttgcttgatgttagcaatgataataaaaaattgactgtgctggtcagttcggtgcaaagttctaatatattcacatttggagtgttgcatttttatcttccatacttcttcattcactcactccttataaataaaatatctctcatagttggtaagtttatactgttagtaaaattacaccagagagacttttcttcttttttttaacagcaattctttgcacaacctatgcacttaaattgaaaatatatgttgatcattgagcttgacaagaatagtgcatttcctgttacaattttttattgttattgctactcatctgcttgtagacgaactgctaactcagaaggtgctatgcccttcaggtgttttggagtaaggccaagccagagagaagcctttcagaagttttttacttaactgatagatggctcactatgaagataacagattttatgaagctcagtaaatataaacaatttaatatgagtgagcaaattatgtgaaatgctaaacacttcacacataggtcttaaaatcatcagtgaaatatacattattagacaaaaccatccaaggcacttaaaagatttgatggattttttatactctgattatctgggctgagttagtgcttattaaaaaaggattaatctgcattcatatttgagaaacagcttatcgggaaagggaatgaggcttgcctgcaacagtaaagtttctatttggagtaggaaaatgtgacctactaaagataggcactctgaaagcttcctcactcaaaatgtcaatttgccacagttatgttttctcctcctctaccccagttgtagcaggcatgagattaggattcatcctgtgaggtaatattagagttactttttgtatgttataatcttgcgaaatctctttaccttatatttgtgtaaaaattgcaagaaattcaaaatatttcatgcaattcaaaaacattttaaattgtggtgtctgcagaactttttggaaaccttagccctattcagttagtgtaagctaaaatattctgtatgtaactccttgaaagttcttaattttagatgctaacagagacttttgattgagagtcacagttattccatatgtatctctaataagcacaaagttactactctgtgattatcaaaattgtgacaagagcaagattgtctgaccaccccaacccttcttacagcttcaaggcaaacacttatttgaaatgagaactacctcaaaatagctttcaatttgctctggaatttgatttgtatgttcatctctctgcacacagacacacaaaatgctgatcaaaacaccagatatgatttccattttaggagttctaattgttcatagttatttgtagtctgccctaaatctcatgatctaatagaagttagttacttttgatctacttttcaaaatagaacaaatctaaaagttttgaagcataaagtaaaaaatgaaacttgaaaaagtgttccctgtttttcccttgctttaaaaacacaactaaataacccattaagataagggtttttaaaaaaattctgacagaaacaatacaaaatggaaatttagattgtgtactaaattgtatgtgaacctttttaaggtcatcaaatatttacataatgtgtgaagttttgcctttgtatacttaatatgcagagatacagagataagtgtctttatagaatattttgacaccctattagcagtctagaatcatttgaaaaacatattttaatgatgacgggaacagaaacagaaaatagattgtcccaaatgcttaataagaaatatttttaaatttaaattattttgctcacagcatttaattttcaattgccagatatgggccatacatactatagtgttcatactctaacaagtttgcaaattaactttaatgcattatgtgtgtatatatatataaatatataattttttcttttgagagagagtctcactctgtagcccagactggagtgcagtggcacgatcttggctcactgcaacctccaccctccaagttcaagcaattctcctacctcagcctcccgaatagctgggattacaggcacttgccactgcgcccggctaatttttgtatttttagtagagacggggtttcaccgtcttggccaggctggtcttgaactcctgacctcgtgatccaccccctccttggcctcccaaagtgctgggattacaggcgtgagccaccatgcccggcctcatgatatattttttatagggttttcagtgttctattataatactttaaactttacatgtcatgaagaatttgccactggttcatgtattaaagttaagggccactcaatgtttgtacctctgtgtctgttgtcctccttttctctaatattatttattgctctggcagtaacagaaagtttgaatgggacaaaagagcatctaaattagggaaaactacttagcttctcacatatctcttgaacagcacattttgaggtgtaacccatgagcatctgcttatttgcatattcacaatgatattcacaccattatcttaactctcttttaacagactaaaacaatcacttgatagtccattaaaaaaaaaaaaaacacaaactagaaagtcacatcagatggaaagctaattagctatactgttttcacattgcatgtgtactaatcaggcatttatttaatatctccagtgctcaattttttgcattaattatttcagattaattcttttttgttaaaagcagttattaaacgggcacaatgtgggacagatgcactgctgattcctgatttcccgcatttcagtgagccttttcatcttctctgagcatgtgcctatagccagtgttgagcagatgcaaaggttatgtcaggattgttttgcaatgcatttgagatattacacataaaattgataaggcagtatatttcaggtaccaataagaagttcctaaaagccctgatatgctttactgtctcatgaagacccttggagtttagagtcatattacctgattatgatagcatgagagataatattagtagataaccttaaaggagggacttcatttggaaatgtgtaaaatttaaagagcgatcatcatatttgatagcccaaacttgagaacagaggagttatggagagttattcaaagtaagaagtattcactatgtgtatatatattaagtggcaatatatcctctatttacttacagtatgaatcaactaattaaatttcatttattttcacctgtactcaccacaggaaaaaaaatcatagtaaatataatcaaccccttccaaagatagggtttattgggttcacagctgtgaaaatagtattttttttccttcatcccggtgattggtttagccaatccacattaattgtggtcagaattgcaggtttattgcacttttgcaagctgtacacttctaaacaccatgtttctttttaaaaataattttctagttaactaatttaatggcaaaatttgatccaaactaatgtgaagctacttgtagactttatcctactaatcatggatattcacattccactgcagaaaaactaaataactttgaatacagtttactgtctcagaacctctttgtaatatgcaaagtatattacttttctcaattctgaatcattctggagtccagatccatttggctgcaaaggtttgggtaatggatgatggacctgaactgataataacattctttggccagtccttaaaatccactttcatgttgttaggtttgtaggcttgaaactatcggctggagagagtggcttcactggctgtggctctggtggatgcttattggtgttgctaataagttccatagttacatggaggattcaacttttctgatcactacatacaattaggaatatattcagtatcaattatttgaaaatttcattttcatgagcatgttattctctattaattatagttcacacctgttgtaattatcactgtttatgagggtcataaaaggatttgtgatggtgaaaaatctgtagtcaataagtatttgtttttcttgtttcattagaacgacgtaacatgttggaactttcctgtttcaatttatattatgagtgttttgtcttatgccttctaattaggacacctttgttttaaaattaaaaatcttgatttgataaattcacaataatgctacgttgatcttgcaataccactatatatactaattgtaacaggtttgacatttaaatacaaattagttctttaacttaaccatggatttggcttaaagaatttgaaaatgtcctattaaaattggagcaaatgatggctttgccttgggccaaaccactgcttgttactctctgtacaatgatgttaattatattttgttaaaattcccagaggcctcagctctaaactaagggccaatatgtagttgttattaattgtaattaatattgactacttgtgtgtgcatgtcttcctttttttcttttttcatagttacgtttcaaagaggagatggaggactaatgagcaatggaaggtatgctacggagattgtttcattattatttttatttttaatcaggactggggaaactctatagtaagagcctattattgtaataaatgatcacttaaaagtctgagaattctaggaggaattaaatggcttaccacaaagtttaatgatctatctgttgtgcactttagaggaatcaagtccagatgtttcataactcccagatgcccctgaagaaattagtagtaaatatcacatggaatgtgttcatttgttagcaggatgtttattgcattaattagacattagcaaatgaagttgctgttgtttaagactccttataggctctcactaaattgctgtgagtgaacaattacacataatcgatcacaaagtaaatgattcatggatgatgaataggctatagattgataggactggattccacaactttggatattcaattgaaattgataaaagctgataacaaactcatatatcctcatctattttccctttgccaatatggagattgtaattaggctctggtaataacttccaatctcccatttaatcaatattttagcaaaaagagattaagtctaatgagagtttgtggatgtagcaagaaagcggttgggtcttcttattgcagtttccatagaaacacatgtttctcttagggattgtaccagaaggggtctatcaaaagaaaagtgcaatgattatagatgttctatttctgtgtaaatatgctagtaatctggaaaggaatcagaatctcatcttttatattaaagaaggaagttctttactaaatatgacgtgaaggaaattttacttatagactatactcacatgctggatcagatcacagtgtatcttttattacctttaaaaaaaacccttaatatacccctgatattttgcaatttagaacttggaaatgtgctatttatggagcagtataaatactgttcattaatttcacttcagttccttgcctccaaatcaagcatgagggctcataacaagggttacagcctagagggaacagatacgtaaggtagctgcaggaattgaggaaggaatagcccaaagtcttagaaatggctgacatagagcagtcactttgagcagttgttcccttgtggtgccaatgtatcatcaaaccttgttttgggatcctagtatgttactgatttctaccagtttcagggcagacacctgaattcatctggacattgacaaaatcccgggcaaggactccctgcgtccactgttaatgtatgtatagccttaatgaattgctggagttctttaattccagggagtctacttatattaatttgaagtcaatgaaaatcttccatttcttaacgctttatattgcatgagacgagtgtcaaaatcttgcattgagctccatgtgttgatttccttgtaatttctgttttagccgtccaggtcttctcaatgctggtgatcccagctatccatggcttgctgattcttggccagccacgagcttgccagtaaataatagcaacagtggcccaaatgagattggaaattttggccgtggaggtaagttgtgttttttaaaatagtgttatttgagttctctctctctttttttttttttgaccttcctggatttttttaaagaaacatatcagagagtatttactcccataattaaaatcaatgaaacatatgcactaacagtgttgtacatttgctaaatattttaatataaaacgattgtatcttcattaccttgagtaaaaccaaacttttaaggaagctattactaaccaagatgataaatatttataatatatatgctttcaggattactagtacaagattactgaactcagagactattttgttaactagggcttatggttttggactagaggtttcccttctccatctcatttaacatgtatttattgagcatctcctgtgtacttggcactatggaagaccataagaatataataatgatataaaaaagatggttcttgccctcatataatatgtcatgtaagaaatagacaattaagtcaatataacatgttgagagagaacttttctgtagttccacaactagtaactgttatccaaaaataaataaataaataaataaataaataaaaaagacaaaaaagtgctaagtagccacatgcaagccttcaaaatttggtgccagagtcctctccctgtgggtttgtaaggagacacaagtaacctactgtaaataactaccacctcccctgacttcaccttttcatccagtcaataggagagagctgggtttagagaatgatgagaggagtagggaactctctgatctcagtgtggcttggcaggttcatgtgagttttccgttggtggaagattgtacagacattaaatgtgcttaaactgccttgccagaaccccatgtggcatgtctaccaattgggagtaagaaagctctatgaacagaatattatttaagttgatacctgaagcaaatttaaaaatgagtcaaaagtatggaaaaaaaaaagtgtttagaaaagaagttgctgtattttaagttccacaaataaaagagacattgacctacttgagaaatggaggaatttcctaatgacttgagtataaaatacgaggaagcagaaatggtaagaaatatagaaggatagataacaaaggaccttttaagccacatagagaatttagacttcgttcagagggtaatcagaagctgttgatggatttttaagaggagaatgctgggatccaagtactccaagtactgttttaagtcatccagcctgctgctggatgaagaatggagtaacggtagaaaattggagtgattaattagaatagtgctgtaatccaagcaaagctgtatgaattctctgtaagatttctgcacttttagaattaatgaaggaggcccagggctctgttaaatttttctgagtccactataagccttgatgggttaatttcatatgtatgagtatataaccagattgactgagaactgagaaggatattcatagcatgttctctttaagaatggattaccactatgtttgactatatttgaagttgtatttcaaataatgaagctactgattattgcataagtctgcattctgtcagtaccaactatgagaaggggaactcccttcccttctgcaaataaaatacagaaaataaccattcctacttcataggtgtgtaatgaggattaaatagatgaatatatatatatatttatttatatagaatatatatatttatttatatagtgtgtatatatatatatatacgcacacacatatatatatatgtgtatatatatatatatcccaaagcttggcataccatcaatcatcaggcatcagtgcagtgagtgagagaatggaaagtaagttatatgactcctcagcttcctcttccgcttctgcaagccaacacaccccacttaggactctcacttgcccagatactctggtagtggcttcctcccctaagtgacccgactgtgagcaactgtcagctatcactttgccatgggtagtttctgtgcctgagcacctgctcatcaggaaacaagaatgtccctccccctgctatgtcgactgattttgtcaaaaggaattctgttcccacagcttttgtcaatgaaggaatagctgactcttttacctcttgtatttttattgaaataatatgacatgctattgttacatgaaaaagtgaatgcttacagatggagaaaatgaatattcagtttccacaggctaccttaacgtctaaaatatctcagtcaaatttaacaaaagggtacacctggagatttgcaaggtttttcttccattttcccttaattttcatgatgtgaaatatctcatagatgaacagcaaggccaagacaacgtttttgtagagttgactgtatcccttatccatgtgatagtcattttaagcatttactatgtgccagaaatactgttaaaattttttgtatattttaattcattttgcttgcatagtaatatatgaaatagtcatatttccattttaaggatcaagaaactaagttttctcaagataaataatttgagatctggttgtagaaaactctgctttgtattgtaaaggcagattcacatgtatgactatataaccatattcacttggaagaataagaatggatactgacattttcccacaccacatgttctcactcataggtgggaattgaacaatgagaacacatggacacaggaaggggaacatcacacaccggggcctgttgtggggtggggggaggggggagggatagcattaggagatatacctaatgttaaatgacgagttaatgggtgcagcacaccaacatggcacatgtatacatatgtaactaacctgcacgttgtgcccatgtaccctaaaacttagagtataataaaaaaataaataaaaaataaataaaatttggcaaaaaaaagaatgaaatgacaatacgtttgaatgtaataaaaatagtacttagaataataaagttactaattatagcataaatccatattttatcaaaggaaaccataaaaaaaattatttaaccattcaagtcagcaagtgcttactctcttcaaaacactgggtgagcaactatgaaaatgcagacataaatcccatatgctcctgtcttcaaatgacttcgtgatacagtgaaggagacagtcatttgtacagataattatataaaacaaaaggaaataaatgtgagtacaagtataaccaaggtgctgaaaaactacagaatgaattaccaattccaagtagaggaagcatttccataactcataggtttcaaacataagtgttaacaagcaccagtcagacagcctaaaacattaaggactggtaggtggggactgctataaatggaaatggaaaaaagacctgctaaatatgacatcacctatttaggtctagcctgttgggaggaaggctagcccagagttccaaatcatctggtattataggactctccttaacatccaaatattcatgtgcaatattccaatatttcgatgctagaatacaattcagtttattttttgaaaatgtagggatgatcaaatcatatttgaagacaatatgcagcctaaaaatcaatacagaagcacttagacttaaaggctgactataattttatctagcagggagaggagagattcaatttccagagccatagcattagttgtatagcaatattatgtaggattagattcttggaccacttttcttcattgtttaacatttgagcacacagccatttgaaaagcttgccatcgaagtggcttgcaatccacatctaaagctttggagaactttaaattcaaggtgtgtgaaattggagctcaagttggggaatcaagtatattcacttaatattcatcagtgaaggacatggtagaagcggcagaaacaaaagtctgaaaaatcacccagaatgaaggatctattgtgaccaatttggatatactacatattaaaagtttttgagaaataaaaataatactaacacttgagaatgcagtatgcttaacatcaaattttgtaattaggacatagctcaaagaaagaagggcaagaaagtagttgtgaagttctgaaatttaaaaataatgttatttgcttatacaacctggtgaaatatgataagttaaaatatgtttaacaacttcactgatacacatttaagatatttacttcaatatcttaagtacatatccgctcagctgtaaaacaagctccaaacttcaaaaccttcataaagacttaagttatgcagtgtacaaaatatagtatacatttctttctacacttgctaaagaagacaatttttagcttatgtaaaattcaaaagcaaaagtaatatttctataagaatttttatttcaggtactattgagtatcagctaatctaaaagttttaagatagttgaaaatgtcctataatgaaagaatgcagtgatttgatggcctcaagtcccatgaaatgaagctttcagaagatagcttattttaaaatgtactatataataattagattcattttaacgctacaggattaaaaacagtgttatttagtgatttctattttagattcacttagtatctttcttccaaaaagggaaaataagagctcaggagagaggcagcagttctgaattataaagcatcatgtaaaaataattcagcataccaaaatgaaaaatggactgattgatattcagtgttgctcctggagtttaattttactctagctgtattacaacatgaaactgtaattctctagttcggagttgatagcataaattaaactcaccgatcactgagattgctttttctatagttaaattctgctatattgtgaaaatggcttacacctgaaaattttcctttgttatacaagaaaaaaaatgcactctccttttctggagcaattaaatcacacaataagtggcaagttatagcttcaaaaaatatacttcatagtcggtatagtataatttttgaaatgttagcatgtatttagcagttgtagtccatgtctcttgggataaagtggaaagagatgtttttcatctgtgagttgtggattcagtatcattgcaactgtaaagtgctaacactttcattggctctaaaacagagtgaacaactgaaagcatttttctgtagtgaagtatgccaaccgtctcattcatggttaaagaaaatagggggaagggtgttttaagcagtgagacgtgaagggcgagcagtaggcctgcctgtcactgaggctgatagcttggcgatggttgtatatcatctacccttcagtggctcatgaagcccatctcagctgaaatgcaaacgtgcagtgtgacacacttatttttcatcttcagtcctgatagttttgggcttccggtgcctcattaaattgtttcatttccctatgttcaccacagatgtgctgccaccagttccaggccaaggggataaaacagcaacgatgctctcagatggagccatttatagtagcattgacttcactaccaaaaccagttacaacagttccagccaaataacacaggctaccccatatgccacgacacagatcttgcattccaacagcatacatgaattggctgtcgatctgcctgatccacaatggaaaagctcaattcagcaaaaaacagatctgatgggatttggttattctctacctgatcagaacaaaggtaacaatggtgagtcaggttcttgtgtcctgaggaggtattttcatatcatttgtgcatgagatagaaattagtatttgttgtttgacttagtgattcattaccaggtttactacctaaactaaaaaaagataccagcatgtttccagtaacttgagtaattcctaccaccaccaccgccaccaccaccaccaccaccaccaccaccgccgccgccaccaccacctcctccaccaccaccacacaccagtgccaatcggtttcatcttttagctctttttcaacctaatgatcaacaatccatctctacttccattagggcagggtagacaaaacattcctccactctcccacaacatctgcttctgagttgctaactgcatgttctgcatgggcttgtgctgtgaactaatcacatgatgccactatgacctctgccctttaacccttagccttactttacattcctgactaccgattggctgagggattgtctaatagaatgccacacaaccagtctcaggatttcagcaccaccagctctcacaacagctcagaaaggagtggcagtctctcaggttggtctcatcacagtaaggagaaatatttgtttgtcaccagcgtatgacctgtgttcctaacaaccatgaagatatactgaatcacagctcactgtcaggcatttatctgtcaaatgacaacagtttatgctaatgaaatcatgccttggtgggataaaagggaagagaaaaatcactgtccccttttatatactaactctatgaggaaatatttaaagaaaaattatgccattctactaaatactattcattaaagaacgagtaaagagaattttataataaaaagatcatacatgaaagtcaattccatgttatagataccaaaagatgaattcaactaaaatgaaaatgattttggagtagttcataatattagtatatcattgatgtgacctcctatttttggacaagatttcgaaataccatataataggattttttatctattgaatgatattctactgcactatacaagaaagttaatatgggaaattaatatttaatttccaaaaaaccatataatctttgatattgctaattcttttatggtataaattttaatatgtatttgagatatatcagctaaactgacaatctataatgtcagtatcatatagcacaaatggaaagaaacaccctttactggacaaaaatatatacctattgtaatgacttatgaatgaaattttcctggcccaaagatccttacctgtaaaatgaggaggttgtagtagacacactctaactttcaaccatgacatatacattgtatggctgatgactttgtgcatttctaatttattccatgaccccacttgtttaatttgtttggattaactatatgctatttgtttgtactgagattttgttttatttttttaattacaggttatttgtaaaagactatagtgtattatggcatgtcacaggctaccaagcatcaaagccataaagagttaaactttttacatcattagggtaacattttctaaattacttttcctcaggagatggaaccctttcagtctgaaaatgttaatgctccctcttcccttcaaaatgggtcatttgctcttcttgcctattggtagaattagctatattatagaatccagaaaattttaaacatctgttatgaatttaaacaggtttaataatataggagaactttttgaataaccttatatgtcatttagactgccatttatttataataagtctcacaattgttctgaataattaaaaagtaatttatcctgggcttcctttttatttcattaaagatatgcaaagtcacatgcagtatgtaaaaataaatctatatactataatccatggattacttaagacttttaaaaatctttctttaagtattctatatgtgttgattgccaccaccaagttttaaaagttgtcttttgagtaactgtaagcagaacacaattcacaatagtacttagtgcttttttgaatccattaatctcctgagtgacatttatatatatctatgaattatattaactacttcatctacatttgaatacaaaattacttaaattgatgatagaaagcattctttagtaggtgagagtgattattctctttttagtttagttcaattgagtttaatattagagttttgtcttatgcttataatcataggtatctttcctaagacttaaatttaagatcaaaccaccttgtggataactaatcatatggtattataagattttcttaatttgtggatagcaatgtaagcaatttaaaataatcacagtgataaaagtggacatttcagaattatttgagtgtattaccctctttgaaacacttaatatttattcaatatataagttctgagcacttccattaaaaatctaaccattaaaaatataaaatcaccagcctgagcaacatggtgaaaccccatctctgaaaaaaatacaaaaattagccaagcatggtggcactcgactgtattcccagctacttgagagtctggggtagaaggatgcttgagcctgagaagttgagcctgcagtggatgtgatcgcaccactgcactccagcctgggtgacagactgagaccctgtctcaaggaaaaaaaaaaagtatatatatagtatatatatacatatatattaatatacacacaaattaaagagtttatatatgtaagtcattaaaatatgctcccttaaaagataatataagaaattctcaccttaaagtgattgaaggttctttgtttgcaagtaacagcaacagactgtggcttacttcactcaaggttcagatctcagagaatgtaagtggctttggttctatgtatgctctccaccatgctatgaacctaccattgctcactgctaaaagaagtcaggtgtgttgatttgtaatcctacacgtactgcccataatgagagagcagaaatttcctcaaaagaagagaaagtgattgttggatagaaagccctcacatatttcttctatgaatcacccgtttcccaaatagatttttaaatctgtttggaagagtaggtaatgaatggctttcttgaactttggacaatgacttcaacagaattcagggctctggaagtagtaatttccagtaaagaaagctgctacattctgaattctgatttttctcttactgggtgaatgtggaccacgtaacactcagaatgaacctcagttgcttcatctataaaatggagatgcaagaacttgtctatttctgttactcagttctggtggtgaccacctaacatttctaaaagtaccatggaaaacgaaaagcactctctctatatataaataaataaggaataaaggaggtgaaactagagagaaagctatggaagacaagtagctcagtctgttccccttttaatcattgaaaccgagttctgatactacaacagaagaaatggttcctgtctgataattttgctgactcatcaggaaacaaaggattaaggttcatctaccttaaagacaaacattacagatgtatattcaagcaagtttattgttattctgagtcaggctgtttgtgggatactcatagggcctggagaagttgggagtaaagaaagctttagaaatcaagaggagctgggtttgctctaagatagaggatatgggggaaaaaaaagaacacaaatgagtggcatttattgaatgttctgtccattctgagtagttgatatgcattgtctcttgtaattctcaaaataactgaaaaaagtagtaactttatatctgttttacatgtgcaaaaatgtaggcagtaactattgagtaacttatccagtaagtgggaaactggtctgtaaacccagatacgaaactcttgtcctctaagcaaaagatgtctgctctccttcctcttaaaatcttttattctaccaaacaagtatactacaaggcaagatgaaagcaatttgtgtgcagggatgttctttgaaatatgtgtgaaggtgtgcatgctatgtggaaaacacacactattttataactggcaataaagtatatatccagtttaacagttttatcacttcctggtgctcaaatatgttcctattaaattacataatattcaacgtggctgatgcagatgagtaattggtagaagtaaggggaatagtaggcttctagtgatattataatacattgctaaatagccctgctacaaatagtttttgctcacaacttgcggttccagaaagatgaagtcgaaagaatcagtaagatttttggcagatattgctgtaggctgtggtgggagccacagaagttatatagtgtcccctgaaatgtcctttgttattctgctccaagaagtactcattcctcatttaactgtagtccacttttaaggaagaagctttatctacttaattttggaagagtaaaaaccatggcactgtccaaatgataaattgtattttttatatttcattaagctccatgtaatcctagatatggctcatatgctgctagcttactttcttctcatattttgtgcatgaattcatttgtattagaatgccactgaaactgattactgtattaatttttcctcctttttggaatattatatgatgttatgcttaaaatagctaagaactattcacatatgcaaaaataattgtgccattcattagttaaaaagtctataaaacgtatcttcgcaaaatatttacaggtattttcctgattgtagctgattgatttttatcagttacttttgggataaaaattgttacccttcctggattaattaaattgaataaattctaatggaaaagtttagcctatatccttagaccttgcattttccactgagagagattatgcaaaagagcattataagtgtactaaaatttgacatttaaaagaatttgttatggcccattatttcctctaacaatgaaaacatgaaggcaccagacgggaataaatcaataagcatgcttttgatacagcagccatgtttttggttcattcagctctgctgttaatgcactggggaaaaaaaaacagtatcattttgagtgatttataaaaatgtttttctgattatatcatttcattgtttatagcttttaacaactccaacatactgattctggtgttttgaaacataaatacaccttgccatctgatgtattctctttattctgctatttggcatctctgaataaatacgttattactttcaggtgggaaaggtggaaaaaagaagaaaaataaaaactcttctaaaccacagaaaaacaatggatccacttgggccaatgtccctctacctccccccccagtccagccccttcctggcacggagctggaacactatgcagtggaacaacaagaaaatgggtaaagatattttatatactagcaaaatggccagggctctcctctcctctctgttgttcatttttgccatcatcttatgttctctcactgtttcctttgccccccaccaccatgttcattgcatttccccctctttcattgtttgcactgtctatatatttttagctgataaatacaaaacagcacatattgaggactgagaatccttggccttcaagtgccttagattgtctgcaatcatgataatgcagcctccatttataatattgcttgttagtttgaaagcaagtacccacagctctgtgaactaaagagccactcctgagaagggctgaaaagggaattaaaataaccttcttcatcatcccttgcagttctctaatgacttgatgtctggccatagcagggcgccactgtagagcaccatcacaatgggataattgtagggacctggccagtgggtagaactttaatcatcagctctgatgggaatttaggggccagaacaataatagagccaatgcatactctgtaatgaaacctttttaagatacaaaattttcttcgagggtctttaaatgggaccagtttccttattctttcccaaatgtctcacaagagttagttttcctctgttactttaagctttaattgattttaaatacaaagacactgatattttttatcctctaattccaagaaaaacaaaaattggtcaaaaaatcatactgtttccttttctagtttaataattctgaatgctttgtcttccttataattcccaggtcactatttattttgactgggcctttatgtaagctaaaaatacagaaaaaaagcagtttttcttttcacaggattttttttcacttagaaatagttagatattaaaataaatctatttatttctataatggttgtttatttattatcttggcttaaaaaatcacatatacatgtttataaatttcttcttcatcctcttttctttgtacataactcctgtctttgaagtcttcagattaatttttctaactagaattttctatgtcataacattggcttcctttaatgatatcatttgcctttttttataaaataaaatatatatacatatatgctctatatatgcattatatatgtatacacacatacgcgaatattttttgtctatgtcttcctttccctccaaaagccttcatttgtctctctgagactgtagcacttattatatatgcatatattgttattttacttcttttaagttcacatttgaaatgggaaactaaaagtatatcctgtgtcctccttctctaacataaaaaataaaattctgtatatgatcttaatttatattaatgttataaatgtgtcagtgtcacataaatcatgagcaaagaaaaaccaaagatgtgtattccacaagagattaatacagagcttagaaacctgcattttaaaagctatagtcagagactacagacatggggacttgtaaaacaggaagagaaagtagtgctgttaaagctttatatgcataaagtcttgaactcatatcacatgaaaactgtggataatttggagggttttttttcccattgagtctactaaaatatacatagactatgataattcctgtaaccccctgcaataaaaccaattaaatcaaaatcaatgctaaacttctcactttattttattatcttgcagtagaattgaaaatattcatgaaatagtagatggtgcaaatttttattatttaacacaaattattttcagtataattaagatataaaacacaaaattgtttctacatatttggaaactttatatatacatatatatatatatatatatttatatgtatgtatgtagtttgagttaccttcaagtttttgtttgtcttaaatacctagtatttgctaaaaaaagaagttatcattcttactaaaaatagtggttagatcttagccagtcagtaatattgacaacaaaattcaatttccttatttttttgagctcagtttttaaaaggctaacacttgaaaattattattttaattatttgtaataaaaacatatttaaagttaatataaaaacaaataaaaattaatagattgggcatgattttgtccattttttgatattctttatacttttatattttctaatcggtaaaccatatgatactgaaaaagaaagattattgaacacagtagagtattctactattcataatattaagtaagtcaaaaaagaaatcttcagaattgatcttctagaaaatttttctataatttagaaccttcataattcaggtttaagcttttcttggcatacaaaatataaaaacttcagatacttttttgctctccatacttattagagaccagacactaacattatcctgttcctgacacacacacatgcacacacacaaacacacacaattttgtatgataagccctagctgagcaatgtggaagaactaataatctccccacagaaaggggcaatcatatataccagggaagccaggggaaagcttgtagaagttaagttttgaggtgaatctagaatcatttactcacaaataatagaaaaacatttggtggctgttggatgccaggcactgagccaaaaataaggacaaagatagcaagaaaacgtctctgtccaaaagtggtctagcattagaatagattgttagtcaacaactataacaaaattttactattgttgtgattttctgtgcaaatggagacaaatttccctggccaaagaccaaaaaaaaaaaaaaaaaaaaaaaaaagaaaataaatataatacaatgaaagacgagaaaacaggaaatagcagatagtcccattagtcttcctttggaaaccccaccctcttttctttaaggttatctgccttaactaaactgttgttttggttattcctaaagcttgctcctctattgtagtactcctcatattgcacttaactgcttgtctgtgccctttatcaatttgtacctgatgtatgaggcttgttgagtttgaaaactgcatagggtggctgggcgcggtggctcacacctgtaatctcagcactttgggaggccaaggtgggcggatcacgaggtcaagagatcgagaccatcctggctaacacggtgaaaccccgtctctactaaaaatacaaaaaattagctgggcgaggtggcggccgcctgtagtcccagctacttgggaggctgaggcaggagaatggcgtgaacctgggaggcggaattcgcagtgagccgagattgggccactgcactccagcctgggcgacagagcgagactctgtctcaaaaaaaaaaaaaagaaaactgcatagggtaggagataatctaagaagacgttttgaagccaattgtgaagccttgtatgtcatattggagttctgatgtttgagtacagatgatggattggaggatgtgaggctgaggcaggtagataaagcatggaatattgcagcagaatggctagcagaatggctaatatcatgtaaatgataagggaataaaacaaagcaaggtcaatgggttggaggaaaggtaagtatttaggagatatacccagctaatggtaatcatcaccctgaaaatattgtctctagttttttgttacaatatttagtattatttctaaaagcttagctatcatcagttttcattctaagcctttccccacaatatcaaaataaatatcaaaatcaaataaaaagtatcagaatatcaaaagttatcaaacaattgcccaaagaagaaaagtatttgttaattcaggaatataacaatgatggcaatgttttctcctatcattattcttctctcagcttgacaaaaatatgtcaaaatgtattaatccctagctataaatacagtgcattttattatactcatatgattccaggaagaattctatggtaattaaattgaaaagtggggcttttctttgctactgcagttagagattggcaagcttctgccagtgttgaactttattgtatttttattagtaatttggtatttgtatctggcctttacaagttaattcacatgaaacattgatttgttgtcatctttatcattagttgccaggcaagacagataatatgatgcctcatagttcactgacaataagtcaaagaacaaaaccttctccaggaaaggttgaccaaaagatctttggtttggcattagcagcattttcacagtctttttcaatgttactacaagaaaaagttgaaattctgtcactcaaataagatgtatatctgtaaaatgtgaaggaaactataaaaacagggctacacttcataaaatttgtagagtcatctgttactttctcatccttcttcggtaactgcatgaaacctaagtatttgttgcttgcaatggattaagacgtgaacaccatagagataacagaccattcttctccttcatatgatatacaccatgccccaactttccttcatttattcttccaggttcttctagtcttttcttttatctcattttccatttttcctcttttggtacatggtaggtagatggatctgtggacatttttcagtttcgctatcccaaaggggtaaagaatttgctccttcttgttctaaattatcttcacacacacacacaaaatgacacagaaaaattggtgataactggctaggcgcggtagctcactcttgtaatcccagcacgttgggaggccaagatgggcagatcacgaggttaggagatcgtgaccatcctggctaacatggtgaaaccccgtctctactaaaaatgcaaaaaattagctgggcatggtgatgggtgcctgtagtcccagctaccagctactcgggaggctgaggcaggagaatggcgtgaacttgggaggtggagcttgcagtgagccgagatcgcgccactgcactccagcctgggtgacagagcgagactccgtctcaaaaaaaaagaaaaaaaatagaaaaattggtgataacattaattctagttaatgggaatagctaatgaaatatgttttagttaattaatgcattaagcaatgtatttgactaatgccaaatacaatatttatatggttaggctctccttggcctgacattatttgattaataaaaatgaattgagtacaccaaattataacttttcttatgttttcttagcacatgatgcatataacacatatttcttctaatatattctctatgaattttttttttttttaaatttcatgtgtatatccccattagattttcaaaagtaaggatatcttactacctatggagtttcagaaaaatcttaggaaataacagactatttccatttgaaaaattgaatatgtgaacattttcgttcttttttccaaggtatgatatccttggcaacgaacgagtgtaagtaaggaaagtccacccattactttttggcagaaaaaaggactcttttgtagtaagagttacaaagtaaatttaattatatctagttatgaagcagaacagcacatttcatattgaaaatagatagttctcttttgattagcctcctcttacgtatttctgtttaacttaataatgtggcttaagtcagataaataaattaggaaaaaagaacaaagcattctaattagtggaatgatatgtgtgttttcaaatcaaatcaatacatacgcgtatgacttactctttttaaggtgttatattagatgtaacaaaacaagaacagttcaatgtcataactataatgcacttgaggaaaaggtattataaacatgtgaaaagttaaatactaaaataaattagtcaagagttacagaaaccagcactggaaatgacataagactgcatataatcaattttcaaagaaatgtacatcaaggaaaccttcatacaagatatgggatttagcctgcatcttgatggatttataagattaagataggtaaaactggaggagtacagcttattggaaataagttggttcttataaataaatgcaccaggatgggaagaaagtacaaagaaagatgaaaacaaattaatttatttgagcaggagattcttgttgtaaaaactgtctgaaaaggtagattgcggcttagacatattcaatggatggaataaagagaagtaaatcttcttattcagaccattctgatattttcatagatgaatttgtaagtggtgggcaggattggttagaggatgcgaaaaactgaaagcagaaaatcccaccaggacagtgagttacaatattttaaagcaataggatcttttttccacatgaaatttaattgtgatctccaacatataaaacagataaaaatggcatcaattttttagagcaatatgttctttaaattcagattagcactcattatatagtcaattaaatgggaatacagtttaaatgatggtattttctagtataaaaattgctatttgtaacacactagtgtgtgtctgttgtttataatgtctaatattatagtagatatttaggaggaaatattcctatcaaaccatacagggcttctgaaacagggtcttgcaactcacttaggtagcctcagcaagagaataaaatggccatggaaatgaaaataaaggagttacaattataactaactttgaaggaagaatctttggaattcgggaaaaagcatttaggggtctaaggaaattgaacatccaaagatgatattattcccccaaaaaaccaaccaaccaaccaaccaaccaaccaaccaaacaaacaaacaaacaaaaaccctttctgtaactatctctcacccacaggaaaatttcaaactccttgtaggggctgataaggccttcagtgaccagcctatccctaactctcttgcctcttccgtggccaattttcttctttctttgccagctcttggcatttagggaagtatttgaactcttcaaattcctttctcttcctccgggcttccacacgtgttgtttaaaatgttccttttactggtggtcaacatagccctgcccaactccaaaactagtttagacctcctgctttctacttttatggcatcttgcatcactgattatttgtttaatatcagctttccccactgaattgtatgctctgtgaaatagattcaggaccctgacacataactgtccaaaaaaataaattaagagtttttttttaaataaagtttatttttacatctgttttaggcttacagcaaaattgagcagaaggtacagatttatcccagcccccacatattgatagcctccccaactatcaaggttctccaccagagtggtacatttgttacaattgatgcgcctacactgacacatcatcatcacctagagtccatagtttacattagggttctctctgtgttgcacagtctatggatttggacaaatgtaatacatgtatccaccattattttataatacagagtggtttcactgtcctaaaattcctctgtgctctgcctgtccatggtttcctctcatctagcctctggaaactactcatctttttcctgtctccgtagcgttgacttttccagggtgtcaagtagttggaatcttattgtgtgtaccttttttagacctttcacttggtgatatgcgttcaagtttctgccatgtctttttatggcttgacagctcatttctttttagcaacgaataatattccattgcatggatgtaatgcagtttatttatccatctacctactgggagacatgttggttgcttccaaattttggcaagtatgaataacaccaataaaaatatacacgttcaagttttatgataaattcagcttttaaacaaaataaatggaaaggcattcaagtgaaaatattcaagaatcatccggacatttataagttactctttgtaagagagatcaagactagagatgtacatttctgatatttactcatatcacagtttccctaatgaatatctcccatgtaccagaaactgtatgaggtgcaagaagtagataagaatgacagctttcttgaatttaagaatctcacaaaatagtgggagaaaagaaacacagaaacaaataatctcaatataatatgaggagtaccacaatataagtattatggaattgcaattaattccatttggagtggggaagagaagacttcacaaaactgatgacgtttgaagtgactggttgaaggaagagtaggcagttacaagcaagtgatttgagaacagtcataaacagatgcagactttagagaaaaatatagtatatggatgttgaggaaatagtgcgagattaagctggaaagatgagtttatcagactaggatgggttttttagacctagctaatgagttggaaaggtttttttttaatactagttataatcactgaataattttaggcttaagcgtgatgtgaatgaagattttagagatataattctgttgcacgtgtttaacaaagggtggaagagaagatgatgataccggaagagtaggaaagctaatgagcttgtttacagcaggaaagtgatgtgtgattgtgggagtgggggtgaagtttggagaaagattcactaggtatttaagaggctgaatgtataagaccactatatccaataatattatttatcttttccttgtctgtgtttaaaaggatgttataatccatttgatttatgaaagtattcagactacagagaattgaaataaaaaagctattgattttgtctcatggttaaaactttttggattaattttctatattcacagaccacagtccctaaaaaaatatggttttaaaataattgtcatattttatactcaaaattttttaaaaggatagatctcgtgttaaagttttttactacaataaaagtattatttttattttatagggcaaggttttgaactcctgttttgtgatttgcatttggatgacaagataaagaggacattagtttctactgagaaaattaagagaatcaaagagatactgaatgcatttatatgatagtcttaatgacatatggaatgaaaggttgtcagatatctagaacaagaacaagtaaaattctccaatacttcttagataatcaatcagcgatattggcatgtaatggtgcacaagtatgaacaggagaaggaagcagttaaatctacaagcactaaattcattaattgtctttaattagcaatttggtttttccacatgagtaagtttgttgggaagttattgcctcttgtaactgtggggtaacaattagctaaaaaggtcttttaagaataaattgagatattgagataacagatgtaattacaattagaaattaagataacagccaggtgatttactgtggtgacaccaacagcttcaggaagaaataaaccgagagaacatttcagataccatgtggttgctacttattgccagtataattgtgtgcatgtatgtgtatatgtatttgtgtcaatgtgcatatttttctcatttaatttcagctatgacagtgatagctggtgcccaccattgccagtacaaacttacttacaccaaggtctggaagatgaactggaagaagatgatgatagggtcccaacacctcctgttcgaggcgtggcttcttctcctgctatctcctttggacagcagtccactgcaactcttactccatccccacgggaagagatgcaacccatgctgcaggctcacctggatgagttgacaagagcctatcagtttgatatagcaaaacaaacatggtaaatatcttcattaagtcaagagacccatgctttcaacacatggaaatttttttcagaataaattcacaagagattctgatagaactacacagctagggttaaaagtgattttgtatgactccttaatcatttagataaatgtatccactgagaaatgttaaataatttggccaaaactagaactagaactagaactagaactggaactggagctgtaactgtaactgtaactagaactagaactaaaactagaactagagcaagaattcaaatctgctgtatttcaggctaaagtgctcttggctacaccagaatcttttctaatttatggtttatcttcaattagcttatcattgaactcacatcccatgatgtaataaaagactccttttagattcctcaaagtgcctgtgattaattctgtatgtggttgtcaatatgtaaatgtgagcttctgcaaatcacatatggtcagtattagttattaaaagactctctttacctgagttaagtgcaacagaaaaaaaaagacaatactagtatcagtaagtgcataaaaagcaggagtaaatcaaaaatttcacatttctttttctaatctataaacttttgtaaactacaggtgtcagtttacctaggtatcctgtggaattaacacagatatataaatgggactaacgctaacagttttatacaggatttttgttattcaatctttctattttaattttcaaaagcccaggcttttatatcactattttaaagctccatgtcatactccaattttcttctgttgatttaccctttgtgcttgaagtctgagtaaattttttaaatagtatttgttttgttttttaaattgttctagtcatggggataaataattcttattctcattattaatgaagtatgtattattaaaatacagctaactatacatagaaagagataccaaaaggaagagtattacttaaagattattacaaacagcctcttttcttaagatattcttgaacattttccaacagtcatcagatgctttctcaaaggtcaaagacaacttaccgttaaacgctgttatttttcatcaatctgcttttaataaaacatcactatgtaagttgaagccagctgcttcaagagccacagggcttccttcacgttaactaatgaagcaatgcagtttggtcatctaaagcacagactcaagctgaagggttctcaaatttgccacattttagaaccatttggataaccttaaaatatattggtacctgggctccactcccagagaaagattctgactgccatgatctggaatttgatccagatcatgggacagccaaggttgggaccactgccgtggagatgaacctgtcttactagctgcatgactttgggcaacttgctcaacatttatatgctatagtttccccatgtgtaaaatgatggtgatgataatagtaattagctcatataggaaattagagggcagtccccaagacaacctatatttctgataccaagtacaagtttcaagggtccccaagaccaccctgaagtttcagaattctctatagtaagtcatagaactcaccaaaagattttacactcaaagctacagtctattacagtgaaaagatacgcattaaaatcagccaaaagaagaaatgcatgggacaaggtccaggaaaattccaaaagtagagcttccagttgtcctctcagtggaatcatagcgttactttcccaacaaagggtgtgacattacacaccatggagaattgccagccagggatgggcacaccttccttgaggtcctgcgacttcattttggctctgtcacacagacattgttgactacccatatggctgacctcaatttccagcccctccagaggctgaggtgacaccatgcaactccaagcccccccataatcatattgcgatgctttttggagtagcctaaggcctctaggtaagcagagagacttttatccacaggacattctaagggcttacagattacctcccaggagtagagggcaaaggcctaacctctcttgggtcgaggttcaattctttgttacatatcctagtttttgtgagaatgaaatgagtatgaacttatatactactgtccctggctgtatattagctgttattagttagaaaggcctaggttttcacccctgagttgttcacttctgtcttcccacacttagaagagtgtcccacttagtaaatgcttgatagatatttggtaaaagaatgaacaaattagttcatctccacctgctgcaaatacccatagaggacaccctgtttcttcttctgagtgtgttcctactcaaccagcaatctttcagaatgccttggctgactccacatctgggagttatgagcttgcatgtgcttctggtttggaagtgactcaccatctgggtagcacatcaacatcataggactgtttaacaaataataattcccaggctccacctcccaggatctgtttctattgattcgtgaagtaaacagcacagtgcctgtcactagaagatatttataaatgttatgtgtcctcttcctgtatttcaatttacctcttaattttgcttaaataggagtacattttttattccatcaaggtatatttgttttatcaagaggtatcaattcataagcatattgatggcaacatttatagcaagatgtgctcatctatcctcaagcttttctgtactaatacttaggaaacttgctatttcttcctatttttcaactagcaggctgtgaggaatgctgaatactaacttggggcctgaactttctaatctgttaaagattgaagattgggatctgatgatattgaggtagcttccagaattagaaatttttttaacattgaaacatctagaatcctgttaacattgaggttggttacaagttcaagaagccagttgggagaggaatattaaacaaattcgggaagattaaaatattttccccaaatcatgcaaatgacaaagaaaagtaatctaatgtctttcattcaccagccaacaataaaaatgcatagtactttttaagatctcacctaaatagcacagccttttaaataccttttatatgaaggcaaagaaaatacttactatgttaaaacatgtagtacactcactttttaatgctggtaacaaataacaataaattcatttcatttagcattttatggtttagaagaaaatctgagtagactcaaagcaaatcaactggaccctactgcccagcttcacactttgttagctacctgatttgaaacaagtcacttaaatttgaccttcactttaataaattctaaagaaggttgggccaagcatgatagctcatgcctgtaatcccagcactttgggttgctgaggcaggacgcttgcttaagcccaggagtttcagaccaacctagacaacatagtgagaatcccactctacaaaacatttaaaaactaattgggcatggtgaagcacacctgtaatgccagctacttgggagaccaaggcaggaggatcgcttacgcctgggaagtcagggctgtagtgagccatgatcgcatcactgcactccatcctgggtggcagaacaagaccccttctctccaaaaaattaaataaataaataaataaataaatgagggttgataatgcatgatctatttatttcataaggttgagattagaattatttattcattgcaaaaggtttatttaacacactagtgttccaaacacagagaatccttagatgaattgtttatgcctttgaggagtttaagactttgttgggtgagacagatacataaatagctactagagcacaaattagttgtgcctaccctaaactgggttatagtgaaagtggaaatagccttccagccttgatgtgagagagatcgtgtggggaggaagccttctagggtgggaaatgtgttcagggttgggaggtaggggatattaggtcctcatgtgacatcttttcttcataagggccagcaggcagcatgggttacacagactgagtagaattttgacactaaactgagaacaaaagtataatatttttggagaaaaatattcactttaaatagttactcgtggcgaatattcctagtcccctctagataacttcttttcacaaaaatactgggcccgtatttttttttctccgtgtgttatcctataaataccaagtgaagagtttaatggtttatgttttccttgtttggtgaggctcgtattcgtagccattgtttctgctgaaagcattatgaactcctaaattagttaatggaaaggaagaagacagtatgagttactatagcatgcatttaattaaaattatgattttgttgcatgttaataagttgcttttcttttttaaatttcatttgaattctaggcacattcaaagcaataatcaacctccacagcctccagttccaccgttaggttatgtgtctggagccttgatttctgatttggaaacggatgttgcagatgatgatgccgacgacgaagaggaagctttagaaatccccaggcccctgagagcactggaccagactcctggatccagcatggacaatctagacagctctgtgacaggtaacggaaccaatttaataggaaaaactgacctattggtaacattaaaatgcatcaaaagtcaactacttccttattgtaagatttattccactccatctatttctgtaacattttaaatgtgttaatattaaatacaaaattcaaaaaggatttggaaatacttttgctttgctgcaaaaatgataagaaaattcatgaattttaaaaagctttaaagacatgaaagaaaactcaattatatctagggctttcatgagaagttcactctactaggaaaccaagtctattacattaaaaaccttgacttttagaaatgatcttttttatatatatcaggaataacatatgaagtgaatgcaatcttaaaatgcttcttgatatttcactctgtaaaatcattcactgatggaaagtaagcacgtctcctgaataagccactttaaggttgcacaaggtattatttttagaatgaagaaaatgtgtagtgagataaaccatatgtttatgcatttcacattgctgcatctagtaaatgcttctcttccaagaaatgcagttattttttctgtttatttctttggcttcctcttgccttgttcatcaaacgaaagagttgcattggtactcttctatgatgatcccaggactaaggtataacctattttcagggatttaaatgtaccaatttttttaaagaaaactttaaatcctaaaatggacacaatgaatttggagaaaactaaaaattcagtctttctattcaaatagatatacactgttggacacacaagaaaatgcctcttacatgactgtgtagaccgagctactacaaactgaagtctggtctctgcatttcactgggtcttctcagaagaccactcatatctgtatttaccgtgatgacatctttcatcctaggagatattttaccacaatcccgcttaattcatttttatgccaacagcttccaaactttcacagattttacacaatgtgttagagttctacaaacactgatgggaactggtttatgacaggataaagcagcatcagcgcctatgattttcctctgtattcctccctgaattactcaatgtgtgatgcatgagcccatttttcagtttttcttcttatccaggggctggtctgcttgccagcctaattaagatttaagagctgcagatacaccgctgtgatttgaaatccagatccaaccgaaggtgacagagcacaagttaaaatcttcaaatgcagagagctgacttattagtgcactattatgttaagcccctttgcctgaatttccagcataatctccttcagggtaaaattctgcatatttttgcatatttcactaatgatactgaactcttttccattaggaatgcagtaacaaattgcaataatgatgaaaaacagtcagctatagtctgtgtagttcttttattaaatattataatgtcaaagatgataaatacgtctataaatcaagagaatgccattttgcacttttacatgctcacctgtgacatgttaggctgcctgatgtgactgcagctcaagcagtctgtatttctcctgtagctagtgtaatgttcattccaaatgaagcttttattgctgagaaaaaaagtctggttttctccttgaattcactgcttaattactgccatatataaaaacctcagggtgtttaagtttgtattccatgatgagtttatcctatgaataatacatctctttagtaaaagaagttgtgttctacacaaaagtagccaaatacaaactcactttttttttcctttctcttccacaataactttgtggagaaggtgtgatcaaagatttaatttgctttctatggtatgtgagtaagtgcttataagtgtgtgtgtgagagagtatgtgttagatgtgtgagtgtattagaacgtgggtgtgggtgcttgtgtagggagtgagtacgtgtataaatgtgtgagagtgtagataaggttgtaagtgtgatatagtgtgtgtgcatgcatgcatgcagacatgtatgagaatagccctgaggtagatgtatatagagactgaatattagagaaatcagcatgccaatgaatgttgttctaacatgcttatgttttcctcagacacttaatgctagtttaatggcgctgaatgaggtggacaataaaacaggcattatttctatgagctttttatgtttttaacatggtaagtgcccatacagtggatgcggatcataccaccagttactttgggttctaaatatatttgtggtgtgaataaattagtcattacctccccctgaaatgctgttagttattttcactttcatgaaactaatgaccattttattaaagagatctaacagttacaggaggcagcatgggttacacagtccctgaaaccctgaaaccaatcagaatattgggttccagtccctgcaactctgaagccaatcagaatattagttcaataacaacactgggatgggctggtaagcctgtatgtaaaattatgcaggattttacttggatatattgcacttcacagctgccacattagggaatatatcagcagttatccagggacagagcccatttttttgtaaagaaataagcatgttaactacaattagttgtttttataacaactaatttgtgagggatctcttaaattttgaaatgatgttctatgagtggaaaaggctaaaaaaaagaagaaaatatcagcagttccatatcccataatctcagtactggataatatgtatatttgcaggtctgctgttaatatttctttcttcctacaacaaacacctatcgaatgcctattacttctaatcacttggctaaaaatttagattcagtaataataataataataggtaacacatatacaacctttacgaagtgcaagccatctttctttctttcttcttttttttttttgtcggagtctcactctatcgccaggctggagtgcagtggcacgatctcggctcactgcaacctatccctctcgggttcaagcgattctcgtgcctcagcctcctgagtaactgggactacagacgcccaccaccatgcccagctgatttttgtatttttagtagagacggggtttcaccatgttgaccaagagggtcttgatctcttgacctcgtgatccatctgcctcggcctcccaaagtgctgggattacaggcgtgagccactgcggccggcccatgcaaggcatctttctaagcagtagcctgtattttgtgtggtctcattagctaagaatggtttttcacatttttgaaagggttgtaggaaaacaagaaactaactaacaaacaaaaactaagaagaatgtatgacagagacagcaaagcctaaaatatttactatctgtcattttacagaaaaaagtttgctgatccctattataaagttttaatgtatattaattcatttgatcctcacaaccctattaatagtattattttcatttaatagattaaaaacagagggttttaaagcctttgtccaggttacccacctgataaatggaagaagaatgttcaaaatcaatcagtcttactctaaagacaaattatcatgatccctgctctggaaacacacaactttcttctaatctgaggaataggtatatttaagaggaaaataatatgctggtttgttgcttcatatgtggaactgagtgtgtgtgtatataaacacacatgaataaatatgtatacaagcacaacatataattttctctctcgaaacattagtcctttttccttatgcatttaatcaagatcaagatattaattttagatgtgacttttgtgattcatttttttcacattcagttctatgtttatttaaagtgacccatgctaacaaaattcaactgtatcagcactttttgcaatgaacctcattttaataattttcattgtaatctatgctcataatgcacacctatttgattgtaataaaatacaacatatttatttattgcagctcattgcactctgtttgggctagaaagtaaacataaaggcttgtttctgtcttcaggaataagcctgtaatttcttcctaaatgccaaaccgttgggtaacggggagggagagggctacaatacttctttctgtaatttccatggcaggagtcaatggtaattgtttcccaaatttcatgacaccaccaggaaaaaagaaacagaaggcagtaggagagagtgcagggggaaaatgccctcaacgtgtagcaaagattctaactgcctcagtgatcacaaaaaggaagactgagattgtgtgctgttcagtgaaacaagtaaaaagtttccttgactgctggaccccacatgaatatcacagctgaaaggaaatcatggctctatattttgtgttacgtttttggaggtttgttgtggaactcccacaacagatcagtatggaaacaatgaaacctggtggcctcaccatctgactcgaccacacagcttttagagcctcggccactaaaatatttgacctgaaactttgcttttctacaaaacttaaaggaaaataagtttagtattagggaaaagttcagggataatgctacagtaatcaaattaatttcttagactacttttacaggtttgatgcctttaaagaacaattaaatgtgtatttcaaaattgaacagataaaaaggggaagtgggatattacacgtgtaatttttatctgagtgaaacaaggtatcaagcatcgtatgtcctaatgaagatatttttaattgcttattttgctttccatatatattacacattccttttctttctttctttttttttctgagatgttgtctcgctctgtcacccaggttggtgtgcagtggcactatctctgttcactgcaacctccgcctcccagattcaagagattctcctgcctcagcctcctgagtagctgggattgcaggctcgggccaccacgctaagctatttttttttttgtatttttagtagatacggggtttcaccatgttggccaagctgttctcaaactcgtgacctcaggtgatctgcccattttagcctcccagagtgctgggattacagatgattacacatccctttctctctgaggcacgcaggtggaattgttgcacattcaatatgtttgagtgaaagaagaagttctgtagatttgacatgtttttctacgtgtaggcaaaggtcaatatttggattaatttgtctaaagacatttgtagctgcagcttttacttaataggtagacaaataacatttaataggaaaagttcatagattaaatattggttgaaaaaatggagaatggctagtttttgtatctcataaaaatggtaatgcaacaattagcagggtcatcttataaagcacagactttagcttaatggatctaaggataagcatttatcagcaaggaaagatttagcataaaatgacatgtaaatgaattgatgactgatcataaattaattttagtgctgaagatgtaatagagacacagcaagatgccactttatcatgatattttactgctcagtaacatctgagcaacaacttaatgtcctatgtgcagtactactttaacagcttgaatacatttgagatttttttttgccttttctgcaatttaaatcagggaaatttggaaagattgaaaatgtaaacacaaataaatttggctatctaacataaattcattgttcattaaatgtttaaatatgtattgattatgtttggggctgaaacatgtcaaattggtatggagtgcttattaatttgtaagaagcctctagccgaattggttttacctggtgttcattttaattttcgtgtttatacttatgtttgtgaaagaaaatcagttatcacaaaagtgacttacttttaaatttgtagattaatgtttttattttcattcattcattatcttttcttctctctctctctttttgtggggggggggtaattgtttacctaaatcttcagctcattgctcttgtttaaatctcaacatttttccttttttcagaaaggccactagacgtaaaatcagtagatgttcaatacattttagccattttacagaaggaattctaacatcttatatactatttgattcatggaatgtggccaaatgtcttttaaaaatatttaccataaatatgcccattccatacatcttaaccaaactgtagaggaagggatgtcgaaaatcccagacagagaggcagagagacaaagagaaggagagagaaaatttctttctatgttccttgccctccgttttgaaggcaaacacaactacactaacgtgagacacttccctctcttcagattgggtcatgagatttcctgttgcccaatatggccaagtatctgtggtcacatatctttaattctgaagtcatctatctagtctctttgctcttacaagaagtacaaaagaaagaatagctgacgttctttctgtatttaccaatactcacttgaagccctggcttccatgtgactctctcttcccagagggagacaaaaagcagcagggaaaacttcatgaataattgggagttttaaggacatacaaggagcattaaaggctgggagaaaggcagagcaaagacacaaaggctggaagtagtccatttgtttagagtatcacaagtgtgtgtgtggaaatgctcggatgaagaactgtcaagttaccacagggagataaacagggttatctgaggcggaaagttaggctgattctctgctaggaggtctcacaggatatcatttctttagtgatgctaccgtggtgtaggatttactggtttcacctgtcaatagctacaccacagtcagttttataggttcagagactaaatgtgtcactatgctagatcctcaggctggaattacacagcaagcagacatagacaggaaacgaaagaaactcaactatttttaggctggttatagtggaaaaagaaaaattttagaaaacaaatcactgggccaagtgcattaagatggataaatgaggatggaaaagttacactccaaagaaacttagctgccacttaatgtaaattttttatcttaatttgaataagatattgctaaatatcaatattcaagtatatcaaagcataaccaatacacatgcatatatatcacatatatgtatactatttatatagtgtcatcatattccttatttaataaactttctaagagttcttataagaaaattctttctatagttaaaataaggacattgctaagaaattacacatcaaataatgtcatacacagaattatagaataatgaaaacgttgaatgcatttaattccatatgcctactgtttattgaatttctaatgtacaatgtcactggacaataaatatgaaaataaacatgaaatagttcctaatctccagaattccattgtctaggagaggaaacacatgtgcagtagaccataatatatagagagaactgatatgcgagtttatgtgtagtgtttggaaaccaaaggaggtagagagattgattctcgctgtaataggacagaatcatggtgataacagaaatggcatttaatttagactttaaagtttgtcagtggttaatagtgttagtggcaatatctctgtctaaagaatgaaggatgatgttacataaatgagcaaggagacacacaggctgtaagagtgaatgaggactaatacacagcaggtatattagtctgttttcacactactgtaaagatattaccggagactgggtaatctacaaacaaaagaggtttaactgactcacagttccacacggctggagaggcctcaggaaacttacaatcatggcagaagacaaaggggcatgtcttacaaggtagcaggagagagagagcaggggaaatgccagagatttatcgaacaaccagttctcatgagaactccctcactatcatgagaacagcatgagggaaaccgcccccatgatccaatcaccccccacaaagtcccccccttgacacatggggattacaattcgagatgaaatttgggtggggatgcagagccaaatcatatcagtaggctagcctagatatggaagggttgcaaatatttaattagaagtttagatatggcattggctagctgggtaaggctttaaacagaggaacacatgtatgtaagtgcttcacaaaaataatgtagaaagcaatgaggaagatagaagagactagagggaaatcaggtaggaggggtttaggagtaaaacaagatgaagattaaagagatgcttatttggaaagtaagagcaggtatttagaaatacaagagcaggcatttagaaatacagaaaacagcacagggaagggactgggagtgaactttcaaatgtttttaaactatcctccgttccagagtttcatattcttttgtgaccccctcactgaatttctttgatttttttcttatctagtatagcattatattgcaaagcctactgcattatttcttctttcattttggatcgttggtccttgacttgtggttattaacccagaaatgattctctcagaagaggctcagtttctggtgttatctcggcttccttgcagtggcctgtgtcaagggaatttgtttgaaaagtaaaaagtgtatctctgtgcttttggcaaccagaatcaaaactctatctttctttgctacacttaacacccttttaacttctccgatcattctaaccagttcagcttctgttttctctgtattgaaagtgcatgaatccgtgtcattgtatcctggcctcttgactaaaattacaaatacagcatcaaggcaacactcctaactattctgttgttgcttaaatattacagaaaaaaattaaatggtctatagcatttgactttcatctcttttatgtaaatatgtatttggtttatttagaaatcttaaattagtttcttacaaatattttttgcccctcttctaacaaatttaggataagcaatacttggtagttttttgtgtcatgaattaatggtataccaacataaatcttgtaatattaattttattaagtaggaggttatgttctcagtctgtttttgtctaagaaaacatataaaattgtaaatgacttgctagaaaattaagaaaaaatgtttctgagtatcctcacaacttacagctctttaaacgtaaaattaaaattattttcctctattctcatgttgcattttgcagaaaaaattcatattaatgctgatgatagtccttataagtgttactttttaatataaatatcagtattaaagagaaaactggagttcttaaataacttaaaaggcaaagtaagcagaaagagcatttaaattaatagaacttctttaaaatacattttttcttatgttctaagttcatttgctttgatattgtttatacattttttgtttgtgaatttttgttgttatttgtaattaagtttaaattttaaaatcttgaaataatttttgcccttttatgatatacagtgtagtttctatgcagattatcattggagtctgcgttaaattcaaaatatattcacactatttcttcaactgagtctttgataagtttaagtacactaagtttgttttactaaaagtgttaatttctgaattatagtaacttaaaatacacatcgcagctctcttttggaaaacgattgtgtaataatttaaacaatgtaagagttgaacagtgcagcacatgctttgcttatgtgctgcaaacagatacaggtttcaaatgagcttcattcttctgcacaaaaaatgtttaaaatgtacatgatacttgcatttggctaaagaaatcatgatgaaacttcaaggaagaagcatggacaacttacttgctcattagtatagtgtgtacaagcagatgagattttcaatatatacaactcactagacaactacatttgtttttaggttcaatggtaaatggatggggctctgcatctgatgaggatcgtaacttttctagtcatagatctagtgtaggtagctcctcagatggctctatctttgccagcggcagttttgcacaagcactggtggcagcagcagataaagctggttttaggctggatggaaccagccttacaagaacaggttggtagactccaagtcaacactctttgcatgagagaatcttgtccttggacactgtcctcttttctcctgttctttctccttagtgagtctgactgtagggctttctttaatacgcatgaatacagtttggatgctccattacccaaactctcttctgatgctagttttgcagagccaagaatagactcctcctcaacactttctcttattttcctttctcttcacggctttactgattaattggaatatgcttcctttttatattacggcaaagcagcaactaagattgccattaaattttcaataacacattttgcaaaatcctcatacaattaataatgtacccagtgattaaaattactcagcttttatctccattactttcctttgcctcatctctttctgcaaatgcattttctgggaaggtttccttagcatggggtgaatgggtctaaggttgtcggtcttaccagttcaaatagcttatgatctttttaattgtttggctagtaagattttaatacaataatttattatttgtcttaaaggatgctaattaaagatacacccactgcatttgcaagttgaataaaataatgactacatgtgtatttctctttagaataatttaattttgatttctgagagtgataagtaatcatataaaagaacaattatataatttttcaagtgctgctcattccacaaaaaagaatgtgggattaataatagatcagtaatttgtaaacttttgcaacaaaataacttaggcatgatgcgtgcttttacatttgtatgtataattcttaactatacatataagaatattctaatatatgaattaaactgaattaccttgcaaagcaaactaataaaacattaagtacatttgcaaaatcttaactgtaatcaaatagtaaagaaaaaagatttttacccttcactaaactctcaggttataaaaatgagtcttggaagttttcttggaattataccatcaatatttcttttaagcatacattagctatctttaagtgaaataaaaaagatcttctaagcattgcagaggtttatttttcaaatagcatccaaactaaaatacgttgtaatagaactgttatttgaattgtcttgcattataaggcataagtctgaaactttatgttgcttgagtgctttttgcagcattagctgtaaacagagcagtgagaacgtgcaaggaaactaatacattagaaggcacaagtgcatttcctgcatgtatgctaatagctaacacagcattaagtaatatcatatcacgtcgtcgtaagaaaatgtaactacatataataatgttgtatgaaatgaaaacatacacaggagaataaatgcatgcacataaaccaggcctctgttactacaataaacatggtattgaaatcataagttgttgaaaatttattagctaaccttttcccagaataaatttccccgtatacctactctaaaccacaagaaaaggacacagcacatatcatttttcaatgagaatttggagcctgctcagatacaataatattaatcagaaaatacctattgcatgctggatatacaaggtgattttaacctgctatcctctacacagatgttgttgagtttctgccaaaagagatagaattcattgtgtatgtggataagtggtaaggtcaatttaatatatgtgtctgagcagacctttcatgtaaaatttcagatgtaattactatatgacatttttctgtgttcagagagattttgtaagtttccaaggatgaaattttattaaacaaatacaacagtatatacttcataaatagcttctttaattttaagaaataaaaactgcatgaatttgcatatatctttgacaatatcaataatattgtcaaggttaaataaaagtataatcatgcaatattgagttgtggattggtggatctgttttatgttcatttgtttgattttgagggggccagtgggggtgttgttagcttattaaaaattgaacaaaatatgtgcagctgagaatgtagaaaatacatttttctacagagatgcaccaatatttggtatcttcatatgttatctctaggtagatttacaggttagtcatagtgcagaaatataggacagaatcagtgtgctataatgtcattctctagaacccattccctttattttcattttaggaaaagcctttacctcctctcaaagacctcgacctaccagcccattttctactgacagtaacaccagtgcagccctgagtcaaagtcagaggcctcggcccactaaaaaacacaagggagggcggatggaccaacaaccagcattgcctcatcgaagggaaggaatgacagatggtaggtttcttccctttactcttgtttcctcgctgaagagacgtgctccatgcaatcatttacttagattaatgtagtcatggtagattagccattgcttcattacataacaagacaaaaacctggcaatatggccttgtttaaataaaacaccatttttaaaaacaatctagaattatttctatattattaagcctcaagaaatacattccatgcaattttttgaggttgatttttttttttttgccattctggcatatttcataaatgctttttagtgagcatttaagagtagggaagaacataagctgcatgtgcacttatatgatcagaacttttatcatattaaattacaatatcttagctgctatttcacttttggaaaaaaagacttttgaaatgatttagtaattttttagtcacaaatttcagagccaaaatcaggctacagtagttgaagagtgtcttagtctgtctgggctgctataaaaaaatagagtcatgcattgtatgacaatgtttcagtcaatgacagactgcatataagacagtggtgccataaggatgtcatactgtatttatgttgtaccttttttgtttaaatatgcaaatatttaccattgtgttataactgcctataacattcggtacagaaacacgctgcacagatttttaccccagatcaatggtatgtagtcagctataccatctatgttcgtgtaaatatactacgtgacacttgcataacaacgaaatcacctaacaccacatttctcagaacttatctccatcattaagtgacatgtgactgtaccataagctggtagattccaaacaacataaattttctccacaaatctggactctgcaaagtccaagatcaaggcattggcagatttggtgtctggtgaggacccactttctggttcatagagggtgccttttcattgtatgatcacatagcggaagggacaaggttctctctggggtgtgttttatagggtgctcatcccttcatgaggactccaccctcatcatcgaatcacctgccaaaggccccacctcccaatatcatcacattggggattaggattttaacgttgaattttgggggtacacaaacatccagactctagaaaagggtcagcaaacttcttctattaaagtctagatagtaaatatctttggcttttgggacatagggtctctgtcacaactactcaacactgccattgttgtatgactgcagctataagaaaagtagaataggccaagcacggtggctcaggcctgtaatcccagcactgtaggaggctgaggcgggcagatcacagggtcagaagatcaaaaccatcctggtcaacatggtgaaaccccctctctactaaaagtacaaaaattagctgggcgtggttgcacgtgcctgtaatcccagctactgaggaggctgaggcaggagaattgcttgaaccagggagtcagaggttgcggtgagctgagatcacaccactgcactccagcctgggcaacagagcaagactccttcttaaaaaaaaaaagaaaaggaagaaggaaaataaaagtagaatgatggaaatgattgacttccaataaaacatcattcacaaaatgggcagtggctggatttggcccatgggccatagtttgctgatctagctcaatatttttatttatatatagcatccaacatttgaatacttgcttaaacactgttagtttcaggaaacacaatattactggaagatatccatgttcgataatgagtatttcattagctttacagaatatagtctatttcccgtatttttaatttaattcttataacttttaaagaatgaattaaaatatgtatcctgaagttatattctaaggatatgtaacacatatttaaagtgtgtagtacaatgtcagattgaaaggtgaatttctttttccttttcagcactgtaccctataagcacacaaacattatcctaacatagttcaattaaacaccaaaaggataaacttttaaaaactgcacattagaaccatctggaaagctcttaaaatataccctagatattcagatttaattattctggggtgaaacccagttacaggtaattttaaagctccacaagtgaatctaaagtataactaccttagagaagctatgacttagtccttagcacacttacacttatcattataggacagaatgaagcttagttgaaaaagaagaaaagcattggttttttattagtttggggaagggagtatccaatcctgcagccctatttgtgctttcttttgtcatcttgcaaaggtaagaggacttaaaaagccaaatatattgttctacatactttccggtttacttatctttcctgcttcctttgttttcaatagaatatgaaggttaagggtagaattgagatttttgagtctctataaatgtgtatcctgtggtgagtaaaaatggtcaccactgcctttctgccttatatgttcagaagattagctgagcatttaaaactattcgtagtgttcatctaattcttcgtaaataaaaaaggactactttcactgaattgctaggtataaatctagtaattgataattttgtatattttttctgttgtgaatattgtggagagagaaaaatgtctaggtatagaattttctgtggtttttcagaaatgtttgaagataatattcagaatatgtggaagatataaaatataaatcaacaaaatacagatctctttttttctaagacacttttattgcaagcttttttagaatgtttccttaaagcaagctacctcctagtttaaagtatgatcaatatattgcttatctttctaaaaaataaatgtttctaaattttcaaaattgccagcatttcaaaaaggggttatggattatgtgttattagaaaatgatacattttagaagtagtgatatagcaaaggaaatttcagcccacatatcttcccaagtgcttaatccaaagccattttaattatgatacagtgcaaagacatttattttggatggtgctctacaggttatccttaagaacattgttattttgcagcaaatgcatatgccatagcatttatatggtatggatccatatgtcagaaataatttcataactttttatgtaaaaatcaagttgttctttttgggaaggctgatacttagcagcattgattgtacagacattttacaataaaccttttgcattatagattttacaacagtgtttgctgttttctaagcagtattgtaaagatgtaggcctttttagcactgggataccatcatttctggatcagacctttatggtttctgaggggaagacagaacatgagtggttgttgggaggttgtaatggcaagtggcacacatcacttctatttcattgaaaacaactctgccacgtggtgtcaaactaactactggggtgagaaagctgccttccctgtgtcccataagagagattatgaatggtgggaaatgtcagtctgtatcccaaagactgaaaaacccacacacatcttaaagagtgttcttctcccttttgtaaagtttctccaaagcaggcattgctgagtccaaatcttgtattccatttgtcttataaatcaaagaatacccttggaagccaatatattaaccaatgctaaaaaagatagatctgtctatccatcaacctgtttctcctagataatttatttccagcctattctccctttcacctagctttttttttttttttttttttttttgagagggagttttgttcctgtcacccaggctggagtgcaatggtgcgatctcagctcactgtaactcccaccttccgggttcaagcgattctcctgcctcagtctcccaagtagctgggattacaggcatccaccaccacacccagcaaattttgtatttttggtaggtagggacagggtttcaccatgagggccaggctagtcttgaacttctgacctgaggctctctgcccacctccacctcccaaagtgccaggattataggcatgagccaccatgcccggcccctttcccctagttcttaatgtcctgttcagagaaggggctctttctcagctctgccacatactagctttggcctttgagcaaataaatttacatattaattaatctattcactcaaatacttattaagtatataacatataatagacaatgggagccaaacagacaaaatcccctgcctttttatattttagttggggaagatagataaagaccaacctaagtacatacatgaacatataagtaagatggtgataaatgttatggggaaaaaacaaagggaagggagttgagaagtataggtgtagggaggaagtatttttaagtagagtgactggggaagtcctcaccaggaagtcagcatttcagaaaagactggaataacataagcaaaaaagtaatgctgatatctgaggaaaggttattccaggaaatgagaatggcaagtgaagcttgagacttatttgataaaaaggaaagggaacgatatgactggagcagagagagaaacaagatagagtacgaagtcaggcaagcaaacaagggctagtgtttgtgagacctttaagctaccataatgacattggctcttactttgaatggtaaaccactggacggggtgtgtatatgtgtgcatgcatgtgtgtgtgtgtaaggcagggaagtgacatgatcttatttgtatattttttaaaaagtcattctattctagctgctgtgttgagatgtactaaatgaggcaaggtggagattgtggaagctacctagggaatagatgacggtggttcataccaaaggagaatcaatggcagtgttaacaaaggttggattttggaggtagagctaacgggagttgttatgaaattaacataggccataaagaaagcaaaccacattactctgaaattttggctaacttgtagaatgtaactgtgaccaactgagagaagaaacactgcagaggaagcattttttttttttttttttttttttttttttttgagacggagtctcgctctatccgccaggctggagtacagtggggcgatctcggctcactgcaagatccgcctcccgggttcacgccattctcctgcctcagcctcccgagtagctgggactaaaggcgcccgccaccacactcgggtaattgtttttgtatttttagtagagacggggtttcactgtgttagccaggatggtctcgatctcttgacctcgtgatccgcccgccttggcctcccaaagtgctgcgatttacaggcgtgagccactgcgcccggccgcatattttatataggatgatctagagctgagttctcatacatgaaatttgagaagctttctgaacacctaagtggaactgtccagtgtagctctggttacatgagtctggagttcatgggaggaaagatccaagctggagatttttaattactttgtgccttcattttcttgtctaaaaacagaaggtaataatggcacctatctcattggactgttgtgtgcctgaaaagagctaatcctcggtaggccagtaagagactttatagtgaattgatttagtggaaatgaatcaacatagaaatgaataataaatttaatttaagtaaatgtatttgattacatacttttatttttcaaaaaaccattcttaatcccatgtctttttccaattagtttatttcagtgtgcatgtaatgtcctttcttaaaatatacaaactccaaggatattacttatgaagctatataattttaggttaaattaaataataatcagaattttagctgcataagcagatgccgttttggccattttaaaaattaagctgctctgatgcagaataaaaatcaatgacaagataagttattttggaagaaaatacaataatttctcctcactggcagtctaagttcaatcaatcaaatgaaataattaatttgcatttataataacatatagtgaaggaagtcagtactatcgaatataaaggaaacaccaaactcattggattatccaacaaacagatatctcaatattggattagctcttcattttggaaaaatattccaaatgcaactttatcctccgaaacagagaccctgttcccttcagttattagcaattcataatttaacatgaggacatacgtaagaactggcaatgctgctccaacttaggaactcagaggagatgctccagagaccaacattatcagtccaatgcagattagtatcactttgctcataaaagagagtataaaggttcttgaagtttttgaaaggagcggcttagctgactgttaaggaagctatcttttgtctacaagaaatttatactttttccttctaaatttcacaaacagaatattattagagacaacagaatacatttacaaaaatggcatcagaaataattgaatacattgtgtacaatatcttctattaatgaaataaatgtatattttatatgatatttggtctttatgaaaaaataatataattaccaatattctaaggatgaacaaagaagtttacaatagcatgcaagaaaaatgagaagaaaatgatacaaattgatgttcagaagatttcaaaatcttcagcaaagtaatttcagaactaatacatacttaaaagagaaagaaagaactgtgatttcacagtcgaaggcatacaaaatataaaggtattatgatctgaagagttaataaaagagagatgaaaagggagttgatattggaaccttaaattttttcctatctgatatttactttaaagagcttttctgaaaaattatctcttctactctatctcaaatttctgtgaggcattgtcttctctagcaccataaaacacattcagtctttactctgaacattggttattacttattaaaattaatacatcggaagattgtaatatattagttgtaactcattagctaactcatgaaacgaacagccagaattggttgtcaagcagaatattaattgcatttaataaatgttagtttaatgttgttaaatgtgccacatacatgggtaaaggcagtcatatgttgcatatgacacggcatacagttctaaatttcccgagggtgacattccctttggagattggcaggagagcttttgttcttggggccttttgttagtacagcttcaggaatttctagtgatcttattttgtgtcatggtatttctactttggggaaggagggttggacaatggatggaatataaacaatgaactgccctttacaccttgaatgatagcctcaatatgtaactgaaaacactttccacatttaactgttgaataaaactagtcaattttgtttcaatgatgctatggccaaaagacagcagagagagcaataatatgagctttggaaataaataattgacttttattttccccaaattttttttgtatgggtaatacctgtataagggcaaagattttcttcaacttgaactaaaacctgtatttttcattaaattttagtccattctaaacattattcaaaatttttagatcttccaccaccaccagatcccccgccaggtcagggtttaaggcagcaaataggcccgagccagcaggctggtaacgtggaaaactcagcagagagaaaaggaagctctctagagagacaacatgcatccagcttagaagacacaaagagctcattggattgtccagctagaacctccctagagtggcagcgacaaacccaggaatggataagctccacagaacgacaagaagatatacggaaagccccacacaaacaaggtgtcggatcaggtgtgttctgcacagtcccaagaaagtgtggactgttaccatttcttttcctaccaggtattctagaaatggcagttgtttaagggcatctgaaaaacatttgccttcaatcgtaatggaatttggaattccttaggagattttaccagtacatgccttaaggctgattccaacgggcattgctcctcagtcagcctctccacagggtctttgatcccaagagacttccaggcttcatctaaacggctcagtagaaaattttattttttggcctattaatgtttatattgagtactttaaagatcgctaaatttaatcttttctgtcagtttaatctctgccttcagcaagtttgttcattttggctgaaataaccagtcattcgaaaggagaactcacatcaaatatgtgaattcattaaaattacaaagttgcagaaaaatgcccaatcacagatcctcaaattagataaggttatactgggcttgcactttctccaactgttaatcagttgattgatttagttggttgttaatctgtctatgggaaatgctcttttttataaatcaagcttcctggaaatgtcacagaaataaatttcattgtttgtagttagatttttttggggggagaggtgtggcgcgggaggtggggagcctgctttataaacgcattttctgagacatctcatgtcaggattcattgagtactgaaacacacacatacacatacacacaatctttgaaaaaatgtcttttcacttattcatttggacttaatgtgttgtagataggcctctccatgcatttcccataactacattttgtcacaacttggtgctcaagtttttggaaaatgtcatttgtgcaagggccagtagatgacaattttaatatctaggtttagtgaaacatttagaaaggttacaccattcaggctgtgagagaaaaatcatgtggttcttgtcattgaagactatgtaaggggagaaatagtaaattcagtgagcattaatcacaaaataatagcccatacatagaaagaacgtgaaagacagaggggatggggtgtggagagggagcaatgagaatagagagggaaagaaaaaacaatttttgaactattgagtgattatttgtaacatatgtcatgagttatttgtagagagacaatctgtaaaaaaaaaaaattagcatattatttatttaaatgtgtgagtttctcttttacttttaaggaaatacatagccctttaaataatgtatttctgtctcaaaaagcaacataaattttaaaagcttatttaactaatatatagttctttatctaaatcaattgagaaaatgttgccataatttaagctgaaacaaaaaacatgtttctttaatcttaatgggaaaattaaattggagcctcattgaactttagaaattattctcagatatgcttttgttaaactgtagttcattgtatgcagctctcttttataatgaatttaaattttgcaaataatatataacattgtgtacttatcccaagatctcttttaatttaattctgctttggttcctattgtaggaaatgttgcttgcacatagaaatttctttaatatccggtcctgattaaacttcataattttaattttattaaagaatgaaatggtaaagtaggccattcacagtgttatattcaagagttaagtttagtttgcctccatgtttctgttcaatttagcctttgggttttttttctttttcagaggaggccttggtgccctatagcaagcccagtttcccatctccaggtggccacagctcatcaggaacagcttcttctaagggatccactggacctaggaaaaccgaggtgttgagagcaggccaccagcgcaatgccagcgaccttcttgacataggatatatgggctccaacagtcaaggacagtttacaggtgaattatgtaagtgcttaggtcatttaaaaggctatcgtgattcagaaagaatcttgggttaataacattgccacattaaacaaatttcagattaatagaaaacttgctctgttacaaaaacaatcaattgcaattttcaacaagtttggtcataacttaggccattgctatatttattgaagtccatttttataaatgtttctgctatttcacgttggatttatgctataaaaattgttttaagttaggcaagtagtcttaacacttatacatgaaattaaatatagagtgtttatcattttctttgcctttttaactgaacacaataaagaaatggagacactggccttttggtagttttaaagaaactcctaaggaatgcttcattttcaagttactctatatttattttttaaatttgggtagtcacccttgaagagttgatctttgattgttaattaaattgtaatgttttgactacaataacattttataaataaatttccatttatgaatgaaaactggcataggtagttagtacaattaattttctaaatgtaaaatactaggtaatagggaaaattaagaatgtcacagcaaaaaatgttgaactccttgtgttaatttcctcaggaaagttaccaatacagctttgcattatcagaaacatatttgctgaatatttttaactgcctcatcagaaaaatagcattaccattatcttcacatcacagattgtttggaagattctgtgagatgatgaaaagagaaataatttcaaaattataaatttctttattgatctcagttgtcattgttgttgactattgctaatctattattaagattcatttataattttaatttgattcataactacttgaatttttctttaacttttttttgaagtaatgacagactcacaggagtaccaaaatagttctactgggtgtttacatttccaaattctatagtgttttctttccttttactctttgatcatctccttcaagtaaaattacttaaattcacaaactcatctatctgaagaccttattttcattgattatctgttggctttgctttttgttatgctggtcagaaaagcagaatgcttaatttatattttatttctacttttttctctttctttagagtaaatgagaggagacatacaaagctgctctgaaggaccatcaggtccggactcatggaagtgatgactctaaacagtgcaatgaacaatttatttatgtactattaaaagaactgtaaatgcaatgtaaagacacacagccacacatatcccacagatattttcattgtgttcttctcttaagtacaccacccaccttaactctttcttgtcaggagtatataaaaaagaaagaaaacaaaactcgccctacaggaagaaaaggattctcctctgtatataatttcttttgtgcattgctatgcaagctcactctttttagctctgctcatattattgtctgttcttattggtctgttgtactatatgtgaattaataggctgtggtgccatatattaacttttaattgtgtaacttttatgtttaaattttgcactgcaattttatttggtgataagcacaaatctctactcctcatgacatgaagaaaaagactgaatgtgaagggagtttctgtactgtaagctagattggataatgatggctgtaacaaatcatgttagatggttttcagttggggtgtagaaataggaagatgcaaaggaacaatggtgttggcaaagtcttctttgaatatcagggactgagtcaataaaaaaaatagtagaaaggtggcttttactattgacaaaagccggggtcaaaaaaagtagtttaagtcttaagactgaatatgcattaaagtatgcaggtagcaaagatgtaataaatttgcttaaaaaaagaaattaaagttttatttagaatcaattttacctgtcattgtaattgacccatctgagaattacaataagcaagaggaaattaaggtgttttgcaagagctgtatttatattacagttttttaaaaacattttctgaattatcgtaattaagctctccaactcgttaagtcagaatataatatgaagttccccaaggaaacgaacaaaatgaactctagaatatctagcaaatagttaaagaagcaatttattattagggcatactcgggctgtttccaaatataaactctattgcaatatcttatttcatctttctaatacatgtacagtgcacactagaggatagagctgcatcacttaaattcatgacttaaaaaataatacagtttatatacaacttgttttttatttgattaagaagtgaagtttacgccacccaatgtatagccaaattgtacgtgcttaaaaaacagtgccgagagtatgttcagttcgcagtaagtagatttattggaataaatattctatggtacattctcagaaattggcttccaactaaaatacgtttgacccattttgaataaggaaattgaaaagaaaaatttaaaaggagaaaaaaatgcatgtttataaactttttaaataaaaccagaccttgtaagtggacattaataattgtcctgcctcatttgttttcacgactttgacaacaagaagttcctgaacattagtcatgtatgctcagaataaatgtgactttgaaatatatgttagctactgtacatgtatagtcagtcaagtagaagaggaccttcctgaaattcccacttgtgacattttcccatgggtttcctacacaatcttaaattttatttctgtctatactttctcaaatttttcctatgataagttcagttgttggtactcttctaaaaatattcaacgtgattaggatcagttctaaaatacgggacccctttgagtgacaattcgcactccatgcattattggctcagtagccaatttttgtcacgtcgttataacaaggagatgacataattaaacatttccatcctttctattccctgagactgcatcagcacaggcaagtatagaatgtaatgttcttcatgggccccaccagctttttggtgccatgtaatttatttcttcgctgaagagaaaaagaattctgagacacagttattaaaccctttatcaactttctaccatcagtgcctgaattctaatgcagtgtgatttctctgggacaaagagactgaggaagatgaaaagtttcttcaaagagtgaatacatacttattcacaactctaggatgtgaggactttaaatatctctttatgaagttccctgcctaacctctttctatttaaaggcaaacaaatttcgaagaggttttgtgttccctctttatgtttctctatgacccagtttagtctaaaaccttagttcattacatatacaacacatagcctttgatccctggtaactggcaggtgttggtgattaataaaccaaggcttcaaagtgaagtatgtgtgtgcagatgacttttggaataacgtgggcatagcatcataccttcctgattgtcttcagcatataaaaattaactgttgtagttaaaattatgtcagtgcagagcttgtggttacttggaatgttctttcagaatagtccatgttgcctattaaacctagttttaaacacattgggcagtcaatttatgcacccaaaatatcaccctcaggtagattgagggcaagataaaatgctgtatgtagctatacaaaggaattcagaaacattactggaaagcaaagcctttgtcagcttgctactgacaaagtagtaaaaagctactaatcagtgttgagtcagatgtcaacagaaaaatacaaatacctatgagagccacagcagtttctcgtttcatagccgattcaatgaatatgattagaaattcactgagctcactcttgcaggtttaaatggaggcctgcataaggactgcaagaggaaatctgggtgggagagaatgtaatctgatcttgcactcataggcaatgctgcaatgcaatcatgtccaatacaagcacagcttcattcataacaggaaacgtcttctttgggaaaatagctctattggtgcccaaactcaggtatgccagtgtatgcaggtggagtcgccctacccctcttccaaacatgtcctgtgagatttttaaaataagatgggatagtacaggggcatgaaaagaattgattccttcacaggatttgaatccagttcaagggagaatgtagaaaattcaaaaccaacatataaggtatcacacaaccaagaaaagtaaaaccattgcaagtttacttgcgttgagtacaaaacagatttaatggtgttctatgtcatagtttaatgctctgggtatttaaatatgttttcaacaggatttgagttgaaagtttgtaatgtgctttgatggaacacctctcaatttctattcaataaacttatgtaattgtccattgacaatataatgataacagtaccattgaactctaaactgtggtttatcttcactactgggaagcaactgtgcatcagtattaaagatatgcagaaacataatattcactaatttgttcatctgcttctgtatattgtttatggaattacatggcaagaactgttctaaagcaacatgtctttccacattattttagaggtgaaattacttttgttttgcttctctataatgtgtacttcaaatgaaacaccatacttttttctaaaaaaagatgttcaatttactaatttttttaaatctcataatttaaaaagcatttgttgtgattttaaagtgttgcaagaaaagggattttgtggccgtgggtagactttttatactttgttttatagatggattttttttaactgtagtttgtttaagtcaccaagcagcatccaaaatcttaatgtgtttcatttgatgttgttagatcagagaagaaattggcataaaatcggttaatagtattgtcaaagaattgtgtattgtgtactcactgggaaaaaataaaatatattcacatttcaa

SEQ ID NO: 2590 - DNA, 609822 bp, Homo sapiens
tctcctctcttttggaaaccggagaggtggagggagggcaacaccgctgcaaaggagaggcccgccaagtctgcccgcctgcaaagtgttgctttgacacattcttattatggaagttaagtaaaaatatagacatattaaaaaataactccggacgtggagctgctacggagaaggaaaccgggggaaagaaaaccagtaggcaggccaatggtttttcggcagcgcgctggcaagtttgtggaacactttctaggaattaggtcttttcctcccccttcatcatcttgacttctgaaggaagaacttggctttggattgcagtggagcctaaggagagagggttagacacactcgaataatccctctggctgggctgaatttgtgggaatttaggaagccagagtgctggaaatacagcagcctttgaagtaccctctgttaatttggatggatctcagtgtgccccgttcgagacctctccaccaaccccttctgatcttgcgatttgctcttcttgactttaattagtatctaggaaagtctaaactttggacctacctctttttttgatactcatttttgtacttttgctctctgggattggtttcttaaagaatctggatcctttttaatatgtcaaaatgagtctgctgatgtttacacaactactgctctgtggatttttatatgttcgggttgatggtaagttaaaaatgctttcatctttttttgcgccccccaccccccaatcccccaaaaccatttctttttgaatttgatgtgggttataaatgaaatgacattatgtctgttagtccgttttggcccggcacgggctccttgggggcagaggttttatttaagtcttttgtttctaaactgctgtaagtggaatgtgttggtagtcacctattgttgttattgttgtaatttacttcactaattaaggagttggataataaatgattgggctcccagttttgttagaaaaagaaatattacagtcaatctcctgcaagagcctaatactattgtgcctgctctctatttgatgtttgctcttgtgtctgaactttggctgagacattcaagtgaagaaatacagtaatagacactctaaggaaggttcagtgggttaggaatttgagactgagatcaatgtgtatcacctgtgtgccagtgaatgctctcctagcgttaaatcgaatgaagaatttagatcctagggagaaaactgtcaaaagtgagactgggcgaggctccacgaagggggaagcatcagctatgggctggccacaggagtagaacacttagctcagtccccagtgggcaaacacaatggggaccttaaacaggtgctggaggtgtctccctctaggttgagtcagtctgtcaagcccacagcattctgcctctgattctcttgtcttttgttccgatttggtttactgggatattttcacaggatgtcaatttcttgtgcgactattgcaaaatccttttttgtggttcttttgaatgaagagtggaaataatcattaacatgctttttggtttgtattcaaaagaaaaaagttaaaagaatatttgctgttaaccttctagaggctttaatttttatatcgatggaaacaactggtataagggagtactagatattttttttttctaactggattgcagtactttaggtttttagttactttctgtacttgtaaagaacctaaagggtattagtctaactgtttgagccatcacaatagcttgttgccacataaactttcctccagcatttgcattgtggatgaattcattatttgggacactgcctattttggcccatctgagtagctaactttgttcctggcagctactgctgcatagagcccaatgtattggactcaaaaaggaaggctttctataaacatgaggcaatacagaggagtttacctactgtcaagtggctgttttcaatcatggactacatgagtacctttgccccccagcgatagtgagggagggatgcgtgtgtgtgcactgcttctctcttttaccagtctaagcagtagatgtttaagatttaattattgtgaattatactatggcaacatctctaattatttttcatgcatttatttttcagtacattaaaatacgtgtacattaccgtaacaaaataggtttacctatttgtcccaggtgtgtttgattttcatgataagaagaatttggtataacttttaaaagaatatgtcctcataaatcatgaatttacatatctcaacagaaatgcatgtgtaaactatacattagactacaaaattatcaccaagggtttttttatataagcgtttttaaatcagtgtgttgctaggaggaatacaattaaattgctcagtggaagtgacaggaaatcagaagagcttggtgttacagaatgtaattaatataccagggtgtttggagatatatgaaacaaatgcaattaaccagcttgctggagcagcagtagtaagacaccatttctgtctgccttccctccctccctcctttcattcctccctcccttctttctctccgttttattcctctctcccttctttccttccttctctcccacaccacccttctcctgcccccaaagacaacctagaacctttgttctgatttaacattgtaggataagggggcagtttgtgtctgggccacaattatgcagcagaactcatagtaatgtagtgaaaaatgccaaaattgaggagttgacactgaaaaggcaatattaaatttttgtgtgtgtgaaactagttttgtatttagcatctgctgtgtcaaaagcaaaggaaaccctggacactcttactaaattaatatgtaaatcatacgtttgacattggattgcctttggatacttcagaatgacagtttctccacggggatggttgaaaatttgggatgtggagaacactgccctctaggctgtttcagcactttgagactcagtgttcacatatatagtgaagaggttggtttgtaggttctctaagctttgttactcttccaggattctatgatttctatttacttattcttcttagaggtgtgtgcttatactccacatgaatttcaaatgtacagaagcctgtaccatttcaaagatatactgaccatccttgtgctagacacagatattaattttattcagtgacaaatgatacatatatttgcattgatatttgcttggtgggttatttatatgtgcatttttatagtatatgaaaaatggtagcgttttgccacctcatagaagctatctgctaatattatttataatttttcagtattgtgtccctgtagcaatccatagagagcaaatattaagttagttgagaaatgtagataaacttttctatttgggatgtaaataatggttttcttattgatgcagattaatcacatctagacttttctgtatgatcatataggagaatgtatgttaaggttagcctttgttttccagcttttctttatttttgaataagaatagggttttgcagtcatttatgggaaattaatatgaactatggcaacacttttaaattacatctatatgccatatattacatcaatctgataattttataatacttgtgaaaaggtgttttaaaatgagaatgtttttctcatctttaccctttaactattcttaaatgaaagtggcacacatgatattaggggagataaatatagtaaagataatgtatgtgcatagtgcagatgtagaatctcatagaggtttatacatgttgctaaagtgctctttttcagtaatgggcttattatcatagccatatgtagtctatttcagaatttaaattatatataagtaacctgaaatgtgtttttgaagctatgcagtaataccatgtttgaattggctttgtttgaataacctttgatgctacgcaacatgtggaccataaaaaaaaaggatttcttagaacattaagcaaaaatattgtaaaaaaaaaaagtaatgattatataaaaagagcagttctggccatctcatccctgagcagcttgtataaaatagcatgtttgacgataaaaatatagatatgtaagcacattgtataagttgggatacatacatagcaatgaagggagctgatgtatgtgggatgtgtgtgtgcctagtaatatctgctgaaatagttccggcagtctacaggaggtacatttacttcccatgtgcaatttggttttcgaagagtattagaaaaaaagattatcatcttatttactatttctcctttttctcctttttttcctccttctcctctccttctctttcttcttctcattcatcgtctctttccttttcttattctcctcctctttttttcttttttggatctaatgaaaggaattagagaaacacttgaagagtgaagaagataggtgagggtgtttcttgaatgataatttagaaaatctgcatttaaaggaaaaatgtgaataatattttacctttaggtatatccaactgggattttgactttctcacttttaccccacaatactatatatagctttatgcaaaatgttttgcacggatcctatcattttccagtttacacaagtaaaagtcgtcatatctgagttcaagcaaacagtggagatttatagagtgccattttacagatttatttctaaagaaaagtattgctgtatttcttaaaggttctccaggtatagatctatcaacctaaatcaatacattggcatagatattgcttttctccttcttctcttctttttttttccatgtgtgcctttattagctgagccactacttgagggtttaaggtctttgtgaggggcttggaacacccaatgttgggggagggaggcgggcggtagggaaagtatctgaaaggacttcctgagccagctgtaggcttttcttcttcttgtaaaagaattactatataaagaatgaaggaatgattataaactctttttaaaaataaatacctatcaactctactgttttagtagtgtgttatacaatgatagaagcatatagcatctagggtagcatgcttacccagaatacttgactcaacacagtgttggagtaacggaggcctcaatccttagtgttttctcctccatttgcagccaatccttaggctctttcatctaatcacatgaggtttaaatacatgtttggattgataattctaaaattgccctaatcattgcatggagggatataagatccatcagcacagaacttggctgttgtatatactgttgatctccagtgcttgcatcagtgcttgacatactcacctgactacttgacgtctttgcttcatgtccaatgagaatgtacaaaactcaagcctaagacagaatcttctctttctagccattcccatcacagtaaatggcttccaccattcataggctttttcatgacccccaatgaggaaccatttttcacttgttctcacaacttgtattcaacttgttctcagaattgtgcaaccatcactacaatctaactttaaaatgttcttaattacccaagaaagaaactatgtagcttgttccaccatccctccaccaaccacaagaaatcaccactctacttctgcctctgtggatttgtcttttctggacattttatatataaatgcaatcatacaatatatgatgtcattttgtgactagcttcttttctttagcgtaatgtttttaagggtcatccgtgtcatagcatatgcatcagtacatcattcttttttattgccaaacaatattccttatcatctatcctttggtttactagttgatgaacatttaagttatttccatttttggctattatagatattgctgctttgaacatccacgtactaacttttgtgtgaacatatgtcttcatttaacctgggatggaaatgctgggttgtatgtttagtctgtgtttcacattttgaggaactgcaagactattttccaaagcagctgtgctactttacattgccattagcaatatatgaagtagatattttcttttaattgatcatggaaagaaagagtcgaagggccttatgagttgggtatgatgttttgaagtgaaacaattttatattatactaatctgtctcaaatccccaatagtcctgatttctaatcccttcagtggttgttgtcttctaagtcttcctcagttgcctcgtaaaactttacaaagatagtacctcagttgaacttgtcacttttagcagagatctcagcaatagtaaatataaatcatagaatgatagcatctcggagccattatgaatatttgcagctatattgcacaactctcttattggttgggcacatggagaactgaagcttagagattttatgtgccttgtcacagatcccattgctacttagtggtagagcagaaactagactccagggatgcttcatctctgtaccaggcttctgcctatgagagactgtttctggattcttagccctggaactccttaacaagaattccaggctcttgttactgaaaatgaccagctattttctgaagagtccatgagaaaatgagcttgaatatgtttaggttattcctttgattcaacacatgcatattgacaacataacttgcttggctctgtgaagaacatgctgacctgtgaaaatattcccacattcaaggaagtcatgacttggtagggaaggtaccaaatgttcaagtcactagaataaaaaaagtagtgtctgataagtaagaagtttgaaggtgtacacagtatagtcttgagaactcagagaaggaataggtgatttccagctggtacaatctgggaagggtcaacaccaaatgggtctcttaacctggaccttagaggaagagtgggattttggtgggcaaaaagattggaaattgaattccaggaaaagaagtaaccagaaaaatggcatgaagatgacaaaggggtgctaaggaaatggcaagaagtctagattgattgcaacatagtttgcctgtaaggaagaaggataagatggttattgaaagactactgagcaatcactactgaatgagtatgaacaagtaatttaacctttttatgcctcagtgtccttacctgtaaaatgggcatggtaataatgtatatctcatacagttataatgagaaataaaatagttttaaaaatataacgatatataggcagggcatggtggctcacgcctgtaatcccagcactttgggagggtgaggtgtgtggatcacctgaggtcaggagttcaagaccagcctggccaacatggtgaaaccccctctctatttaaaaaaaatacaaaaattggctgagcatggtggcaggtgcctgtaatcccagctactcaggaggctgaggcaggagaatcatttgaacccaggaggtggaggttgcagtgccaaaattgtgccattatactccagcctaggcaacgggcaaaactccgtctcaaaaaaatatatataatgatatatataaataaataaatatatatataaaataaagatgtatataaagatatatatgggctgggcgcggtggctcacgcctgtaatcccagcactttgggaggctgaggcaggtggatcacgaggtcaggaggtcgagactatcctggctaatacggcgaaaccctgtctctactaaaaatacaaaaaaataattagccgggtgtggtggcgggcgcctgtagtcccagctacttgggaggctgaggcaggagaatggcttgaacctgggaggtggaactggcagtgagccgagatcgcgccactgcactccagcctcggcgacagagtgagactccgtctcaaaaaaaaagatatatatgatgccatgaacagtgtactttataaatgccactcaagcataacttattgttataattagtagtatttttattagattattattccctgcctagtatgaacaaggaaaataactagaagaggactttgctatcagactaattatggactacaattggggtgcatgttaggacaattttaataagatttttcagctgtgagtcttcaggtgactgattaagaatttttgttgcctcttaagggaacttatcggtggcctcgcctacacagctgtgacagttgtgctatgacatgtgtgtttccattgcatcataagctgattacaaaacacatgtgattcccaagtgaaaggtgcgacgaatgaagatagtaaacaagagaggaatcacacaaatggcaatttgttagcaagtagaccatgcttgtgtaagcctgcattttggttcatgttggctgatttacatttcatcctggataatttttacctggtgctttgatataacgtactgtggagataaatcttgtgtaagacaaactaaataaacactttgagaaccgaagacctaagtaaaaattaacatttggtatccactcactaattcgttttctagatagcccccttagcttcccttcatttagtataagacattgaatctaataactttttataattatccattagttacatttgcacaatgagtagttatgcatatcagaaaggatagcctgaataaaacaatatcattactattgtggaagtgacatacctttggtgaccagatctctggactgcactgttagcttccctagtggattgttaattgttctaattgccttagaaccttaccaaaaatggtttcatttgactgtgtaatttccaaggtctccatgaaccttaggttttattatcccaagtacttctgtttaatgttccaacatttattgttatatctgagaatttttaaagaagaaaatttagcctgggctcggcgcagtggctcacccctgcaatcctaacaatttgggaggctgaagctgaaggatcgcttgagcctaggtgtttgagaccagcctgggcaacatagtgaaaccctgtctctacaaaaaagaaaaaaagttagctgggcatggtggtgtccacttgtggtctcagatacttgggaggctgagatgagaggattccttgagcccaggaggttgaggctgcagcgagccatgattacaccactgcacttttgcctgggtgacagaggccccgtctccacacacacactcacacaaatttaggcttgaaaagaattatccaaaaccataaacatccatctttaaaaacaataacagtctattgtctaatatgcatgtagcatatctgtgttttggtgtgggttcaatgatatggctatggatatgcatgacagccaaaattaactagtcttatgattcacatccactctcattcattaatgaccagtggtacttaggctttccttatcaataaatggaattttaaaaatttaatactaaggagacaatagtcttaggtcaatgtgcttagtttctggccactataactagaaccatatgcaacatggaaattttagctcaggagagggggttaacagccactttttaatttctgttgtaaggattgatgtgggatctctttccctagactttggttccaagctttttggaaatgagctggagaacatggaatataactcaactatcccactgaaaggcttttcaagtttaagcaaggaacacccagttgaaaccagactggaatttaagggatttggaccaaacctctgcagcacttataaccaattaaaatgttcataagtgtgattcaaaaagggagaattttgactttccaaaaaacttgagttaagagttattcattataaaggaaagtttataagtttttataaatcaaggttagagtcgtacttagaagttttataatacgtatatttccaaatactagcaaatgctagaatatgattaaacttatttagatatatccgattattataaaatatagatttcagggttagagtaaattaggggaaatttagaatgaatctagcaacaggcactcttgtattttatatctctattataaagtaaattttaatacgttgccagataacagtacagttattgaaaaccaagcttattattgttccattaaatcagagacagcatttcaccttcctcatcttaagcatttcaccttcctcatcttaagtatataaccgtttgtgtattctaagtacctttgaatgccagcaacaacaagctattactcaaacgccaattgttttagtgcttcttaccccatctctatcatgggttagcgtagaaactgagtaggagaaatgtaaccttttaaaaagaaaatgccatttctgtttctttactactctaataaacttactttcatttaaaaaaagaaaagaaaatgctaggtacaacattctcagtctttgcttttgtgtgttttttttttttgttgttttttggttttttttccccatgcaaaattgactaagaagagttacaacatttaatgtggtggtctcaaaacatttttttttttttgcattgtaattgttttcgcataatttcaagagttaaacaataataatgaaaagatgtttcaggccacacagcgtggctcatgcctgtaatctcagtactttgggagactgggaggatctcttgagcccatgagtttgagatcagcctgggcaacatggtgaaaccctatctttgcaaaaaaaaagaaaaaaaaaaaaattagctgggcatggtggtgctcacctgtagtcccagctacttgggaggctgaggtagaaggattgcttgtgtctgcgaggtcaaggctgcagtgagctgtgagtacaccactgcattccagccagggtgacagagggagaccctgtctcaaaaaaaaaaaaaaaaattcatcaaatgggcatatgagccctgaactcacaaatcaagttgtcattcagttgaggtttaaggcctccttttctgcccaaaaccagatttaactgggttattcctcactggctatcatgaaacatgtaaatacatttcatagctaagtatgtttttaagtgtttcagtcccacctttctgatttgaaagcctgaataatgtcaacttttaatactaaagtgaaagaaaaaagaatcagaaaatatgtacaacatgtgggtacagattttgggcaaatatagctcttacccccttgcctcccacctccctgtacacatggcaataagactattatgaataaactgaggtgtttgatgcctgccctctactcacaatccaacagacaacttgtattttaagaaccctttccaggctgggaattcttattacactttcctgttaaactgtagcacctgtgatgttcatcacttggatcttatgaaactctccagatttttgaggctctcagtaaatgtgtctcatcatggtaaatttaaattccaagtgtattcaacatttcttttcagaaagcagtttttaagttttgaagcagcggctacacatgacatgcaaataaaatgaccaggcaattgcttgtattgtctgtctgtatcaggattcaattctaagctttccaaacatggatctctataggaggttatgcctaatctttgcatttgaaatggtcaaggaggtgcaaggatatacctgggaggggcaatctccctgaactataaggggaggggacgaaagagtgtgttggaaaagtgaaaaactgaacatttgaatgaagtcggttggattagcatttgacactcaactatacagcaagcggacacgctgatatttagttctatggattgttaacattcacataaaacagaattatttagcatttactgaaccctttttgataatcaatttgggatcaaatgcaaaagaacatgtgtctgctttgtatgaccccagattcttccgttttctctttgagcagatgacatgccttctttactgactgatgttggttgctaggagaagtgcactggtttagtcccttcttatccagcagtaaaactaaagagtgtatttagtaagagaaagaggcagaacacagtacaggccatgaatcatgacttgtctccaatatgtccactttgctcccattttctttccctttaaaaacttttgtttttaccaatgatgctttctttcagccattatctataatccttttggagcctgaggggatgagggttgctaaagagaggctgtgctgctgagagtccactcagagcaataataaaagccttgagagttattcatggggccacattagtgagaatgccctactcagtgaatagcatcagtcagctgcctttgagatcgagtgattaataccttctgttttgaaggggggaaaaggcagacaagaaaggtcttcatactactttggctattttgcaaattagatcttacatattgtcaaaccttttgacaaagaaattgctaaaatgtcaatacctgcaatagtcttttttaaaagctagtttttcatgaaactgttaattgtggctactgtcaaatacaattgaaacggtaataatatcccaaatgaacactgaaaaaaatcagttagccattcttagattttggcagtgtttatgatgacatcaaactaagaacgtgatgttagtgatcatattcagaatgttatctaggcagatctatttgacaacagccaaatagcatttttgtttgtttgataaaagaactaattgcaatactcttgagagtttacagaagcagctaatgagaaagtgttaagggtggcaggtgttagtttcccataagcactgggatataagggacagtctgtgaattacaaagaagttgttatttatatatgtatgcctgtatgtttgtatctataggctggttcagcatatgggattaaaaagtggtattattataatcctcatgacctctccttttatcttttgattatattatgtacatggcactgttcaaataaaattgctcaaggtttattaaacttgtcaaccatctgagttgcatagttagaaaagcttctggttttggtggcctgagtgtggcagctagaaaatccaagggaatgctttgccatactgtttttcagcatgattccaacattaagcaggctgttaatatttagacagtaaattaagccatgtctttgtttttaaaaagtcattctcattctattcttcattttacattttaaacttattttttatatagcagcttagtctggcccttctgtatatactcatgctcattccaaaggctttactttcatctgaatatgagaacaaacaacatgttaaagactctgtgtgatgcttcctgtcatctgttttcactctgtggaagtgaaatatcttgttaagagggggtaatacccaaaggcaatcagagataaaaatgtaacgatttggtgggtgatgtctcaagatcagctttaagtgaggtctgatttaacatctttattagtcatttaaaagggaaatgataaagaaattgtaaatctcaacattggaataccatcagaacctcccctccctgtccctgaaatcacatataatgatatacaaaaatttaggcagcagaaaatattagtggagtaaaaactaatgctttatttggtatataaatgtaaactaattcttcagggaaataatcagaaatctagaaatctaactagagggagaagccagcaaagcaataacactgaaagggccctggggataagtacaggagttggcgcaaggagagaatgtgatttagattaggagtgttatatcccagtttaaaggtcatgcgattatagtgcccatttagggagtattgcatcactgactagggagattctctttcaatgaatgtggcttaagtgcagttgaaatacttctttcattttgtacttcattgccagaacatgagagagattttggcagaatagaaacaaggttagtacaaagagagattctttaggaagatgcttgtctacttaacactagagaaggattttccattggaaagttcaagtagttcctttttagagtgaatatagcatcttcaaaaccaagaccaaattcataaagccttccaagagaaatttctaccatctgtcagtatacagcaaagcccatgtttgtgttttagttcattttatatgtactgtattacacatattagggcttaattaaggttgggtgaattaaattgatctattaaatttaatagacaacttgtatgcagaaacctatacaacgtatgccatctgaccccagataaattcaagagtaatattttctgtggaagtcaagggtcttccttccagtagaagaaagtattggatggagtagggaagcatagacaatgactcttcagatgaagtgtgtcgcatttaccacattcctggttaataaggatgctaggtctgatgataaagactagagaaggttgtacaagtgagattctctgcttgctgcacaattatatgttgttccttttccctagtcctcagatagaaatcgccattttttttctcctgatgtaagagagtgatagaaatagaatggagccagcatctcagtaaaacagaagtaaaaacaagttaagatgggcagtgagaggtaatggaggccaattcctagggcttctgattggttttattttgtcaattttacattcccatcaatgctgtggggctacttcatagccaacatttgaaagcagatgggcatcctgccgtaatgtcactgcagccagtgacagagaggcgcctgcagtccacaaaatctcgcgtgtatgtgtgtgtgtgtgtgtgtgtgtgtgtaaaacttggttaatgtgtcattcatcagtaatgagattagagccctcataataaagtccctacatgttaattgtggaattatggtgcaacaataagtagagaaacactcattctttaaaaaaaaaaactaccagatacaaaatctattcatttggaactcacccttctgtgatttttattcactacttttacagttaattttttaaagattttcttttattcagcttccactgcgtcttcccactaacatcaaacccttctgcatccagtattcatcattttgtaacaaagagcatataaatattataagggatggtcttgatattaggggtgtctatataaaatccattctactggtctagtgattgggccagtaaattgcatactgtattgataaaagggctttcattctcataatagtctgtgaactcactggggactccttttctggggagtcatgtataaatgatgagaactatacaaaatctcttgaggagtttatcatagaaatagaggtgctggaaaagaaaatatggtagactcatactcctttttgccttgattttctaacacgtcatcctgtcacaggatttctgcataccttgattccatgtgagggttataaagagttagagaaaaatatacatttggaagactcatttacgcataatatatccacatataaacttccatgaattggattggattataacttgtgtgaaataaatgtaacaaaaccacatttttgaccctgaggaactaatcaaagccagaggctaactttattacacccattcctgattggtttatttctgtaaatttatataactacgagatgatttcttactttttcgcttctaattttaagttttaaaagtaaaattaaccaaaagaatgtttataaggtgaactttggccaaatgatgattgtcataaaacgtaactttttaagtagttgtgaaatgcaataaattgaaaagataaatagagaagttgaactgtccttacaaatgactgcacaataccagcaatgtcttttgagagaggatttaggacatagtgtgtaggtatttatctcacacaaagagaaaaatttccttccgtgggaaaacattagatcataggaaggcctgaaatatctgagttgcagctttgtgaaaccacactcagtctaaacaagttacaacaagataaagtcctcagaatacgaggaagggatgatgactacaaagatccaccactgtgtttcccagcttttttctctaatgtagctaagactttctttgatgaagtcatcctttcttgatccatttgtgtaaaaacttgtcccccaaccaccgtttgttaagggaggcagtatttagcaaacttggtagagtttataaagacctaattttgttggatgagattcactaggattagacaacaaattaaagacaaaatgacatatattagtaactgaaagatcttgcttattattaatatcttaattcatgcagtgttttttttacttataagaagacaccgtactgtataacattccatttgagattgttatgttggcaacctcttatttctttgaaattgtgtgggcaattcaaaaaaattaaagacaggataatatagagaactgagcatttaggaaaaaaattgtatatttgatgtaaatttcatagttttaaatccacagataactcaaaactcagacacaagacatacaatattttggcaatttgtgttaaggctgtaactttttttcaaatgtattattgcttaatatttctaacatgaaacctaaggtgcttgaattgaggccatgtcgtaatccagggaagatgttttataaatcaaggaattgacatgtaatatacacatatacacagatgaatatatacatgtcacacatatacaaacatatgtctatgcacacgtacatacatataattttgtaaaaaaaaagaccaagttcataggaatgccatttgacccagagatcccattactggttatatacccaaaggattatcaatcatgctgctataaagacacatgcacacgtatgtttattgcggcattattcacaatagcaaagacttggaaccaacccaaatgtccatcagggatagactggattaagaaaatgtggcaatatacaccatggaatactatgcagccataaaaaaggatgagttcatgtcctttgtagggaaatggatgaagctggaaaccattattctgagcaagctattgcaaggacagaaaaccaaacaccgcatgttctcactcataggtgggaactgaacaatgagaacacttggacacagggtggggaacatcacacactggggcctgtcatggggtgaggggagcggggagagatagcattaggagatatacctaatgtaaatgacgagttaatgggtgcagcacaccaacatggcacatgtacacatatgtaacaaacctgcatgttgtgcacatgtaccctagaacgtaaggtatatatattaaaaaaagaccaagttcaaaggctttggcacatctgtcttttagtcattgcatttttgtgagttaattactaatgtggaagctataccttttagattccagaggattttttttttttttttttttgagatgtagtctcgctctgttgccaggctggagtgcagtggcatgatctcggctcactgcaacctctgcctccttggttcaagtgattctcatgcttcagcctcccgagtagctgggattacaggcacgtgccaccacactcagctaatttttgtatttttagtagagacggggttttaccatgttgaccaggatggtctcgatctcctgacctcgtgatccacccacttcgacctcccaaagtgttgggattacaggcgtgagccaccgcgtcctggcaatatattttaaaaaatatgtggctgacgggttgataggtgcatcaaaccaccatgacacatgtatacctatgtaacaaagctgcacgttctgcacatgtatccagaacttaaagtaaaattaaaaaaaaagaaaaacatgtggctggattttgattgaacgttaatgttatttggggtgtatgtgttgtttttttcattaaaaaggagaatactcggatgttttcctaattgttattaagaaaattcttagattattgggacaacaaagttcttcaaagtctttcactaagcttccaagtatcacctgaataaaataggtgaatagaaaactgagcttagatattttttgcttgatagccatctagttttattcagttgccttgagacaaaaaatggaaattgaaaagtataatacactaatgtttagttacctggaaagttccagctaaatataagtaatattcacaatagcctgctattgtaattttaaataaaatattattgtgtgccatctggaataacttgtacacctcttctgtaactttccagctcttgtgagggttaataaagatctcaagtgatattttcagaatgcttcaaaaagtaattgaaaaaatgaacctatgaaatatatcactaacatatagttgcttttatttttatttatttatttgtttttgagatagggtctcacgcctctcacctaggctggagtatagtggtgcaatcttggctcactgcggccttgacttcctgggctcaggtggtcctctcacttcagcttgagtagctgggattataggcctgcaccaccacacttgggtaatttttttttttttgtattttttgtagagatggggtttcatcatgttgcccaggctggtctccaactcctgggctcaagcgatccacccacgtcgacctcccaaagtactgggattacagaggcaagccgccacacctggccttagttgctttttaattgcatgttgttttactatttccaagtttttgaccgttattgttaattagttagcacacaatcacatgtatatattaattcattagaatgtatttactgagcatctgcaatgtgctgaatacttgtaacagtgtggtgagtttttactttggtgagaaagacaaataatcgtgctgaatatgtttatacctgtgattgaatttttaagtattatgaaagaaaaatatagggtgtcataagcagattataaaatctatgaaatttagatttttgtgcctggagaactccctggggaagtaacaattatgttgaggactggagatagctatgtgaagagtgagatctgagaaaagaattctaggtagaaggaaggtcccgaagtggacagggattggagtccctttgaaagcctggaagaaagtcaagtggctggtaaagctgcaagcagtgaaaggtggaagaaggctgggctggatgacacagattatgtaggtaatgataaaagaaaaaggtaagtacatttaaatttcaagcagtgtatttgaacatttaaggattcatgatttggagtagcactagcctataaggcgtaaaatttcattgagaagggcaagaggggaatcttttataaagtgttcacataagcaagacaaagaaaacaattttggttacagtggaaagaccctatttaaaggttagttggtggtttctgattgttagtttctagtttcaatttactattgatgttgggctttgatttattgatgtgggaatttaaattgccagagacaccccagtttaatagtttcccaattacaattttttttaattgtctccttttgatcagcctctcatttatgagagattgaccaaagtttgggcataagcatcactctctgtcactgtcttggctgggttgtctttatctcagtgtaaaactcatacgtcatgacatcaggctcattgaagaaaggttcttatttttgctcatctcatttttgttgctttaatcacagtgagaccatctggcatacccttgatggctgcacacatacatttgagacccttcagagtatatactacaccaggggggttacagtggtgactatcaggagaatactaccaagagactgaagtatgctcctcagccaaggtcatcacaaatcaaaccaactagtatttctatggaaataaaagaaaaataaagaccaatgactagagcaaactataaattcagtctctgagtccagagggtaattagtcaagacttctagatttgagttcaaataatgttttcctggtttgcagtttgagtgtctttggttatagcattgggtgtgttggtgaactcctggagtcatgcacagatcaggaatgagggttgtcctctgaaattatgccaggctacccattccagctcatggcatttcaggaacagaggagttcttgttcttagtaatcccaagttggaaaaatgggagaaaattgaattggagaaacctagaagaattccgcatctagtccattctacaggtggaaaataaaactcgagaacaatgaacagagctacctttatttcattgatatttacctaattcacttgttcttaacacttgtatttggattgctcatgaaaaatttcataagacactaaacacagctagccattgaaggagttcaataaatgtcacctcaagctattccactttggtatattgatcactttgagctaaagggacttgaaaaatagcaaatgcagagagaggctttccctagaccacctcctatttgccaaatccagatccaccacagcagctcaagtgtcatcagtcactaccctaccccatcatcttatttcatttgtgtttacaggtcaggcaaatatcaaagttatcacagaagcaaagaaactgaaaagctaaacattattcttccctctctgtctttttctaaattctgtaactaacaggcaccaagcaatttatgtttactacatattttactctttggttggagttattgacttaaacatctagcagagataatacaaacccatctgaccagcaacccaggaaaacctaacattttttttttttttaaagagacagggtcttgccccgtcaccaaggctggaagacagtggtgcaatcatagctcaatgctgcctcgaactcctgggttcaagggattcttctgcctcagactcctgagtagctgggacgacaggtgcaggacatttccagctcattcttttttaattttataaatttgtttagtaatatcatcccaaaatatcacatacacataacatacatatgttcatacaaagacatgcatgtacatacagacggaagcagataagttgttgatttaaaagtcatttattaggagaagtctgaaggtcagtctaaattgttggttgccctggagttgctataattgcaaggccattaatttggaagccctttgtttcttaccttgttctaagattctttacacatgttcagctaacctagctaaacctatggcttatttccttaccttttttaaaatttttaactttttttcctatgtctccaaataatacctggggagaatctttttacaaaaagggcagcaagggtaggctgggtttcctggaatgccataagaaaaacaaaagctctgagtggtttttgaaatcagtaacggattcatcttccttctgtctgtaggtctggttgattgtccagtcagtgtgagtggggaaacaattcaggaatggctttcagaagattgtttttagtttttttgagctttttctggcacatatgtgaaccaaatggggacttatcaccatggatcgtgtcctcacaatgataccattctgcctcttgcatccatttttgagcttcccttggtcctgtcaacatgtctttaacaggattactgagttccgggtggaaccaattaacatatagggacaaagcattttctatgcaggacaggaataccgtttattattcatctgagctcaagactttgagcaaggaataacagtggttataaagcagacctggttgatctgacatccttttgtcaacactgatctggttctttcttttttttccctttgaggtgagcaggtaaaccagtgaaaacattagtagattcaaagtaggcaaaggataatagagagaaaccgagagtttagaggtctctacatgtcagtcaaaactgcatcctatggttttgaggtgtttgggatcccttttgatgtatgtgccctatagatgagcagttttacttaggttaaaactttcccattgtggccaccaaaattctacattatatttgttaagattcacccatttctctagaaaagcacaggttccaagatggagtcttagactctctggatttaaataaactcattatttctgtcttctgggaacctttcctaccagaggtgtttaaacccaattcagtttctgtctaacccagtcaggcacctaaaggctcctgacagaatgcagtgcagtttctattaagacttccaaacctagttcagatttttaaaaaatactcaaataaactcagagaacaggacccaagttgtggaactcgtgtatccaagaggacttagtggtgatgacctccaaatgtataggaagaaggagtgagcagaaggggcacagctgggtacttattcctgtttacttaatttctcccagaggtcatgattgtgtggtagcctttaggtcacacttctgacaccagagcttatgaaaaaacaacttaagcatatttaacttttaaaaagtttatctgggcatccagtggcccataaattggagttccaccacactgcaaggtacttagcactccaccaggagggtcaagagggggaacttctataaagtgtttacagaagcaagacacacaaaaaaaatgccagttttgattgatttgagtggaaaattcctagtgagaggttagttggtggtttctgattggtgcagttttaagtgtcagtttgctatttacattgtgaattagtttgtatatgtatgagtttaaagtgccagagctaatctagtctaatggcctcccagttacattttttttaataataaagattctgaattttatcccaaggataataaaaatacattagaggaatattatactgctgtgggaatttacaggcagctaaggcctactggtgtctctgaatactgtagagcatcatcaatttttagctcagaagtaaactggtggactattaaagcatatagggtgggaactgaaaacatcatgagggtgggagcaggatctagaagtggacagcttgggttgagttcagagtaaggtttcgccaagggctatgcccatctgccacccctaaccagttacatgaaatggctgggagaggagtgtacgtgtctgttttctaaaagctctctcatgcaattcttgatgtgcttagatttgataatgtgaagatggtaaggaataaaataggaggaggttgcagaggaactggaaatcagtaagacaggagcaaagtgtgtgaaaagggggtgtgtttagggagataattaggagtttcaccagaaaaataaaaccatttcaagtgtgtgctgcaagacagggaagctgatggaagtttgacagatctcctgacctcttcaattcccataatcatgtaactctttcttcctttctcctggattataacttacttgaattgtagtaatttacatatgtgctttatgactcacacttacgttaggctacttcgtgtgaagagctctttgctcttaacttgatattgtttgtagtctgtagcaaagcaacgtatacataaggaagtgtttaataaatattcgttgaattcaatcgagatggcccatttaattcagctcttctttctctctgcctattctagactcagccaaaactactggtttccattggttttgctgacttcatcaatagagggtgcaaattaaaaattactctacttatcatctcctgaacatatacaatttatgtgttcaaagtttgattgggcaattgcctatctatccttgtaagtttaaaagctatttctcatttaagaacattcataataaacactttgcattgtacttgttagtgcacatacctagatgaagggtaaatctattttcttcatgttatctttaaagcctgcagaaaaattatatgcttatgttggtattgttaagctataatgtcataaaaggtaaatgcttgtgttcattgttttcacttattatgctttttgttataaacgtttgattttatttttaaaattaccttaaaaatgtattaaattgtattgtttattcctttcaaagaaagaaaagtaaggtgtaaacattagtttataaaagtttgtaagacaaaattcaagcaaaggaaaaaatgagtagtgaaatatatttttatacaaattgcaattttatattacaaatatttaaataaaattaatacttggatgtatcttttttttttttttttgagacagagtctcactgtgttacccaggctggagtacagtggcacaatctcagctcactgaaacatccgcctcccaggttcaagcgattctccagcctcagcctcccaagtagctgggattacaggcatgcaccaccatgcccagctaacttttgtatttttagcagagacaggtttttgccatattggcccggctggtcttgaactcctgacctcaaatgatctacactccttggcctcccaaagtgctggcattaaggtgtgagccaacacacccagcctataaaaacatatttcatttcagaataaaaagtgtagtagttttgaagagctaaaaaatttgggacagatagatccttgaagcagaaaccaatctatttcataatgatttgtgcttccttactcaaatattttgattttcttctgagggaaaagggagaatgaattattttctatgacaagatatttgtaataattatactctggtattcacaggtatcattttttcataaggttgatggccaccaaggaatatggaggtcttgatagctttaattctcagctgaaagcaaaaatgggtttttggaaactgatcagaattgcatgacttcccagatttggaaaggagaggtgctcacaacatatttttattcaatgattctaatgtaaagtggatctggcctaatcaagggcactaagtaaatcaactagaaaaaatacatcagagggaactgcatataaaataataataatcacaataatgtttagtaatactatcacagtcttttcccaaggagcttcaagcacttggcaattgtctcattaattctcagaagctccctgggaaagagtagagcaataaatcacatattaaagagacgttttaaataacagagtcagtcagattcttaataaacagaagttggtcaacaaaagttggaatccagttttatggaaataaattttgtctttttcttaacaagtaatgaatgaccaccaaaaactttcttcaaaattaattgtgaaaaatatcctattgtttctctttgtattttttgtatctaaacccaattacctgtcattcttgtgacctattttcaaaattccattaaagtcagcaagtaacaaggtttcttgcaatctttagtcagatgtcatttgagtattggtgatcaagattgagagtaccttaaatgagaagtttcaatcaatggccatcatccatgctattgattaaatactttgttaccttagtaatggcccaaatttaaacatttcttaaaattggttaattttaaggagcaactaaaatagtaaaataatgttattgtttgcattagtaattagaaaattattgaaatatgaagtcaaatatatgtttctctttgaaaatagtgcctcatgctattatgggatatacaaatgaccttaccactctgaggtcagagttcaaattaagcctcagtcctaagtaaattgagatgaatggtttggtctttgtccctagtgtaaaatagtccatatcgcaaaatcaagatacatctgtttttgcaaaattggcgtaattggcattctcccaggactttgctggcatcgaagccgaagctatttcttactacaaaggaaaatgcttttctaggtcatgggtttttaaaaaaatgtgtataaaaatggctcagaccatgtctgttcacttgtgacaagggtgaattatgtctcatcataatcaatttggtgatcgataacagcacagaaacaatctagtatgtttattaagttgggtgtgattatgggaaatcgcaagataaacagatggaataattttgaagaggccacttccttgtcttagtagtagttttataagtactttcattcaattatattgagaaaaatcaagattgcctttacattctagttaactaaattattcatttatgtcaaaacctttaacatttaaatgcataattatattagatgtcaaaagacattggtaataataactctgacaacattaactgcagttggaaaaaaattggcttcaaagtcaactctttgttctatagtttcctgtattaattatagtctaatcatataatttctttaaaaatgtgttatcaattagaaaaattttgttagacagcaatctctatgtgaaaaaagtatttgtatttggtatttcccagaaatcatataacaatgtgagtacaatcaaaggactaacagtagggaaataagttaatgtatagaggtatatatgttaatgttaaataggacagtactttaattatataatctgtatttcttagggggagtgattgcttttatttttggttttaaacactttttgatagtacaagtaggcaatctaaagaatttgtagggaatgattgtttagtgttatgtattgggagattagattaagacatagtacagttacttaattatccttctattttctccaaagaaaagaaacagacaaatctttggtatccttgcactacttttaaaaatcaacacccatttttagtttgcaaatgtttgactcttcatttgcttttagtttaaatattttaagaaaagattcttttcccctcccccctccacccctgcaacacacacatacactcacacactctcacacacacacactcacacacacacacacacacacacacacacactgcaaaacaaaaacacaaaacagcttgcctttgttgctaggccatagcactttttccaaagatttcaaaaactgtctgtacttgatttttcgtgactgcataagttgtagtattggatttatcaaagcttccctttgcaaaacatcctaactgaagccagagtccctccaaacatgtaataatttatagtgagtagaattttaaggtaatttatagtgagtgagcactagtcttccatcagtttaaaactcaacactcagttttgcttattcccaaactttgtatttactttttactacttgcccctgatatttttattaacgtctttatttaacaaaagttaagtcagcagacaactgtgagtacagaaaaggaagcattttatccctgtataccgaattagaaagaactgatatatgtgtcatatatgtgtctctaaaataagctgcgcttgaattggatatgcataacagactgaaaagataggggaaaatatcacaggatttttgtgagaatagcattaagcaaggtaacatgtgaaaatagctaacaccgtgcttgatatagactcagtgctgaattgagtgtttgttttttcttttcataaattctttgatgaaagtcacatgttttctactgatatattgtctttagcctcagtggaccttagaaacagtagacgcagaccttcagaaaatagatgagaaaaccatggctgatgttaaaataagaggcatcagaggaatgcgccctatatgtactgttttctttcaaagctaccaggttatcccaattttaaagagcatgctgaggatgtttcagaacttttttcttttttattttattgatgagtactttaaaatcataattattagttttttctagagtatacctgtttaagacataaacatcagttctaaatcacgtctaagtctttgctttatttgtgtttctctttgtgttattattactttatttattcttggtacatttttagttctcaaaatgcttagaagtgtatatttgtaaaattttccaaaaacacaccattagtcttctgtcattgttttcataaagttgtaactaaagggaagaggctgccctttatttttgagtgctacttttctctcaccactgagagtgcacaggcttttggtttaatatttacatcaagggggtaagccttaattgatataagaaaatatatttttgtgacaaaagaaagctttatgtcttatgtgtttgaaaggaaataaaactaagacaacttttgcctacaagtttccttctattgtgtcatgatttctcaagggaagtgatagaagccattttattttgactcttttaaaggagaatgaacgaatcaccaccctattaagaatataatctttgtttaaatgaacattgcatggaataaagcagaatctttttttccattgctggtttctaaagcctcttatctctgcctaactcttatctctcactaacttgcctgttagtcacgtaacaggcaagttcaaaattcaccccaaagtatgatataaatatatcttaaaatataattcaaactcattactgatttgtgagaaagaatgaatggcaacaaaagagcatgagggagggcagaattggaagtagaatacgtgaataaagtaatgtttttgtgaacattaaattcaacataattccacagtatagtgcccagcccacttccgcaggctagtatgtttctaggcttcattaaatagaacatattatctaaaataaaggtgggcacactgcagcctctggactgctgcttggttttgtgatccgcaaactataataaatttttttacatttttaagtcattagtataaatcaggagtagaatgctatttcgtgactcataaaatttttattcggttgaattttcttgttcactaataaagttttatttgagcatggccacgctcaattgtttaagcacagtctatggctaccttctttctaccaaggcagaattgagtagctgtggcagacgctgtgtggctcacagagcctaaatatttacagtcttgctcgttaagagagagtgtgctgatctctaatttaaactataagggcactacgtgtgcttaatgtgtgctctcaggcagtatgcaaaaatgctaaattttaagagagagagaccattggaattaagtgaaagagttcacttaggagaaggaagaggtctgaatgtgtttaagacaaataaaaatatgaaaaatagttgaaagaatgaggatgctttgttggcaaagaagtcgattgggatcatgatattcttcaaatcttcataatcatgtgggagaatgactggacttgtcatatttaacacaaaggaacgaaattggagttaaggtcataggtggacattttactgaaatatatattgattcaatgaagaaaataaagaatatactaataaaattatactttgatggaatatctttgttcttgtaagtcagtgacttctagtacttcagtcattcatgcatagactacttgaacattttgttgacacatctggtggtggttagattgaataactttcttattctttaattaattcagtaaacatgtattcagcagctcctttgtatgaaacactcttttaggcactgggattagagtggtgagcagcacggaccaggtgcctgctcttcttgcactgtcttgatagagtccttgagggggagagacaatatgcaagcaagaaatcaaggtgttggtagggccacactttctctgaaggctctagggaagagcgctgatatgtgttgaattgtgtccctccaaaaatgtttgttaaaatcataacccctggtgcctcagaatgtgatcttatttggaaataaggtctttacagagagagtaaaattttaaaagggtcattatcatgggcccaatttcaatacgactggtgtccttataaaaagggagaatttggatacggagacacaaagagaatccatatgaagatgatgagaggttggaataatggatttctaagccaaagaatgccacagattgccagcaagcccccagaagctgggaggagtggatggaagagattcttcctcctgttcaatagaaggaaccaactctgccaacatcttggatttggacttcgtagcctccagaagtgtgaaacaataaatttttgttgtttaagccactcagtttgtaataattgattacaacaaccctaggaaactaatgcatcttccttgcctcttccagctttggtggcttagatgttcattggtttgtggcagtataactctatctccatcttcacatggacttttccactgtgtgagtgtgtgtgtgtgcgtgtgtgtgtctttttctatctaaggacattttcattgaacttagaacccaccataattcagtatgatctcatctccatccttcccttaattatagatgtaaagatcttatttctaaataaggtcatacgatggcattgtggatgggcatggattttgcagggggacacactattcaacccactataactgttatgccaagagagttgtcagcaaagggggcaggagtgatatcaaatgaaggtaaaggaggcatggaatgggatagatagggtattgtggatcccagttagcagtctggattttgttctaaatataaagaaaatttcttggcaggttttaagctgagaagtagcacaacttgatttacatttcaaagaggtatctcgggctattgcgtagaggatggactgtgatggggaaagagtagaaacaagggcaagctttgtgggtccttgtgagaaggagtgagaggtgctcagtacaaataagaaacaggccaggtttggaagacttgccgatggattcgatatacaccagggtgtaatgaatggtgtcttacagaccggggaaaagtcataagtggcttctttatccatttttgtttactcatatatttatatgagtaccagcagactaagtctttcggaagccgcagaaggttatgctgtgaaaggaaagtcccttctgactgtttctcgcagtctctttactttaagaacagctactgttagcagttttatctacatccttctgaggaaatattttacatagagcattctctttctaagaaggaatataccttctcctaaagtagggctattcttcttccataaaatccaataaatgaacatgtttccaggcccggaaaacttacattttagaaacacctgctcattcagtaaaaatatgtcagtaaagtctaaaatagcattaaattaaaatgaaaccggtagttttatgatacatgtcctttacgattgttgtataatgactacttgtaaagttagctaagacttcatagcctaggctctatgcctagaaaataagaaaaacaccttcttccccattcgcaaaactcataaatgaaaaatgaagtggattttgccatccattgtttctcctgtcactcctttaagatgagtgatgctgttttggaaagcatggctattaagcagcttgcctgagggtcacggagcctgttctgcagaatccatttgaggggaaggctggagttggttgtgtgtgtagattctgtcttctgccagccactgctgtctttgctgttccagggtctttctaggccatttaaaacgtgattaggaaaccatcagtttcctatggcaaagggattgcgcataatcaagtttccttacttgcacgaggctgagccctgtcctgtggagtctaccttccaaatcaataacaaatctatccaccactctcattcctcacaagtaacagtcatcttctagctacactgacattattctagtctctagaacaggagtctccaacccctgggccccggaccagtaccgctcgtgacttgttaggaactgggccacacagcaggatgtgagcggtgggtgagagagtgaaacttcatctgtatttacagcctctccccctcgttcgcattaccacctgagctccgtctcatgccagatcagcagttgcgttagattctcaaaggagcgagaaccctgtttgtgaactgtgcattcgagggctctgggttgcgtgctgcctatgagaacctaatgcctgatgatctttcactgtctcccatccccccagatgggactgtctacttacaggaaaacaaactcaagactgtcactgattctacattatggtgagttgtatacttatttcattatatattacaatgtaataataatggaaataaagtgcacagtaaatgtaatgctcttgaatcatccccaaaccctcctcctgccgcccacactactccatggaaaaagtgtcacctgaaaaaccagtttcaggtgccaaaaggtggggaacttgtgatctagaactgaccaaggccttttgcatttaaagactacttgtgctggacactatgccaggaatgttcttttccacttcttaccatggctaattccatttgtctgtcaggactatgcttaaagaaggctttctcctaataatcaaattaagttcttcctgttatatcccccttgattgcatttatcataatttcgaaacatatacacaatgggatagtaacctccttcagtctctgttttgtttgcaagtatatacccagtgctgagcaggtagtaggtgctcaacatatatttgtgaatgaatatattttctgtttaatatgtagtagagagtataaacttcatcacccttggtttgtgtgctttgtggttacgtcttatattaatctgtttttctttaaattctagattacatttacatttatttactataaacataccaaaataaagttcattttgtatttcagaagaacaattaggacatcatcatttagttcaatgcaatgagtagcagaagtcagaaaggaaattatttttacaaacatgaacagaaaataaatctgctaggcctttatgatgtttataacattgtagcttttgaatggttttatggttaggtattgagggaaaggcttaatagatatgaaaacaattgccctttaaaaattacagcagacaagtatttaatccaaagggggctaataaattgctcaagggaaaagggttgtaattatctttaatcattcccattaaaaatagtctttaacaggttgaatgcatttaactcagtgttctgaataccaggtaaacattggccattatttttctaatgtttactttgtcataagaaatgagcagagtgagaacacatttttatttgctaagagaagaaagcatattgtttcttaagtcacctgtagggcgaagtaaatatgcgaggaaatagtctccataattgtttaaaattcattgaagattgcttttctgtacaaaagaggggaaaagattgtgagaagcacattacagaaaacaaagatcaatgggacaatatgattaatttgaaggtaaagtaaggaagggctctcatttttcacccagtgccaatttgcagtaaacctaagcatttcatcaaagggttgctgttaaccactttaaagcaatccactttcctggaactggaacctggggccttcctgagtcctccttgagcatacagagttgctgtgatccatcttctcttcttttctgtcgacatgaatagtaagtgatttcctccctagtgcattatgaagttgtcttatttaatgtttctttctggggactgcacagcttgaccctcacactgaaggtgaccagatagaattgtcctgtgggcatggtgcaattctctacccttgaacgtggaattatgcagagtagtgaagctttatgcctagttggtgatcatgacctggaaacatacacaaagaaagggataaatgaagtttgttaactagattacatgttttaacttatttaaaatgagctattttgataaacattttggttaaaatagtttaatagaaacgtggaagtgttttacatcaccagggaacatcctgaatgtacaaatgaagacattttcattaaacaggtgatgttaataatttatttttatcactagcactgtgactacttatgaattataaatgaaaatttacatttagatttagcatacatactcaagcgtgtcctgattgttttcacaaatgttagtgggtgaggtaatggcactttatgtttccacactgatagggctacctttaaactgtctccagaagtgttaacttgcagcctctcaccttccttttctctaaggttctgtttaaaatatgtccccttctgcctgtgctataactctaggacataaaagaagtagttaggaacagatgatttttgatgtgttgtgtttccatgaacactaatgcaattagtacatccctgagagggtctttgtatttatctattatattttgaatgaatcaaggcacagtcttttctaacacattagggaatctattagttcacctagtttgctgacagatgtttcctttaggatggaagaagaaccgatacagctagttcaatttagaaaaagttatgtcctgggtgaattcatgactttctattttctctcccatttttacaataacccttcctagagaaagcatcacctttattgtttgatctccccttctgtgatgtatattgctcactgaaatattcagtataaatgaataagtgatgaatgaatgaatgaatgaatgaatgaaatcctttgaagaaataatgccattttagcacaacataaatgtctctaagggcagaatgagatgacggtgaggcaaccttttcttccaaaacttcgagtatttaaaatgctacatgtggatgttgccttgtttttgtttgcatagtcttgaaaagaaagacctaaagatggcaggcttcatattttaactgttttccactaaatgcttttgttatatttgtcgtattacttaaaattttgtagctggaaagttgaacacatcaaaacctggcttttagaaaatgattaataaatcaaaaaggtgaagtcactttgtgtctagtcattaaaatatatacacatgtacataaaacgcatctctttatatatcagcattataatttatatgttgacattccatattagcattatagaacaaccgaccaggttttttgggactcatatctttccaactaagttcacgtgagagtattttttatcgttgaacctgtatctaaaagtatagtgtgtggagtgctgtacagacatagggatacttcagatgaaaatactgatgaatttcagtcattgaggcaattgggaacttcagtaagattttaatttgagagtaatgtgttccctctgtcaccgaggctagacactacctgttgagattatttgagattcctgttctcagatatatcaaagacttgaagcggggtagggtaggggagaggtgctcctagtaatcactatggcagggttgggctttactgtatgtttcctttactcaataaactccagatgagaataactaacagaaaaagtaacttttttgcatttaaatgttgatatatacaacaaaatatgctatttttttatataggaggaatggttcaaatatacactactatttctttctttctcctttttttttttttttttttttttgagatggagtcttgctcgtgtcacccaggctggagtgcaatggcacaatctctgctcactgtaacctctgcctcccaggctcaagtgattctcttcctcagcctcccgagtagttgggattacaggtgcccaccaccatgcccggctaatttttgtatttttagtagagatggggtttcaccatgttggccaaggtggtttcaaactccggacctcaaatgatccacctgcctcggcctcccaaagtgctgggattacaggcgtgagccaccacacctggcttacatactacatacatactatttcttatggcatcctaatgggacttaaaattactgttctttgctgaggtaaggaaatattgggaaaaaaagaaaaaaaaaggaaaaacacaaaggagatattaatagtttaaaacagtttgaaaaccttgggcacattttattatcttatagttttatttagaaagacttattgtctttccatagtttatttttaactgtatcataaagtatataaattctgtattttctcctgtattgatggttattgtccattttagtgtgttatcttatggtttctgctttgttctatgaagactctttaactttttagggatttaattagactggcttttaaattatagcacctaattcaaatatttaaaacttctttggggaaggaacatattttagcatacgtggtactaaagcatttaacaacagtttatgtttttttcttttttcttaaagtttgtgtttttaagcgatattctaaaatgtaaataaaataagtaaaatgagaggaaaataaattttttttctgttattctcataatgagtaaatttttctctcattttaagctatgtctcaccaaccacctataaattatttcaaactcaaattatatggaatctttacaaatgattgccttaaaacttgaataaaactgttcaaataagtattagttataatttctaatagaaataatgtagcactttgcattacaaataactaaagcataacacacagataaatctatatgaactttaataatttgccctaattaaagctataagcttggccttacagacaattttgagttttcgtgtgtttttttaaaaaataagtcaaaattataggttttcagttttgccttatggatataagcaaactgatactgattagtgcagattttgttaaagctgcagaagctaaagtttttaaggaagggattagataaagggaaccttcagagatgatactgaaacagctcacttcaacaaactggtactccttactgataaatgtgctgtctcctgagctaagtcttaggcaaaaaaacacaatgatgacatacagcacgtgtgaaatagatattcttgccttttgaaaaatagagtgcaaaaactttcaattatgttttgaaagccttgagtactgtggataatgatagtttcctgtgcatctatacaagcttttaaaatctcagattcctcatctgtaaaacagaaatcattacacaaagcttgtggtgagaatgaaataaaataatcttggtaaagcactggtgtctaaaagttcaatgaattatagccgtattaataatttctgttgttattattggatattattatagtatcattgaaagtgaattaaacatatacatataccagggtactgtgctggacgtcagaaataagttaaatattccagaagaaacaagatctttataaataatcagaattctaggacaataatggataaacgacttctgagttattgtatacaagtgaccggcaagccttgtcaattctagcttcagttaaagtgggtgattgctggggtgcgtcttggcactgaggcataaaaggttagaggagaaaaaatcagctgggactgtggtaaaatggaagctgggaccttggtccgtcgtcaactggactctccagtcttgtagtcttgtccagattttcaagggttttgtttttcagagtagcatgcagtcctcttgactattcatatatacacacaggtatgttcttatccatcaaggtctgctctttgctgtaacagaggtgtggaatagataggagtcttggagtgtactggtggctcagctgcatagagaatcattcctgggtattctagaatctctgccagtttctgtctctgctttctccttgaggccaggattgtgaaagtgggcttttaaccaatactttcacaatttaaagtcaccttttgtgagcctccttggcactcaagtctgccccccagcacactggcatctagtacacacacacagtaactttgtttcagtaattaatcacattattgatatcagtgaggtcactgttttcacacaagagccaattaaaagtaatttattgactacattttatttccactcatatgtatacacctcaatgcagcaccttaaataattatattattacaacttactttgcctttgctattgaaaaggaaaatatcattgagaaaatactgctttttagctactgagccgtttataaacgtccagtttaaaaacatatttgaaaacttacaatgtaaacaaaacactcctagcttatatgttttagttgacacatgttttcctgggatactttgtcccaaacacctgtctaagtatgctacatatgtgaattcattttcttctcataacagggggtaggagatattatcatcaccattttacaccaaggttcgggagttagcaatttgcccacagttacacaacccctgagactggttctcaaatttcagtccagagttcatgttcttcagtggccctgccatactgtcttacattgatatggtgctttggcattcaaaaagtgcggtttgcatgtctgatctcatttcatccttaacatagtatgtggcagcagatagaattttcaatccactttacagatgaaacaactgaggctcagagagacaaagtgttctagtagcaaatgtaaaacagagttgggcccaaaggtattttgttttattcattgactggtgtgtgtcactggctgtcttagggctgaaatagaaatggatcagggcctcccacaccccgcaactcaccagtgctaccagtttcccacagccctttgatttctgcagctgggtttctctagttagtttgaacactcagtgacctggccacttgtctttcatatcttactcttgccagaattgtagaaataggttctatatttaattattttattgattgattgattgattgtgagacagagtctcgctgtgtcacccaggctggagtgcagtggtgcgatctcggctcactgcaacctctgccccctgagcctcctgaaggcttctcccgcctcagcctcctgagtagctgggattacaggtgcacaccaccatgcctggctagtttttgtatttttagtagagatgaagtttcaccttgttggtcaggctggtctcaaactcctgacctcaggtgatccacccacctcagcctcccaaagtgctgggattacacgcgtgagccaccgcacccagctgctatatttaattatttaattcaactattaatactttgtgttatactttatgaaggaactttgatgtttctgtttcataatgttaatgagactgacgttacaggtatccttcattccaagatagactacgttccagatttaatgattttcttggctagccttccgggtttttcctaacaacaaaggtcttcctgaggccaattcatcatgtggctacattgaataagtgaatatttctatttgatggtgacttcgaatttgagaaaaaccccacaaaacttttaagtataatcaagatctactatgtaagaagtatggccgtaagttaatgaaagcaacctcgtaagtctcatgtgaaagtagtttaccatagtgtttgccttcatatgttcttagtcccttctttattaatttatttttgttaattactgtgtcctcataatgatgttcattccacaggtagtgccgtccagtttgcttataggggaatgttgaatctgtgaccttaattatggatcacagtggaacttctgtgaaagtgaatgtcagtgctagccaggggctgtgttgtttatatcacgtaggctcaagtgaataaattagcacatagttctgaaattcagaagctgattttaagaacatattgatgaaccaaagttgtgtctcaatatgactttgtggttattaggcaaactcttttaattccatagaggacagagggtagctttttccaccatacagtgttaaataatattctcgctccgtgtttgtgaactgaaacaaaagatagattgaattgtaaagctctcttgacaaatgagcacgttttactttcttcctgtatttttcttctcttggcttttgtgtcctgtgctttttcccaagcagtgttatgcaaatgaaccaattaatggtagataaaatggtcttcctacctcgctgtgtctgtaactagaaggacaacaccgtaagtcacgtacctattcagcgggttctataggccactgtgagggtctgattagcttgactgtggaagacaatcgcagaggcatctgcttggttaattttgagagcaaatttaccagatggaggctgaagatttaagtgattagaaggtagtagattggaatacaaattggattaaaagaaattagattgatataaatcgaattgagtcacaacagtttgtgttgttcgtaccaagggccagcagattatgggagaagcagatgctccaatgagataggaattgatgtggctttgacagtccatctgcgaaggtctgaatatcgagtacatccctaatctccctctccatttatcaatgccataatgttaattagtacttcattcattaagttacttacaggagaaaaaaatctcacccctatcccctctctgctcgagaatttgttattttgccaagaactggaaagctctcttcagctgagctagctacagttgacggtaagggtagacctgtgtccttttcctgatgcatacaactgcctgtggtatgaatgcagaaagcttgaaaacatttgctcgtgtgtttctcttcataaatatatagttatttggaagcttacattattgcttaagcattattccactaaaaaggagtggatatattaatcggattacataattatgtatattttacattatggtttttataaggtattcgccggagttgcctgttttgtttaatggctcaagtatttgacattaatattgagtggtatttttcctccttgaggggaaagatgagaaaaattttgttctcatgattctgtgtgtttatactcacgtgcatgtttgttgtgtgtttgacatctatgggctagtttattagattatggaaaattacaggttactgacactatcaagtattttgatatccagtgtttgcctctgattgttatagaaaaaaagttaaatgaaataaaatgaatataaacacatcactgtaaatgcttgtacttatattgggaatttgattctttacaatccaaggggcattgacacaagagtctcattattacgccattggccacagcagtgaaattcagcagaaggcaattctgtcttggatgccatccaaaggaactgagccagtggagatccaaaggtgatctcacctctgaggcagcttgagagtgtgcactctaaggatagccatgaagaaatgcccctgtgtattcataaccatcaggcaaatacaacttctggagactaacgtgatgagctgggcaaaaatggaacatcaaatcctgtgatgcaagaagcatatcattaaaggttgtgccaagtcattcagaaataatcatgatacaggcaagtgtgggctgcctgccagtgtgtgagcacgaagaatttctatttttgttatgttgaagggaggcagtggcttgtgcaaaagtgtgttaagtattgtaacattcttagtttactgaagaaaattctatgagcaatgagctcttcaggcaatgtgcttaatgtagaagtgctatatagctataaatggagatgtagacacagatacatatggctgttccttattcaggctgacctggaattctcctgcatcctccccaaactccaatgcttgggtggttttggtaatcactcttaatattggctaaagaatccaatactttaaaattccccataccttcacttcagaaggagaaataccctgccctccaggaaccaggactgaaactgaggtctgtgagaatccagattctatgcacaccaactgcataggccctatgtttaaaaacaatgcagagccggtatttctaattgtatactaattgatataacttggtcataataagagactgttttaagctgtattccaacaaaatttaaaaaggagagggaaaaacactaacagattagcctgcaaagtataaagcatagagcagaatcacttcttgtagtaaagaaaaattgctaacatttgttattgctattgtgatagtgattaagtgccatctaaaaataatttagtattcagaggtcactccttgttcctgttttgacacttcagttttcagcctaattgtcagttgtctaattggtggtggttgtcttcattaagaaacatcagtacatcaaggtagtgctcactgagcctggcaaagtcatggattatgctcttagccctgcctgtgtttctgtgactgatcattgggtatttcatatcttttttagcccctgtgaggataactaaagaaattagttggttgtaaactaatgataacagggatacaacctccccatttcctgattgttgatgaactttagactgttgatatatttctcctgtgaaacatatcaaaagatatattaattaacagatatatatatatatgtatatatttacactcatatatacaatttctttcagtgtttggtacatttgattcaaatgctacatagtaacattctatatatatatatatacacacacaatagtgtattgtatgtacactctagtatgtacaaatgtacttgtgatgagtgaatgtgtatttatgctactacacttaaaacatttttttttttggctaatctcacaaggaatgtccagagattaaattgaggcccctatttaataggagattctttaaaaaatatatacagtatttaaatgtactcacaccaaatggaaaaaaaatcagccagattatatcagtgcctccatcatcatttcgggattcatatctgaggcagttggcccatggacctgatttcaatatgggcagtttagatacatatgtcaggcacaagctacctcgatgaaatagagaactctgcatctcatttctccccctgcagtcagcgtattttttcaaattttcagtgaactaaaaaaatgagaaacacagccaagttctaatatagtaagtgatgttctggcacctttgaccataaatcagtgtcacaaagacctcatggcagcctgagtaaattctgtccaaataaacgctgagccccagcgtggaggttcagagttttgtacttcatcgtaacactcatgaggcaacttgtatgattctggatgcgtaagatgaacttaggaaagtcccaatttgtaagtcaatttgatgaataagtagatttattctggccaagggagtataaaaatttagaaaaccccataaaagtttgagatttgcctgggcaacctactttgtgtttgtttaaagaaaagcaatcactaactgttccaaaatccgtttgcattttttctaggaatggagtgatgaggaaagggaaagaacatacctggaagagagaaacgatgaggcatttaggataatgatagtgtgaaattatgtcgagagacacagatggtgactgtggaaatgagaggcagtcagttccagacacaaacctggagaaagaaggaagaatccacagaaatgtatgcctaagcggttatgatagaaatggaagagttaaaccccacaaccgggattctgagcattagggacctggagaaagatggagttgatgtcaggaaggagagatgatgaaatatgggacgaggagagaggtgagggtttcattcttagatagatgaaccttgagttgatgactgagcattcaggtggtcacccgaacaaagcctagaactttccttagctggagatactaaacccacatttggctgttgttgtcatagagataatacctgaacaccatgagagggaatgagttctctgtggaatgagtgaattatcttcattgaagggaagagtagacatctaaggcatacataccttgggagctgttaactattgggtcagaaattattagacaattcacacttctagttcactagtttacataaaactcaaatatttttttctgttatttataatggaaattcgtaacaaaagtaaccagtaataatgttcttttaaaaaaaatttcaacagcagtgagcgcatcactaaaacactaaaattcagttattattgcctcatttgaaagtggggaaaattacgtggaatattaggcaaacatcattaaactcttaacatttgtatacttttcattttcttccagattttcagttgctggttgtttataagatccaacttatcagagtttgatatattgaatattttatggtaaaggcaacttcctacattttagaaataccaccctgttcgaagctatcattattctgtgtttcacaaaacttatcactttacatttttatacctctgcctgccagcatttttctttccttttagcataatccagaataattctgtgttccactcttgtgctttgtgacaagaaagcattgcatttcgagagtggctggaaggaggttaattccatgtccacatggtaataacctggggaaacctggggatgatcagtttcatttgatccctcctctgataaggcttcaaagtaaatgggctgagtggaaaacaacattattccataacttttctctaagctgcagatgttttttgacagactcaaggaattgagactcatatattttagtgaaacataattcaagcagaaaaagatcatttgaaaacgtttattgcactcacatttgctgctcttctccattcagcagaaaaataagctcttttttctctgtgcacacagaatcttttaactgaaaactacactcagtatttgtgttgcagcagtgatgttatctgctggtcattttgctctgaaacagaagacatctcctgaaaggaaatttaaagttttattaaatgggtcactaaaaagccatcaatagatatcataaatagacacaaatgaagagaaagtagatccccaaatgaaaagtatcctgatcattaaagtaacttatattctttatctactaaaataactcaagtttgcaatctaaatgtaaccactttgcatagccttactacagttgtcacatcaaaactgttatgattggccaaataaaactggagaaaatgtttttattaaagacgtaaatttatacttatttattattttaatgcattgcataaagtgaaggcaaaatacaactccaaaattttctataagattctataattttgtaaacagagcttattccaaattttagagctatttgcaactgataaaacatagcctctttttcaagctattttatgtcacaaatcttatctaaggtgtttttggtggagtaaacacttaacaatttaggtgtatatcctccaaatacccctgaagaaatatgatgctgtcacttctgttcagtttggccaactgtgaaaatccattcattgtcagtatggtacaaagacaaagccataagcccgagttgtatttggatacctttataagcctcctttgtttccaagatacaaacttcaggaaagatctccaaaagccattgtacaatattaaataagccaactcgattatggccatttccaccatccaagaggaaatctttcttttcatctttgggatcagtatactcatttttgacttgggccttttatttaaagatacacaatttcataaaggtgtcatttagaaatttctaggaaaagttattgctttaaaaggatgagaatgattttgttttgaccatctcttgaaactactggtaaaagtgcatttcagataatattcccattcctgtcatctcataagtcatgttattgtgccctcaataaagtttatttaatatcccttagttatctctaaacttataatggaaaagcaaccaaaaaaataaatagatgcttcctatgcattaatcatggagtcattccaagatttttataatgaaaaataaacagcgttggtatatatttcagtaaaatagtttagagggacacagagttattaggcatcaacatttgctttaaaaaggccgttatcttatagatcgtggttcattgtttttaggggggttacagactcctttgagtttagagacagaggttatactaataaaagagttatacattataataatgcttatactagtagggaacatttattgagtgcttgctgtgtactcagcacatggaaaaatctcattcaatcttctcagcaatgttattcgactgatactgctatgttttatacatagggaagcaagatgcagagaaggtaagaaatttgcctgagttcacacttcttttcggcatttgaaaaagaaatttcaagtcagtcctactgacagatgatttctattaactaccaaaaatatactttatcatttcttaaaaacgaacatgcacatatctgcacaaaattttgcatccggtgcctgcagtaccatcccttacctccattccacataaaccaatccatgatttatgaatcacatttttacaaataatggagtaatgcaatgatatttgcaccttaggccaaattctgtagtaaatgaatgttgattagaaatgaacaaggctaaaatcagtcattgtgtgcatcccttggacatgatgcaactaacgcgtttggctcatgaaggctataatttttctggtcgtgatttagccattattcctttaagaaactattggattgtaatcttattttccatctgtcttttaaaaatcctttctatacttatataccaaaataagtttgtctgaaatttcaggtaggatcattgaatctcaatttaactttattatgaaatattttggggtacaggaaaatttatcaagagtttctgacaaatgtattaactaagtatttaacaaagcttagcacacacatgcataaaatatcattgctggtgggaatggtgttttttagacattgacactgggtcttttggcatcttcagttactaagattaatgctactgctacagaattttcagaatatagaaacagaaggaaatataatagaaagtcaaaatgatatcactccattcagagtttatttaagtaaaatccccttttctggagacacactcatagtcttcattaaataaatgtcaatggtttttagaaaattaaacattattagacaatttaatgatttttgagattgtttcattgcatcaccttttgtaaagccaaatgcaatttcaaaccacatgaaaatattataaatatgataataacaagccagattttaaagctgtcttcctggaatagggattgtttttgtcattgaaaggtaaatctgcataagccatgaaaacctctgattgggcagtaaatcacactttaaagaataccttcaaccatgtaagatgtagcaaattgatttgaaatagtattggatgaatatccaggttaatacattggctcctcactgaattgttggaaatgaatttataaagtagaagagtaatttgttattaagaggaaaatcccccctaacagttttctagaaaccttcagattaggagtttcaaaatttatcttcaatattatatatacatgtgtgtgtatatacagatatacacacatatatacatgtacacatatatacatatatgtgtgtgtacatatacatatgtgtgtatacatgtatatatacatatatgtatgtattcatcatggagtcataggaatgttgtatatatatacacacacacatatatatagatgcacacatatataaagacacacacacatacataagaatatatatatttctattgtatattcatatatatattcttagttgtccacctgtggttcgattgccttcagcttctgactctaacttacacaaaccaagcctgcactccctacgggtgctgaggctctacctgtcactggggcccacttgctcagacagtcagtggctcaattttgatgtgggcagccaggaaattgaatagcattttaaaaatgtgattaagacttagctgataaaggcactgaataacatgcggtagtggaggaaaaaacaggggaaaaagtgttctaattttcatatttttagcaatttctgttaatggtagataagtaaagacctgagatacaattgtgaaattcaggttgaaagttttatgaatctttattacttaccttcacctgaaagatcaactcattcaccctaattaaggaaggaaattttaaagatctttgctgaatgctgaaggttttattttacataattaattacatatctatttatttgttacattttattttattttaagttctgggatacatatgcaggatgtacaggtttgttacgtaggtaaatgtgtgccatgatgatttgctgcacctgtcaatccatcacttaggtattaaccccgtaagcattagctatttattctgatgctatcactccccacgctgcccctgagagaccccagtgtgtggacatatttatttttaagatacctatccaatatagccagttagtctttggttaaaatgatttgtagagcaatgcatttactgacaatatggataaattttatagaaatttaggaataaatttctaaggtacgttttcagtcttttaaatcattgttaacttttggagggttttctaagaattcatgtgatatccattgcttttgacagcagatacaagacctacaaaggccaacttttgtaatctatacatttatcaaaagtatgaacagtaatctaaagtgtgtattttttaaagtatgtaccctgtgttcataaatttaaattgctactcattatgctttcttttagatatgtctgttaagatatcattaatgtgacagccataaagagtatgatcatgctacagaacaatgagactgtagcaatttactcttccacttacctcaagtttgggatgaataaatagtacaaaaaaccagtttaggtaattgcttaaggtgatataactaaccatatattggtccagataaaaagccaaacaaaaaacaactgaaatctagtgcttgggattttctaataatattttagacttctaaaatgtgggtaagaagaaaaagtcatcctgaaaacagagcttggacccacagctaagacaagtatatccttctagttttggttgtgagaaagaaacttcagttctttagtactctatttttcctcctcatctataaaataagggtttgtaaaaggacctctgatagcttaatcttctgttttctgcatctggaaagcaaggtcacagagatgttgcagggtgctattttgtacaactggaaactttcagaatcaaggctgcctgttgagtttgacaaacctcttttatccttatcagttccctttcacactataagccctttagttttaggacactgaaaagttattttgaaatttttctaagaaataagtagagtttctaggtctcaattttgattttgtttcaaatttagacttattaagatggcactgctgtgcttccagaaggaataataatcttataaatttatttaggccaatggcaaattaggaagtctcctgagagagttttagcaaatttcaaatggataaaatggacttcgtgttttccaaatattgatcttctcagcatatcctaccacatcactggacctctagaaaaaaaaagttatctcataatacttttctattccctcctccctcataagcaaagtaagctggaatttaatcatcatgaagaattcaaagatggaaaagttgttatggacagacttgatggattgatggcatgattcattaattccattaaattgcaaattaccttagctcactaatcaatgtagacagcatttgcagtggcactgagatatgtttccttcagtgaaggaaattttgaattggatatatttttgactaacgataaatagtaacaactaattctttggaaatctagtgtaaagctatcagcctggtccagctaaaatgtatcaagcaataaaacattaatgtcagaatcatcctcagcaaagataaactattgactattgtcaatgggattatagagttttatgggctaaattttggaaataaagtttagagttggagtatttgtcatgttttgcagaaggagaaaaaaatactacactgaacgcttactgcccatcctggtgatccatatatatgatttcttttaatcttctaaaccactcttttttttttttttttttttttttttttttttttttttttttttttttgagacggagtttcgctctgtggcccaggctggagtgcagtggcgcgatctcggctcattgcaagctccgtctcccgggttcacgccattctcctgcctcagtctcccgagtagctgggacgacaggcgccaccaccacgcccggctaactttttttgtatttttagtagagacaaggtttcaccgtgttagccaggatggtctcgatctcctgacctcgtgatctgcccgcctcggcctcccaaagtgttgggattacaggtgtgagtcacagcgcccggcctaaaccactctttatagcattgatgtcctgatctacctgttacaaatgaggcatgaacgttaactgatcaataacctgtgttctttatttgtaccacactgcctccttcctattgcgatgtgtcaggcaaccttcaccttttcgtgtagtgctactgtatctgtcatatcagcaggtggctctgatcacattcagaattgaagtaatcctggagaatcttcctgggttaattctatttatatcgttttggggaacaatattttgttaaaacagacatagttatggctagaacatactgttacatacatttttaagagagaaaaatgaacacagcatagaaattttgctggaggaagtatatttcacactctgtccctaatttgccgagaatttcttcggccctcagaaaaatttagaacagcttgaaatacattgcttggcttgtggagggactaatagctgatagggctatccagtttgtaaaagaaaaataaaacttggttcaaggaaatactatactccaactcaatgaggcagagacatttactctgtaacacatgaaatgaaatcaacaagtattctaggtgcattttcctcctttattatactacgtgattgaaatctcttcctgaaaacaaatgttctctggcactcactgcgaatgagtggttactgactaaagaaaactaaacttaaccatattcatgaattataatttatacatcaccttcaaaaatttgaagtgctaatataccactcaacgttgtaaaatatcaaatattttatcaaaaatcattacaaaatcattgtttgagagtctctgagaagcagaaataatccattatgcaaattaaggtgcttagaacattattcacagatgcgtctgcatctggctgacgaacttgatgatgctgtggaatgctacatctagccaggtctaagtgtgtgatcttctggtaagcatggaaaaaatgcagcttcttggaacctttcgctggtaatttctgatgcaccttgttcactatggagactaagaatctggtggccaggtaaggtggctcatgcctgtaatcccagcacttctggaggccgaagcaggaggctcgcttgaggccaggggttcgagaccatcctggccaatatgacgaaaatccgtctctactaataatacaaaaaattagccaggtgtggtggtgcgtgcctgtagtcccagctacccaggagtctgaggcacgagaatcgcttcaacctgggagacggaggttgcagtgagccaagatcataccactgccctccagcttgagtgacagagtgagtctctgactcaaaataaataaataaataaataaataaataaataaataaataaataaaaagaatctgtattttaaagaaatatcttagtgttcacttcggcagcacatataccaaaattgaagcaatacagagaagattagcatggtccctgggccaggatgacaggcaaattcatgaagaattagaaaaaaaaaatcccagatgattctgatgcaggcagtctgagaatcaggctttgaaaaacgaggaaaatgttttctgctgaaattatgactagcgacattcatgtgatacattttattgaaatgaaccttagaagaggtctttggaattagcctagatgccatgtgcattctttacttggtgctccattcatttctaaagaagcctggcacattttggattaaaggtcatgagttctaattctgcttctcctatctattcaattatggacaatttatgtgacaatttcacaacttactttcttggacagtaaaaataaacatttggatgttcatctttaggatcctctgaacaatttttgttatctctcttttattataaaagagagaaagaatatatatagtttatatattattaatatatattattttaattaaataatatatattttaatatatattattatatataatatataaatttgtatatattttaacaatatatattattttaattaaaacttgactgattgcccaattaataattgagatataaaaagataccagacatgatatcagtcacaagcgaaattagaattgtagatagttattttcatacatcgcttagtatatctgttctaataggaatctttgaataatttctcattatatgggcaataataacattgctgtcaaactaattttcatttgaaatctgtagaagagatatttataaatttataaatttatttataaaataaatttaaattaaaaatgaactttgtaatggaaaatgatatcaggtactcttgagcagggtgggcaaaccttggtaaatatttcaagcttcacaggctatgtaagttttctttgttaccacttcctcctcctcatcccccttctcttccctctccccctcctcttcttttaaaaacattgttagctcagagccatacaaaaactgatgtgagcagtgcttatcaaacggtattgtgcatacaaatacctgatgaagagaggggaatcttgttaaaacgcagattcagatttcagatatgctggtatgggcctaagatcctctatttctaatacacctttggatcatgcttttgttgctagttgaggggctcacactttagatgtccaaaatgttgaggttgagctgtttcatggcacttcctgtgatgaacaacccccactcccccttactgttttgttctcagtccccagtgagttttgctgacaactcagctttattttttgaccaaataatggagttgttttagccaataacatagaatacccagtagtttagtgctccttgataatcttaaaggcccaacatctttgggaatatgatgaaagctacacccccaaccccacaccaccactactgcctcccccttaacaataatactcatttccacacacagttttaaagattccaaagacttatgcattgggtccatcgtaaagaccactgctattgttatgtaatgtctgaatttaagaaagctcagaattaatccccatatttttaataacattgtaaaacttagattgtaaagctgtatttttgtatatctatgtctatctttctaatctatctttctctctctctctctaatctatctatctgggtggtgagacctttaaagttcactttatgtcctaattatctattgcaggcctgatgatttcattagaacctaagattataaatgaagaaaacagtgttaactgttgttaggagtgagcacaaattgttacacaccttttattaaacttgttcacagtgctcttttatctatcaaatttttaaaaattgctggagatataattcatattccacaaaatttacccaaagtataaaatataataatctttattacattcacagagtaatgcaaccatcactgtaattaattttagaatattttcatcatccctaaagaaatcccatccccattggcagcacttgcccagacccccttcattccccacttccataccccagccctaggccagcattgatctacattctatgtccgtggattttccttctctggacatgtcatataaatggaatcgtacaatatatggtccattgcaactagctcctttcacttatattttcaaagttcatctatgttgtagcatgtattattaatacttcatttttaaggctgaataatattccattatatggatatggcacattttatttatccattcatcatggatatttatgctgttgattctttctttgttatccattcagttggtagacatttgggttgtttctacttttttgactattgtgaataatactgctatgaatattcatgagtaagttttgtgtggatgtatggtttcattctggggtgatatatatctaggagtgaaattgctgggtcgtatggcaactacatgtttgacattttgaggaacttccagattgttttccaaagtgactgtatgatttaaattcacactagcaatggatgaggctttcagtttttccaaacccttgacaatacttgttattttacattgctttgattatatatgtcctagtgggtgtgaagtgtatttcattgtagtttcgatttgcatttttctaatagctaatgatgttgagtatctctttatgtggttatggctatttgtctaacttctctgtcaaatttgtttaactacttattctaatcctttgcctattttaaaatttgattatttatatttttattgagttatgagttctttatatattctagatacaaatccattattgggtatatgatttgcagattatttttctgattctgtgggtagtattctttcaagcacaagtatttaaaaattttataacatccagtttatctctttttttcttttgttgcttatgcttttggtatcatatccaagaagccatcacctaattcaaaatcataaaaaacttgcctctataatttcttgtaatcatttcatagttttactttttatatttaggttgtagatgttctttgatgtttttattaaagtaggagtaaaattacaagaagagtgtcctgatatgacagtactataatctttatgtaacatagtttacatatattgtaatgataaatgagtaaaattcttcgtgtgctcattggacatactggagtttaattttattgctaaatagcttagctattttttcactttttcttttataaatcaattattttatattttatttagtaagtattagcatatttcaggtcttattcagcccttatccaggcctactgcctaataagttagtgcacaagttgatatagtaaatagcaccctagtagctatttacttgcttacttttaatagtagaacagttttgcagtagggagaatgtaggttactgtgcatagggagattcatggagaacaaaggggctatctaaacagatgattgtaacctactatatgcctgttacatgaaaagtgacataaaactcttgatgtattttaagatcagagtctacagctatgtgtccagacctttacattgagaatatgtttctgatttgcaacctacttctattcagccactcatgtttaaatactttggggtctttcttgattatgaatttaaaaattcattgttacttttgtattctgtaaattcctcattgctttaagacccagtactcatgatctatatcctttattattgtgatgtatactgtaattacctatctagatgctttggatctctttagttttttttttaaagttctgacctgtgaacagtaaattactcttttgctttagatatctaacacttgtaatgtatacattcttttttggtctgatgtgattaaaaaaatagcaacttttaagagttattcctcttcaaaaaaataaagttcatttaagactaaattaaattccctttaatacattaaaacatgtattttcaattaatactgagagtgaactgaggtaacattgacaagtaaatattactgctatctgttgaagagaaatgtgctcatattaggtgattggttggaaaatcttatataagagcaaacttttaagaagtgcttatctatataatcattatgtccccatatatggtgattcctctcagcatctcctttttatttacttggagcagctggtagaacattttcatgaataatggtaattgataccatataaatgaaaaatattcaaaataacacattatgcaaaaatttgattgtgaaatatcaacagagccttctcttcctatttcttttcttttctttttctttttttttttttgagatggagttttactcttgtcactcgggctggagtgcagtggcacaatcttggctcactgcaacctctgcttcctgagttcaaacgattctcctgcctcagcctcccgagtagctgggattataggtgtccaccaccctgcctggcaaagtttttacatttttagtagatatgaggtttcaccatgttgggcaggctggtctcgaactcctgacctcaggtgatccacccacctcggcctcccaaaatactgggattacaggtgtgagccaccgtgcccggcctctctttcgatttcttacgccccttatggccccacttttattgcattcacagggaagtcactggtacgatctatctttctttgtactgtgcatggtgatataccaaattctgtcaagcattttgatatggtatatttttccttcttcttttctacctaaaccatcatttcccaaagtcaggttctttttatttttctcttgaactatttaagtaaatcacaactgtcttcgtgtctccgttgctatcccttattgataatacagactacaagtatctttcgattgtacagacagtcatgtcactgcccccttaaaaatctgtgagccgtgtaaaagaatagtcatacccctgagcatggcacaaagccttgtctcaggctccaagactgtcttaaaccttttcttgctgtatcagcttccttcctgattatgaaatgtaccatgcacgtaactgtcatttccttgtccttttgctgatggtatctcttggcatgatgcttttttcttttagttgtcatttttcattctttacggctcaatctaaatgtaatttttttcggggaagggatctcttattatgcttaatttagggttaacttttactttttttctttctgcctatagtgcatttcttatatacctctatgcagcgtattgcattttaacatacggatttatacttgagctcttcagtcaaacacacctgagttcaaaatcctgcctctgctgcttgcctcatctacatttctgggcaactgacatcatttcctaagcttttgcctcatctgttaaatgcagataatatttgtacataatttacaggtctctttttgtgttagtctgataacatattggcagcacattaaatgctatctatgtgtgtcttctagctgcttgctgacgtggctttcttccccagtgtataataagcaatctgaggacaggaaattagtcttactcatcttagtacccatgctgatcccagaagaacaagaaagtctcttgttctcttttacttttgcttgtcatgattcatggaacacattaaacctaactcctttgagttaacatattaatttattggtatcgccctatcctgcaaaggagttgagatgacttatgagatgcatacacaaaacgaaacataaaataatgttcagttggataatcgaagagtttaatttccccatcaggaacccaagtgaaaccgagggtttagataaggaaatgttaaagcttgtctttattccgtcatgttttgtaggatcgcgtcttcgccaggaggactttcccccgcggattgtggagcatccttccgatgtcatcgtctctaagggcgagcccacgactctgaactgcaaggcggagggccggccaacgcccaccattgagtggtacaaagatggggagcgagtggagactgacaaggacgatccccggtcccacaggatgcttctgcccagcggatccttattcttcttgcgcatcgtgcacgggcgcaggagtaaacctgatgaaggaagctacgtttgtgttgcgaggaactatcttggtgaagcagtgagtcgaaatgcgtctctggaagtggcatgtaagtgaacataatgaacctcatgtgcacatttacttttatttatttcaagtaagttttgatgtgttcccatagacgctgaaacctaaagaatcaatcaacacactgcataattttacttggtcttcttcagagaagtctggtcaagatagtatcaagccagggtgttgtagtaagtttgtttatatgaaatcaagatgaccaatatgttattataagaaagcaggccgggcgcggtggctcacgcctgtaatcccagcactttgggaggcggaggcgggcggatcacgaggtcaggagatcgagaccatcctgggtaacacggtgaaaccccgtctctacaaaaaatacaaaaagaaaaaaaaaattatccgggcatggtggcggcgcctgtagtcccagctactcgggaggctgaggcaggagaatggtgtgaacccgggaggcggagcttgcagtgagccgagatcgcgccactgcactccagcctgggcgacagagcgagactccgtctcaaaaaaacaaacaaacaaacaaacaaacaattatgccttaaaatttttgcactcttcagcttccttgttgtcatgtacgtcttcaaagataagagaattgggagatttcaggatgctggaatcttatgtatatagctatatatattttctcctaaataatagctcatgggcctgtgtctttcttttggtaaacaaaattgtacttttctttctttcttttttttttttttttttgagacagtgtctcccgctgtcacataggccggagtgcaatggcgcgatctctgctcactgcaacctctgcctcacgggcttaagcgattctcctgtctcagcctcccaagtagctgggattacagacaccaggcccagctaatttttgtatttttagtagagacggggtttcaccgtgttgcccaggctggtcttgagctcatgacctcaggtgatccactcgcctacaatttcttatgtagctatcccaatgaagtttttcgttctcaggcatctgcttctgatttacagtttgtgctaagaaacctggaacccccggatgctggaaatgtataactccaataggaaaagactaggagaatcctaagacccatattttttattttttgtgaagtgccttgagctatgagcagtaggactttagttaacaatgggattttgtactggccaccaaatagttttatttttataaaatgatacttcaaaaagccctcaaattaaatgcaatttgaaatacacacacaaaaattcaagaatgcaaatatccatacctgttccatttttgttttgaaatatctaattttggaaacttttcaaacatattgaaatacctcaataccaaattttattgatttttttcccccaacagacccttttatggtgaatatgactggcattattctcccattttcaagataaagaaaatgatgcccaaaaagtttaggtgaccaagattcagacaataaattaatggggatgctagaccaggtcctgaatcttctaatttttatttttagggaattgtgtcatatttgaagaaacactctaaatgaaatctggtctattttaaatatataaaaattaagaaattttaatttttcatttttaaaattctatctactcagcagcaaataaggtgtttaaatccttaacaaaattttacttttcaaaattaaagtatataaaaattgacctgtcattttgttgtttcatctaaaagaattgctttcttttctaattgcgtcattaataatgaatcaaactgttctggtgggaatattttaaaccatgatttttgtgtgtgtgtgtaatgtgacagtaattttttttattttgaagtaaatgagctttaagaaatacttgaattactcatgacctagagaggaaaacaagaaggcttgcaaattggattagggagtgaataaaatccctttttctaatgccatgtcaacagttcattccatttgaggcatcacaaggtcaaataatattcatttatatgttgctcatctctttccattcgctcatcagtcttctatctttccttatgtgtttcataaaacatattaatatggaaatttgggttaaagcattgtgatttttcactacctattggtaactaatatgtattttcataaaatgacagaggaacagctgtagaggaacaacttcagattatgttaaattggccttcatattttagaaaactcaacataaatactcattgtggtgcattcacttagtttattaatagaaggcggatatccactgaaagaggtgttaaggaatagcaatgaagacacattccaatgtattctcaaagagctcacattctagttgggatgacaaacatgtaaataaagagttactataataaattaaatatacaaacaataaagcctattataaagacatgtaaaaatactacgcaaatccggagggaagacatttaattcttcctagataggtaagcttaagaaatgattctaagaggatacattactttcacagtgatttaaggtcatttaagaatgtcccaggtggaaattgaagtgaaagaccatccaggtagaaagaatggaagcttaaatgaacactgtgtattcggagaactgccaggtgtctggatatgaggttgagagcagagtaaattggaaaggtaggcatgtgctgaataaaaatctaagctattttgttatgagaaaagagaatctttgaaagagaattgaagattgcattaaaggtatgatgattgaagtcagagaggcattaagtagctgtcaaataattcagaaaagagttgatgctagattctgaactgaacatagcagtgaagattgaaaggaggaaacagcttgaaacatatttaggaattataaactatgtgacatgatcaatgagaagtagaggatgattactagatttgttttgttttgttttgtttttggttaagtgactgggtatatagtgctaccatccatagaggtgaggggcaggtacaggagaaataactctagggaacagaacagtatggtaaacgttagctgtattgtttgacataccaatgaaatagtaagcttaaaatatctcaagtttcattaaagaaacagcttcttctagagttgaggggagaggtctttctgagataggtgttgaagccacggaagtatatagaagtagatgtgatttccaggcaggctgtgttcagggagcagttaataagggctgagtccaattccagtgcttagaacagtaatatttagtggtggtcaaggcaagaaatgctcatgcaaaaggatcagtctcaggagaggtatcagagtgatagaatatgggcagtgaagtggcaagaataatcaaggaatacattaaaaaataataaaattggggccaggtgtgttggttcacacctgtaatcccagcactttgggaggcccaggtgggtggatcacttgaggccaggagtttgagaccagcctgggcaacatggtgaaaccccgactctactaaaaatacaaaacttagccaggtatggtggctggcacctgtaatcccaactactcaggaggctgaggcaggagaatcactcgaacccaggaggcagaggtggcagtgagctgggatggtgccaatgcactccagactgggcgacagagtgaaaccctatctcaaacaaacaaaccacaagagtactaaacatggttgacacgatgcaaatcccaaatgatgatcaaataaacagtacctgtgggctccagtgatggggacagaacagctgaagagcgagtagtggtgggatggaagtagcaaatgctgccgggtctttcctagaatggagctctgaatggagcatggagaattagagcagggtacctcaacctctgcattactgacatttgggatcagaaaattatttagtgtgtgtgtgtgttgcgtgggtgggtggattgtgctaggcattgtaagatgtttagacatacctctggcgtttgttcacaaggtgccaatgggattctccctagccctgttgagacaaacagtatgtctccagacattggaaatattcctcaggagagaaagtcagttgagaaccactgacctagatgtacctaagtagtcaagaatgtattgatatgtaggacataaacatgtcacaacttttatcataaaatgattattgattaaaaatatggaattttttttactattttttattcacattagttgtcatttttaatttcaaaaatgttcgattctactatgatacgaaatgtggaatgttattgataaccatctgtcttgactgattttttggaagtcagccagttctttaccatactgcattcattttggtgtttgttttcctttaatacatgcttcacctttatgttctggaacaatacagcagagggaaaaaaattcaggaccaatcattgcaatgaatcacctcaaatttgcttttatttttttcttagtttgcaaaaaaaaaaaaaaaaaatagctatccagaaagtgttttttgagtcacttgacctcaaaaataatctctaggcaaaaaatgttttttaaatagttagaaaacagttgcagagttaataagcaagaggcctggtagtcaaaaagctaatacatagttttccaatgggaccaccaggagagccatggtgtagctggtgcagataaagtttccgttctgaacactggcgctccctgtttatggagcagaaggagcacagggggtcctcacagagattgtagctgcctgtgatgcagctgagtcagtggcagcctctagagatggcagctgtagccccaggtggcaaatagatgacagcagcttgatctatcgaccagggtaagagggggttctggcctaaatgaaaattcatgaaaaattgatgaagtccccagattattttttccgtttccttttctcagcactgtgccagtgcagagagtagagattaaatgaggtgctgaacgctttagtggcaaggaggttgtggttcaaaggtcaggggtcacatagaaaccaatctttttttttttttcttttttcttactgctaaagcaaaacacaagaaacttttcagattagctgtgatttacctttgctttgataaataaaatgactacatgttcaaaagttggcttttgatgcagttacaagagagaacagatgtgattcataattcaagtatggaactggaaatagattgaattccatgacttcaggatgattattttttctttttctcttattttttgtcttctgtatgaagactcatgctgtatgaaagtcatttagagaagaagaaggtcttgcattatttatagggttacagattgcgagaatagcaaagctatggaacactgtccaaacataatgctcctgtttgcttaaatagaaaattaaattgatggtttatctgtacaaagaagagaggctacagaagtagactgactttagtatgagagggcacaggtggcactgaaaatgaagacaaggtaaagagcttccttgatctcctcaagttaataaatatgtaaatgtttgttttttattttattttggctgtaaatgcatcttatctaggcaaaatacctttacacatcataaagacacaagataaattaaattgcaaaaagatcaatccatagagagctttttaaaaaaaatgcttaattgagatatatttaacataccatatcatttactcatttaatatatacaagcaatgtttttggtgtattcatggggttgtgcaatgaacactataatcaaatttagaacattttcctcaatcctaaaataaactctatacccattagaactcagttcccattcctgcaccctctcaccccagccctaagtaaatgctaatctactttctatagctatacattttcctattctggacatttcatatgttagaatcatacaatatattgtcttgtgtgactataatagcatcttttccttaacattaatgttttcaaggatcctgtttgtttagcatgtattagtactttattcttcattattgctcaataatatttcatggtatcaacataaccactttttatttatccattcattgtatgatagacatttgcattactcccactttttttctgctatgaacaatgttgctatggaaattttgatacacatttttgtgtgcacatatggtttcatttgggtattctcataagtttatgcctaagagtagaattgtcgagtcatatggtaactgtttaactttttgaagaatatatatgtaattattattaagtgtagattaaatgatatttactggtgcattgaagtaactgtatccaactcacctctcaatatgaaacacagtcataaaacatttctactgttttatccatattattatgtgactgttatgttagattttctatgtcgtatgtccataatttcaggtaagagtcaactatttaaaaatatagaacaattaaccatatggaaacaacggatggccacaaagttcctaataaatccttgtgtaacttctactagactgttttcagtttggtcccaattaagttggataatcttactgtttgagtcttcacttcattttctgttctgtttgtatttgttctgaaagctggcaatttgtcttctcagaagctgacgttacccttcctgagaataactgacagtactttcttcattctcgggttactttctcttccaaatatactgaggttttttctttcacttgtcaggttcagactaagaaattaatgaacaattatactagaagtcagttaagtaagtctaagagtgggaaaacaaagaactattatcattctctatctttcttaaaacaaagaagcacacaaacaaacatatcaacttaaatgcaaactccgtggcgatgagttggactggaactaatatttacaggtgaggaccaaaaagaatataggagcaactttcgttttttgtaattttctccatttgcatttctacaaatgtcaggtgagatttcatatatttttggtggtgatggtgggtggtaggggaggaggatacttacacagctgaaaaacgctccctagctccaggtacttcacaggataatgctaatatgttattttggctgttttgtgagtgtgccttttaattttgccatactccatcaaatactttcaaatgcagtctctcctttgatcttcacaaatgaaggtgtgaaattgctacacctggggaacgtgtatgaatttgtgatctatttaagtatgtataatgctgtattttgatacgaggtttatttctgttgattgaattaactgtattcaaactctctctcaacaagtctcaagttgccattcactgacaattagcctgaattaactctgactcccaggaaagcacataaatgaagtgaagtcattgtgtcctctacttttcaaaaatttattcccataaacagtataattctgagtatgatcctgaggtctgcagtcaagtagatcctatccataaaatgacaaggaaacatattcatagtgatactaagagttcaggagataaaatatgttgaggtctgctccggttttcgatcccagaaacccttttcatataaagttaagaaaaataatttaggattttgaatttatttcttactgtaattttttgtttgtttgtttgttttgagatggagtctggctcagtcacccagactggagtgcagcggtgtgatctcagttcactgcagcctctgcctcccaggatcaagcgattctcccaccacagcttcccaagtagctgggactacaggcaggtgccaccaaacctggctaatttttgtatttttagtagagatgggattttgccatgttgcccaggctggtcttgaactcttggcctcaagcaatcctctctcattggcctcccaaagtgctgggattacaggtgtgagccaccgtgcccggcctcttactataaatttttaatttattaaatttcagctggtgtgtagatgcaagttgattttactgaaaatgtaggtaggttgacattagcttaggaaatataatttcgtgcagtaactcatatgcttttctcccaggatttgtgtttcggcagaatacagatttccaatttcccttctttagatctataattacttaaggaaggttacacttcttttaagcatgagtcagtatatatgataaggcctttacagaattatagaagtaaaaacaataggtgaagttttgtttaactatgaaagtttttgctttatagatgtttctaacagtctatgatttagctgctaagggatgaggttcaatagtattaagatattctctccactatataccattagaattgatttttcctcttaggagattttcaaaagcaattctgaaccacccatttctgaattaaaaatacttatacatttttgtcaattagatattcatccactttttgtcactgtctcccaaaaaatactctatgaaagcattactgagccccaggttgggttgtttctctaaactatttgaagttttctaacatagtcctcctttgtctactaagacgtcagtagtttaacaactctggatgtcttagtctgttcaagctactacaagaaaataccataaactgggtagctttttaggaaaataaatttatttctcatagttctggagcctataagcctgagttcagagagccagcatggctgggttttgtgaggccccacctcctggttcatagacggcatcctcacaaggtgaaaggcactaatcccatttagaagagctctgtctcatgacctaatcatcttccaaacgctccaccttcagtgacatcaccttcagggataagatttcaacatgtgaattttggggggatataaacgttctgaccacagctctggcctttggagagacttcaagcaagggttgtaagagaggcaggtgtttggatgcaatgacagacagggcctggaaattgagcttaaattaacacccaagtagagaaaaggctgttctttctcaccgatattggcagccctacacatttgtcggttcctcatctgaggagttaaccaactgcgaattaaaaataatttttaaaaactaacaaaaatataccaacaagaaatattacaaatcatgtggtatagcatctatttgcatatcatttacatagtattaggtattataagtaatcaagagatgatttaatatatacaggaagatgtgtagctatatgtaaatactatgccattttataaaatggacttgagcatccaattcaggggtcttgagaccagtctcctctggataccaaggaacgaatgtgcctctttctgagagccaggccgtttcctagtaatgcaactataaaggcaagcatcacattttttgtgtgtgattatctaacatttaagtctgaaccaagattttggaataaacgttacagtatctatatatggaaatgaaatgtaactattttttccataacatgaggtatatttgatataaaccattttatataaatctgcctgcctcattttctttcttcttgctttctttgcttattcaaattgaacaagtacattatacatatatatgtgtgtgtgtgcatataaacatacatatatttttttcttaacatgaggtatatttgatataaaccattttatataaatccacctacctcattttccttcttgctttctttacttattcatattgaatgagtatattatacatatatgtgtgtatccatgtttatatatacatatgtatacacatatgcatatatatgtatacacatatgcatatatatatgtatacacatatgcatatatatgtatacacatatgcatatatatgtatacacatatgcatatatatatatgtatacacatatgcatatatatatatgtatacacatatgcatatatatatatgtatatatgatgtgatattagagatgtgatcccactcactgtgttgcctaggctggtctggaactcctggccctatgtgacccccccctaccttggcctcacgaagtgctaggattacaagtatgagccatcagggccagagaatactttctcttaaatcaatgtttaaacatctttgttgggtttcctaatcgttaagagtaaaacgggttaaagagcacctctggtgctgggctgcatatgaggagtctgagtcgcctcaggtggcagtgaaccttccaccctggtgatgtagggtaggggccttcagacagggcatactgcaggagtgaggaggggccgcaagttgcttctaggtgagtctgaatgaaagatggacttagaaaactggaaagaagtataaaagcaaaaccctgaggttgtgcttggccagatttcgagcacaaataatgtattagcttaattggggagtagatgtagggtagtagagggagataatttaaatagcgaggtagaaattagtaatgactaaacgaattgatgagctttcatgttatcctagaacccaagggagcactgtttgatgtgggcttgttatttggaagtgaggtgtaaaaggagacatgataaacacagtgtggggtagatgggagcccaagagtgtggagggaggaaatctactgtatgttcaggtatagtaggatgaggattaagttgattaattaagttcagaataggaaaagaggagataaaatgttgaaaaaaaaggttgatagaaatttaaaaaacgcatctgtagttcaagtgaagatttaaatttagtttgctagagttttgtacagtaccttctactggtcggtactcacctaggtgttaggatacagatacttagaacaagctttgtttgatgggtatagagtttcagctggcaagatgaaaaagttctagagatctgttacacaacagtgtgaatatacttaacactactgaactgtacacttaaaaatggctaagatggtatattttatgttgtgcattttttttgccacaattaaaacatgaaaatattaacaaaacaaataaaccaccaccacaacaaaaaccaaggcatggctcttgccatcaaagaacattcaataggatggtctagaatgtggtatatgtgagagtgagggaggaggagttgctctggtgtgaaatacagaggagaaggaggctgactctgcaagagaatgtggaacaggtgaaatgattttgctagggagaaaataattaataataatctctggggcttgctaagggccaggcttatttctgtgtttcacacttatggctgattcagttctcaaaacaaatctaaaatttgggtactattattttctctctattgtatttgaggtacacagaaaggagagctgggatttgaacgctggcagcctagctctcaagcctgctttcttaattactatgctaagcatcctcactgatttacttgaacaagcaaacaaaatcatttgacacttaaaagagtcattagcattgccttaggtattttacccagaaacagttattcaattgtataaatacaatgatgacccctggaataggtgaagtccaagagtagcattttggcgcaaacaattctgtgattcctgggatatgacggaaagaaacaacagaaagagtaatcttttctatttttttatttagttacatattgacatttgagagctcattagtttattccagtaatttgattttctctgtacagttcctagttgtcaaatattagcatcaagaaaatccatcactttcagttctcattgacatgtttgcaggccaaagcagcttggagattaagaatccaatttataagacaagtcatctatcattgaatatccaaagataacttgactaagttttatagaaaaagaaatatgataatagcaatgatatcttactactttaggatactttctggagttttttgagtcattaacatatttatatgcattatttcattgctatatgtatttgtggacatttgctgacttagatagtttcaaagttcaatacatagtatcattaacattggtctatttgactttcaaattactctttttatttttttatatttaaaaatgaatcaaaggaggaagcatagccttttcaaccaatgatgctgaattaaatatccacaggcaaaaatataaatgaacagaaccttgacttaaaccttacaaattatgcaaaaattaatctgaaatggatcatacagttaaatgtaaggcataagactatatatatataaatatataaatgtaaatataagtatatatgtatatacatatatatatatagagagagagagagagaggcaagttctcactctgtcactcaggctggagtgcagtggcgtgatcacagcacactgcagccttgacttcccagactcaagtgatccttccacctcagtcttcccagtagcttgtgctacaggcatgtgtcaccaagcccagccaatttttgtactttttgtcgagatggggtttcactctcttgcccagactggtctcaaacttttgagctcaagctatccaactgccttggtctcccaaagtgctggaactacaggtgtgaaccattgggcctgacttaaaactataaaatgtttaaaaaataacgaaggagaaaatcctttgtgtctagaatttggtgaagaataaagcattaaccaaaagacaaaattaataaatttgactttattaaaattaaaactttaattcttttaaagatcttgtttatggaaaaaaaagacaagctacatacagggagaacatacttgcaaaccacatatctgaaaaaagcatatctagaatttataaagatatatcaaaattcaacattaaataaaactaataatctgacatcctttttattttaaaataagtatacacaggaagtatgtctactactagagatactagtagtatctctcttagatcctgtgaatctatacttagtacaaaataaaatattaaaattagttgtcgagctatcttaagtagacattaataatatacataaaaatgaatttggaactgaatcgttctttggaaagcatttgaatgtttgtttttcttaaatattgatgaattcatattttgagtgtccatgatctgttaaaaatcttattcaaattcatgtatttactgttttaaatttatacatttaacttgtgatacattctgtgtacagtttcatgaatttatcttcatatctttgatttttgttacatcgcagttttttagtttaaggatagattttatttcattttcttttttaggggaagggaaagaaaagagaggaatgtttgttcatgggagtttggcaagaatgcccaaaacatgacttaatgagtagagtgcattatggagctggcaagaagtccctactttaaacgaggttaataaagagatgcaatgcgtcttgatcctttgctgctaaaattatgcatggattattgtgaatatttctaagtacctgtttaaattcaccattacaactgaaatgtcactatcggagaaagatcagctgggcgcggtggctcacgcctgtagtctcagcactttgggaggccgaggtgggcgggtcgcttgagcccaggcgttcaagaccagcctgggcagcacggtcaaaccccatctctacaaaaaaatacaatagttagccgggtgtagcggtgctcacctgtagtcccagctagtcgggaagagcccaggaggcggaggttgcagtgagccgagatcgcgccgccgtcgcattccagcctgggtgacagagcgagactcgtctcaaaaaaaaaaaaaaaaaaaaaaaaggagaaagatcaaggagttttggggggtggagggggggacgcaggggccggagtctcgccttgtcgcccaggctggagtgaggtggcgcgatcttggctcactgtagcctccacctcccggattcaagcgattcacctgcctcagcctcatgagtagctgggattacaggcacccgccaccacgcctgggtaatttttgtatttttagtggagacggggtttcaccaggttagccaggctggtttccaactcctgatgtgggctgatgcgcccgcctcggcctcccaaagtgctgggattacaggcgtgagccaccgcgccctgccgagaaagatcaaggatttaagactatgtcccaagaaggaaaagctaaaggaataggaattattgttccaggagcattaaagacatcagtagatcctatcgttcctacccggcacctcaagaactattctcccaaagagagaatacatttattctatttaaccttaagaaagaaaaggatcagtggataaaagtttcagcttttcctcggtgtgccatacggtgattatgctatatgtgttctttcctgggatcttaaggaactgtgggccaaccaaaacaacataacctaataaacctaaataataaataaacctaaaaagttgcataaaatatgttttgatatggctttgccttacgtttttcctcagaggaaaactgaatctccaggataatgaaacaaggtaacaagacagttctgatgccctttcagttgcagaataattctcagcactttcctatacacaaggaattcaataaagtagaaataattttcttaaacttagcattatcactgttttgaaaagtccttgaaaaaatcccgtttgtgcatacgtcttgcacgtcttatttcaaaatccattgagattgtaagcaattaaatcaattgcattttgtagaccaacccctcatttgtaacatgtaattccccaggacccatgtgtccagattcaagagcagcttgatagaaagactgatttatttttattttcttcctgggtctgctttgaatattcttaaaagaaggaggaaaatgctgtgtttaatattcatacaggattttgtattaaaagcagcttctctcaaaagcctgttgttaagaaggactacctataaaggggtcaacttgtgaaatccttcctaagtacttatttggttcttggggattgatggataagctgatggagtctaatcttcaaatgtgtatgtcattaatagagatgtaagaatctcaatgtgctttgtcttttcctttcctgacacattataaggaaaagctttactaatgaagtacccaatggcaataacccattatatgctagaatctctctttgtatcagatgacatgcaaatgaactgttctatttctgtggagaaagagagacaaggagcggtctagttaatcatacttgaggactgcatggttgtcttctgggaaatattatcatgattcattcttatttaagggtcctcaccctatgcataagaaaatctcccattcattccatttgggtttgatgttaattataggggcattaacggaagctttctcataagaaatgaatataggattaaatcagaaaataataaggcaacctttagatgaatcaggtcatgatagagctatacatgtagaagctggcaggttggaggaagtttagagatcctcagtccctttgttgtttagatatggaaactgagtcctggaggagtgaagtgacttaactgaagtcccagctgatgagaggcaggcatgagatgacaaacgaagtagcctctttcatcgggcagcaatgtagagaaagataattctgggagtttaagagaccacgttctgaccattttctactattaactactcctgtgatttggggcaaaccttttaccttctctggatctgttttcttaaatttgaggtgagactagactaagcatttgccctctggaaaaggggaaatctaagcaagctcctataggagattagtgtgtgattattattccagcttagttcattggaaaaaagatatttctaaggtatcatgtatattttgttttcaaaattgaagacaccagccttggatatcaaataaatttagtagcacttttaagctaaccttttccctaagccatgaaaagacttttttcttattccagaaaatattttattttatttttatagcatttctttatgtgtcttatagttggcaagtaattgataatattgctggtaaaatgaggcatttccttaatcttacatgtcttgagaaattagctgttcatgtatccatgtctacacagtcctcgttcaccttgtgaccatgtaattaagtcatttttcttttccaatcagccattcaggtctaaggcaaatggttttttgaaagattatgcacaccttgtaccagtacttctggtccctttaggtttaaagtgtacaagtagagattcctagtatatcaactaaattattttcttcctttaaaagagaaaataatttttttaaaaaagcaaagaagtaatttttttactcatatatttgacttacaccttgtatataaaatgttttgttaggtgaaatgtattttatctatttaccaaaacattttcacccaaatagcataattttacaagtagcagtcatatattaaaccaacatcacatttgtcctctctttgaacccacattatctgaactactgtaaagatctttttcctgtgagtgtttttattttattcatttttttaaaaatgttatttattttgtgttatattatcttcctggttatatgtaacatctttccatcttagatatgttggaaactccagaaaagttttaaaaaattaccaacagaaataaacaccacttcttccattgtgttttaatttcatttctgtcaactgtatgacttgaatagacaatctgtggaatgaatttagttttagtactttaataaaataaaatataaaaatactacacatgtaagtaaagtaatttagagaaatttcagaactagtttttctatttttcaaagaatatttagaaagcttaaataatagcttgcacatgtactcagaaaataggagtcatctaaattgcaaacttgtttaataagttcttccatatatgagcgctatgtcatcttcaaagttttcatataattggcatagtgctaaatattttataacacctctgtaaaataagttaaaatatttttctgccacaaaacattgtttttttagctttctaactcttgtgatatctttgtgaatattagccctttctctactttataaaccaagtaacaaatacaataagcctcacattttacatagtaaaaataagcggaatcatcattactccgtgaactaaccgaacttttatagtccctttaaaaatgttcatctgttgttttgtttgggagtttaaagatagtttattctgcatttaaagatactgtttatttcagtacatagatgcatttgaaactagaaagcaaatttagaatacttttgtatttgtttgtgattatcagtccaagataaaaatggtttatcttatccaactagtctttctttacctataccagagtcctcagttggagtgacctttggagtggctggtgtcttgggtgatgtagttaatgagatctagcgacatcatgaccctgaccccttcgtggccctgactcctctcatccatcttcttaaccccacaaggctgcaagtcagtgtgtagaatcaggattaaacaagtgtgaataaacaagttcaagagttttctgcagggctgccagtgcatggcagtagcaaagtaagacacagagaacttaatacctgaaatgctctttgtgcacctccacgaatcctgttggagaaatcagtaatgtttgtggtcagcgtagtgcgtctaatctcctcagttcgctccattcctggacagtgatggcagttggtctttataatcacatagctgttggcacattcaatgaaagcatggctgatctatcacttacccaatgtcacacattgctaaagcttttatctcattaactgtgattaatgtttgtatggcatgggcttgtcatgtaactgttcatattcagcaattgtgaatcccttagtttacttgatgactgaagggtatttctcgtttcagaagagaactttatcttaggggcccagcagcctttttgcaagccaccattgtcacatggcttgagaactgtgtgatgtagcccttccttggctccttctccattactgtccttcagggtgttacttgccattaaacttggacacttagaaaaaaatacaagaaatgtagtagaacttcaaggaagtatttacctgtaattctttcgtctaaacattgcttttctaatatgatttccaattaagtctgtgttcccaaagtcagatggaaaggggtagagatgatggatgcaggtattttcttgcctttggctacggttcttgtctttttctgtgctatgcttggcaagtctttcgccttagcccagggcagcctttggtaagttgaccagtcagtgattaaacatatttatttagttcagtgggtcagagctattgcgacagatagaaaattactgatggattatcaatttcagcacctctgacatctggcctcagtgtagtccatcatctgaggactcataacacattttcttcaacaataacatgctcagctacctgtgtgatcacacagctgaatatcggaaagattttgttcagatttaataagacaaaagttgcagaaatcagacgagttctgcacctatacttgagaatctaaaagcacccagtggtttacacacaaggctggaataagaactgacttgcactgtaaatatgctttgttgatttttgtgatatttttataacatttttacacttacattttggatttgatgaaatagttacttggaattattttggaaacaatgtgacatataaaaataaaaatattacttgtttcaaaatattctattaaaaaatttaaggcattaaaataatggttttaaatgtttggtctactacagtgataaaattaccaaaataaaaccccaactcaaatacctatgatactaaatcttttaaattataaacaagatgtgaaataagatttgcaaaatttttgtgtttattgttattgctgaatggttcttttaacccaagggagttctagtaataaagaataacaaccttattgcaaatgctaatctaacacagaaatgtattctattcctctgtccattttactatatctcagtataattttcttcatatctgtatttcaaagttctacataaatttaagaataatcttgattcatttttcaaatgattaaggttagcagtttgttttatggtaagtttatgtcttttaaaaactggttatatttgttgagaaattaatagattgtggcagagaatacattgtaacttttattttggctttattctcatttgtaaatctttcatgtgattatccctaaggctttatactccttgcacctaatggcctactttctgatgagcctacatttaatatttatgtgtgctgtcataaaaatatttttgaagctaaaaattattcttaatcttcatatgatgcattttcacacattctcttgaattactaaactgataagaacttagaaatgttacctttgttcacaaaataaggattgagctctttgacattgcagtttacatttattcactaatacaccagtgctatgtgccattaaattgaaaggccctttggaatgtccagctttttacaatgtgatataatgtggcaatattacaggttattgtgggccattatttattgtcaaagacttcctgatttgtcttagaattaagtgaggtttcttctatagttctgtggaaacctttagtagttgactatggcatttaattaacccatctctcctttgatatctcagagctggcttggaaaatgttgggatgaattctagtcacagaatatgctcagtaatttagattgggctgaaaaaactgctgtggatgttcaaaaaagacacaatttaaaaaatgagggagatcagattagaatatgagtttgatttggaaattcatttgagcagttgtagggaagccattgtaacattttttccttaaagattaatccctataacaattagaacactaaacatttattggttttaaattcttaaatgtgatgcctagcacttatgcttcctcagatgttttacacagttattttaaaattggagatgctccctacgtgcactctatttcgcttgatgcccaagtttccttttgattttactctacgccattgacttctctctgaaatgacatgtattataaactatacatgacttgtcaggagcaggtcaacagatatttttatgtaaagcaagcatgcaataacagaaaagttatatacagtcacgcattgcttaacaacagggatatgttttaagaaatgagacattaggcaatttttacattgtgtgaacatcatatcctgaacttacacaaacctagatggcatagtctactacacaccttgactataacgtgtagcctattgcttctagcctataaacctgtacagcatgttagtatactgaatattgcaggaaatttgatatgatttggctctgtgtcgccacccaaatctcatcttgagttgtccacttggggagtaagggacctggtgggaggtgattggatcatgggtgagggttcctgtgtgctgctctgatgaatggtagtgagtgagttctcacgagatctgatcctttaaaagtgtttagcacttcccccttgctctctcttctcctgccaccttgtgaagaaggtgcttgcttctctttgaccttctgccatgattgtaagtttcctgaggcctccccagccatgcagaacagtgagtcaattaaacctcttttctttataaattacccagtctcaggtagttctttatagcagtgtgaaaacagactaatacaaaattgtaatacaattgtaagtatttgtgcacctaaacatgtgtaaacgcagaaaaattacaataaaaatacagtattataaccttacgggactatagtcatatgtgcagcctgttgttgtttgaaacatcattacatggtgtatgactgtatattattttagcataaagattacatggatcaaaccagtagcatgaacacttgttcttccatcaaaattaatcaacttagaagaaaatatttatgaatgtaacttgatatgggtcaaagtttctttaggtaaagaagcacggaagtaaaatctccagatgctttcacatagaaacggatcttatctgttacctcacagggaaactgagaaattaagcaaagtaatgcatatgaaagtacgtcacaaactataaagagctgtaacaatgcaagtattttaatgctgtgtgagttttttggtacagaccaagaaagaaagaaaatacatagctatccatttttagaggctctggactggcagtctaagagttgcggttttatggaattcacatcgacatgtaatgatttttcatgtgagcacattgacattgtccagtttcatatagtaaaatgtaattcagaaagacactgagaaccacagttttaaagtactgccttccttctaatgttcttgtcattcaaatgtccttgaaagcatttgaatcagtaattttgaatgactgttatgatagaatgtttaataaaccctattaagcatgaattattttcttcacttctcttacaatactggattagtgttttgaatcatcaacaaccttgatttctatactgaaattccattttgttagcatcatgatgaccgataatgattacaaatgtgtagagtaacaattattttaacgtgtaatagacattggcatttattccatgtgtccggcatgaacatttgtcctacgggcaaggtagtttggagagatatggcaaagaactaagtcaatgatgttgatatagcaatctaataactttactttgatgacctaaaaagatttaggcattgggagaatctggaaaattatgaagcttctaaaatgtgtcctgaagagattcaaaggaaatcacatttttctcctgctctggattgattcatactataatttacctctcataaaactgatcatatgttaatattaagttaatagttgtaagttgatagtaaaattttaaatgtggagtagctgcacaaaatatggaagaaaagaatttgcttttattctgtgaatttaagattagcctgacgtcgttatgctcattttagcagttgcaaagataaaattcattggcatagctggaattacagtgataggagttggctttgaagaaaaatcaactttgccacctattgccttgtctgtattcaaaatagtatacattttagctaagtttgaatgtggacttaaataaaaaccaaaactaaaagataagaaaaagcaactgagcagctttatactgagcagaacagggaacttaaacaggcattggtattttgaaattgatttacatgtagccagctttgtttaccatactccttacccttagaaacccaaaataatttcttattagtcagtgttatgagcaaattaatggtggaaagaatgcagatgttttattattattattatttttgagacggagtctcactttgtcacccaggctggagtactgtggcgcgatctgggctcactgcaacctccacctcctgggttcaagcgattctcctgcctcagcctcccaagcagctgggattacaggcacctgccaccatgcgaggctaatttttgtatttttagtagagacggggtttcaccatgttggccagtctggtctcaaactcctgacctgaggtgatccacctgcttcggcctcccaaagtgctgtgattaaaggcgtgagccaccgagcccagccaaagtattattatgctgacctgaatacatgctcaggttttgatattcttttaaaattctttcatattctgtcagcataatcattttaactaatatccatttcactatgaattcatgtaagtccttcattggttgaaactgagtggggaatggaatatcctgattttaaaattttctgcttaatgatacctattacatttttaattggcttctactggaatggggaaatacaattggattttgcatccagcaatcttactgacctctcttgggttctctgtgaaataattgttttatctgcaagtaacgaaaatttctcctatttgaataaaagtcttatttacttaaattaaataataaattaattaatattttctgcttaactacttaagccagatttgttttgtttaagccaccatgctctgttgaaatttttcttgtaggtattgttttatattatatattagtgttggaattgcttggatgattaagatctcatcagggtaataattctaagtgtcagttttctctatattatagaattatgaatatactatgttactctacagtgtaaaattcagttttcatccacataaattgagctttaattatgttctggaaattttcatacacatttcatcttcactgcaagccactgatatttagaattttattattattattctttttgaggaaatttaatggcagggtagatttttttaaaaaaattgcccaaagcctaacagctagccagaggggatttttgaatttccatgtgttagttcaatgacctggatattttttccacttcacacaatatctagagtgtttaatgtaaggaagaattcttaggattgatctctttgtgaatataaagtgcaacgagactttctgattatgggagttcaggatcttgatttactgagatgtaactctcttgttctacacagatgaagtagataactatttttaaacactgaaaggtgtgtgtgtgtgtttatgtctaaagagagaggaaggtagtattaaatattaatctgctccccaactctaaaaatgtagactctttgatttgtggtcatgaacatattttcttgtttgatttcaaatttcagtctagtgtcccttgccccttaggctgcagatgtcaatttgtggtcatccatgccgatgtgtaaatgagtaagtgttgccccggcaaagagctgaggttataatttagccgtcgctgcccctttgcttttgtgtggattaaaatagctactatgtaaaatcttcattaattttcatattcggagtatatgtagaaatccacaaagttagctaatttaaaatcagattattattacactcatagtaaacccatagagaatggccacttaaaaggctgaagtcccgtcaaacacctttttttaaagggatgacaacataaaaaatgaaccaatgatgcctcaccttctcagatctgttccacatgtggtgttgtggtaatattgtgagcactgaagtattaaaacagttttgtcttgtgttccctcattctgacaggccaatgacataatgtcgacaagccatctctgatagattcaaaattgaaagtgaatacactgcctctttttcctagttcacactaatggtgtttgagtcaacgtgctaatttcactgcttccaacatacagtcctccctagtaagtctgggaatagcttgtgaggggctttttttttcaggctgcaaagaactgtttgatcaaagtcattactttgttattaaaggagaagaatggagaggaatcagcaataaaagcaaagacaagtttaggatctgaactctgaaaagcagtttgccaataaagatattaactctatatgatttaatatttccacaacaatgttaatcagttgattttcataaacatacatggactgggagtattaacaatagtaaaggaagaaatttagtgttctgtgaattgatttttagttctatgccatattatacagtcctataaaggaagataataagctataaaaggaaccagaccttatcacccaggcaaatttttgttggtttgtttgtgttttttctgcagcagtttccaggaaatcaaaagttttgcttctctggctatataattcaagatgattcatcaaattattgcttttacaaaggtgcaaaaactttgaggagttagaaaataattgaggttgattattggagcactttggaagtattttgttcatttatttatttaatcactgaaatagttactagagctttctgtgaatttagcttgttttggtgtgtattaaggtgtggcccttgccttttgactgcttgcacactaatttgaaaaattagacatacacatatgaaactgtttaacaattctagagagtggacaagaaaatgataaacgtaggtaagggtagaggacagcagctttcatatatatatatgtatctatatagatatatagataatctatatgtatctagatatataatctatatagatacatatctatatagatgcatatgtatctagatagatatataatctatctatatagatacacatatctatatacatagatatataatctatctatatagatacatagatacatatatagatacatatatagatacacatatctatgtagatagatatatagattatctatatagatacacttgtatctatatagatagatatgtagataatctatctatatagatatatatgtatctatatagatatatatatgttcacaatggtgtgtaaaacatacgtgtgtaaaacatttgaaaaactgctttcttgcaataaaatcctactggaaatcccagtgcccagtgtctagatgggttaaaggcagatattttctgctcctttcgttctggatacttcaaagttcaaatgattgaaaattatttttgtaggatcagggaggcttgagccgaatgaaagatatgagttagaggaggtgatgaagcctccttcttcagaagatgtcttttgaatggaacaaaatttgaaaaattggaagagaggaaaatggagcatatcagaaggaaatagcacggtgaaagtagacatttcaagccgggaaagagtagcgtttttggactgtgagaagacccatgtgataggagtagagtttatattactgattcatgaggagcctgggttaggagaagccaagctaacaggagccacaaatgccaggcatagatatttcgaagaccatccaggagtcagtagtatgtatatattcaggaacctttgaaaatggacatgacacaatgtgatataacataagttatataaatgtggagttgtaggagtgggttactgtgcaaaatataatcagggtaggaaaaacttgaggggtctgttgtattcttgcattcacttttggtaataggtatactggcttcagaaatagtagtgcagttaccttaattttagtcataaactaagtatacaacttgtttaggcaaccatttttagttccaattaaaagtaacaaataaagtatccattataatttcttacagtttccaaggtcttaccctctcttcctccctcccttcttccctttaccttttctctcttcttactctctatctttattctccctttctttcttttttccccctttctttcctttttcctcttcctttcctctttctgtatctcttcctaccatataatatcctggacttttactcattataaatacttaactctaatatgatatgattatatcctcatattccagtaacatcagaattccaatgggaagaatctaggcaattttaagatatataatttaaataatggcatgtccctacttttgctcattttccaggtagtttttagatacaagctttctttgctatgaaacctggaactataataaaatttaggccagatattcacacttagtggaaaaaccatattaactataatagttgtggtctgtctgcaccacgccaatcacagtcacatgagtgtctgtggatttctgcttctaagggtgctgtttatataaaccaggtgactatagtgaaggaagagatttgcttttgaagcataaatcactacaaatttcaacctgtccaggacttatatcatctgtaggtgtttgttttgttaattactttgcatttcattcagatgtggtgctattgctttagtattctaagattaactctgctgaatttgggggtcaaggtctctatcatttgtttcactgataggcacacaatattctttcttcttaacgacgaaaagattgatcagtgaaagaagacaaacgctgaccaagctacacatcggtatttatgtccgcgtgcctgatcaaaagtgtgatctgagtgaatctaaacttttcagcatgaggaaatatgaaaaaaagtgtcttagatatagaaaaagtttgcttcaccataattataatgctttttcaatacaggtatttaccagttatttagtatataataaagttgttgtatatatataacttaactgaagtataagttgattaacagccaattttagagtgcaatttttagtaattcatatcataaaataaactatatacaattgtcataaaaatatggctatgtttagttcacttctacttctgaagtactattagttgtttcacttatataattaaaggaaaacatgtttgcagagtctagagcctacaaattcaaaactggttattatcatttattcagctcccagcgattgcacacatttgaccctaaatgacaaagtaaatgaaagccctttttcaaagtaatacaatcagttcaaaaaatattgtgctaataaagttatacattctaattgaaagattgatggcaatccatttagttgttactaggttatttgtgacagacagatgcagagtaacctcattacagtcagaattgtgatgacttgtagctgaggagaggaataaagctttaaaccattgtcacagtccctttccaaaacgtattcaaagatgatttaaaagaaaatatatgaccattaaatagaagttcgaattggttacctaggagtgttattatagaagcaatgaagtaatcatctgtttgatccacaattggcctacttaaaattcacaaatcagatttacagattccaatttgtgtaagagaaaaacagtgccaaatactggattaaaaagattatcccttgtggtttggcatttttagttcatatttttagttgttttcttcttgatcatcaaatatatatcggcttattttagacatttctgcccacaatcaccagttcatgataaattattccacagtattcatttgtacgttgtccaatagtttaaagtcaggctttcagcattagtacccaagggaactctatcaacattctgaagttatgtaattgagaaaaagaaggaatatgggtggatatatatatatatattttttttcctttgaaagatggtgaagtctttgtgggatatatttcatgtatatttgattttgaaacttcttttttttttttttttttttttttgagatggagtcgcactctgtctcccaggctggagtgcagtggtgcaatctcggctcactgcaacctccgcctcccgggttcacgccattctccagcctcagcctcccgagtagctgggactgcaggtgcccgccaccacgcccggctaatttttttgtatttttagtagagacggggtttcaccatgttagccaggatggtctccatctcctgacctcatgatccgcccgccttggcctcccaaagtgctgggattacaggtgtgagccaccacgccaggccgaaacttctttttttcttaatgaaaaacaaggtagaaatgttgacctacaggaagctccacctgctcctcatagtcttcctactgcaatatttgcatgtatttctaaaatttcttatgttcaggagcaccttttttgtttcaaatgtgacagtccggtgctatgcttggcacataaaacccgttttattctgatcacttctcatttgtggtttaatcttgcgcacagttgtccttgcctctctcctgtctcagcatttgagctttctgttactcttgtacatactgaactttttcttgtgctcctcactatcaccaccatgtcttttattatagatatctttcaccatgaatccttttattatagattatttttcaccatgaattctaaaattctcttacattgacaaaagtactctttgcaagaagactatttaccaacttgaaagaaggctaattctatttttttaagtgaatttctcaaaagaagattttcattgtgtgggtaagtcagttaaatatctattgggtatttcttatccgctagtaaacttaaaaaaggtgttctttctaaggtagtgtctttccataaagttgacattttatctttcctaatcaggaaaattaaggcctcattcccttgtaggttgtgttatcagttaaggctaaagttttgacttatccaagcaggtgaattaaagaatatgtaataatagagtcttaaccaacagaacaccagtcagttgagaggttgtgtgttgaggtgaaagaccaaggactgaaatgggaatgaaggaccttccattcaatcctagttatagatcatttaccaaagattacttactagctatgtaaggcctcagacaaattatttagtgtctgagtcacagtttttcgcctataatgttaaccagctttgatggttctaaacttataagggtgtggtgatacttatattttataattaaacgtgatttattcatttatgattcattaagatagaaaatgtttcaaaaattatacttacttctcatttatttaagcaggtgattatgggaggacttctagatgccaggtgcatatccaggtgttaaggctatgtcagcgaataagctagaaaaaggcctcctagagcttatattctcagtgcttacctattcagtgcagaagcttgaaacctatatgaatgtaaacacagtagtcctttcctcattgctttctaggggcgctatcctctcattagtcatttaggagacctcttggttatcagatcaaaaaaacatggtatatactgtacagtataagctttggtactatccctggtttcagatatccaagtgggggttttcgaatgtatccctcatggataagaagggactgctgtacacaaaaataaaactactcaacatttcactattaacaatatgtggatgactaattttttgcacgtttttgtgtgtactgtgttttgcaatatttttttcagattgctggtgtagtccatctattttgctttcttgtatgaattacataaatattttcccatattatgtttttcttcaccatgatatttaatggtggacctttcatcccatgttctgtgctaattttcttaattctttgtcattggatatttaggatgtttctagtttttcagggttgcatatgaatatatgaactatgaagaacataccgtgatacaaatccttgtgctcaaccttggttatttcctttgaataaattcatacagtagaattaccagtcagtgagtatacataaaaatttaaacttccatcaaaaaatatctgaaaattcaggcttactcatttcttttccttggatattttcctttgctaatatgataggtgaaaatattattgcataataattttactttttatttctagtgaggctaaaagctgttgcgtgagtattggcttaatctttctctttttgtgaattgcctatttatgtttaagtgttttctccttttggagtgctctttttagaaacttttacaactgtctttttttctactaattatttctttatttttagtaataattattaattattactaattatgtgtctttatttttcaactttattaatgtttacttgtcaagtaaaacttgtatatatttatggtgtacagtgggatgttttgatatatgtacacattgtgcaatgactaaatcaagctattaggtttatgcaaaagtaattgtggttttggaccatgaattttaaatcattataactaggctcaaacacatctttattaatcaaaataggaactattacaatcaacacatttttgccaatgagaaataagtttgtttattcctgtagcataaaaatctgtgattggggatttgacgaactcttggaaagcattttctgcattctgcaggttgtggaagcgtttttccctgcaaaaagttgtcgagatgcttgaagaagtgatagtcggttggcgagaggacaggtgaatatggcagatgaggcaaaactttgtagcccaattcgttcaacttttgaagtgttggttgtgcaacgtgcggtcgggtgttgttgttgagaagaattgggccctttctgttgaccactgtcaggtgcaggcattgcagtttttggtgcatctcatcgatttgctgagcatacttcccagttgtaatggttttgccgggattcagaaagctgttgtagttcagactggcagcagaccaccaaagagtgaccatgaccctttttttggtgcaactttggctttgagaagtgctttggagcttcttctgggtcccaccactgagcttgttgtcactggttgtcacataaaatccacttttcattgcacgtcaccatcagattgagaaatgacttcttgttgcatagaataagagaagacaacgcttcaaaacaacaatttttttttattattgctcagatcttgaggcaaccactgtgcaagctcttttatctttccaatttgcttcaactgttaaacaaccacagaatggttgacattgagttcttcggcaacttttcatgtagttgtaagagggtcagcttccatgatgactctcaaatggtcattgtcaacttccgatggccggccactgcactcctcatcttcaagcctctcgtctcctttgcaaagcttcttgcctcaccactgcactgtacgttcgttagcagttcctgggccaaatgcatggctgttgttgtgaattgtctctgcttctttacgacacattttgaactcgattaagaaagtcacttgaatttgctttttgtctaacttcatttccataatctaaaataaatatagaataaacagcaagtaataagtaattagcaaaaaaaaataaagtgagaaatgtgcattaaaatgatgtataacataaccacatttatttatgaatgcattccaatactaaacggcaaattttaacaatgcaaaagctgcaattatgtttgcaccaacctgatatttagcacaggcatcacctcacatacgtgtcttgtttaatggtgaaaatatttaagatctgagccattttcaagtacatacattattattaactacagtcaccatgctttatggagtttttattgatacgtacttcaatgcttggtatatatgtaacacattatcctctttccatgcacctctgtgtgtgtgcataaaggtttttcattttctatgtagaaaaacttcaaagtaatcgccatgattttctagtgattgctttaaaatggaaacatatatgattttccatcatttatatatgaattattttgatacactgacagtatggttagcattacgttgtgcaaacttctttcgttaactagttatggaagtgaaatttttttatttctgctgttttttcttattagagtattagaatttcttactgctttttcctttgaaatatatatattattggataagtttgggacactgccagccaaaagtgaaaatggcattaatgggactgagatgtacagatccagcatattctctatgtgggtatcatttctacctttctaattctaatggcttggtggaaccttaggcctacactggatctttggttgaaagatgctcccctccacacatacacacaaacctttccctctgagatatgctgaaggcatctgaattttcttccttagtattcatattttagagcaggcaaccaaaaaggctatgtataggcaggttcttttagccttcagtagcttgctgttttgttgtgttctaatggcattagatgtttctagataagtctgttctctccagatttactcatatctagcatgtttttcatacagattacttggctgtatccaggtggcatgtacgtttaagatagctgcattagtggttaaagaatgctaagcaaaaacaaaccaaccaaccaacaaacaaaaatcaatagtaaaaagagattggagatccttaggagatattaaacctgccagtaacataaggggaaatatgtaaccttcaagaatccataaacatgaaaagtaagttgttggtaagctctaaactcaatgagggaaggaactatgtatttctttacattaaaaaaacctataccacatatgaaagtgtctagcatagttatcaatgctccataaaatgtgttgaatgagtacagcatagtctccattctctttttataatttacttgtgagactagagaatttaggaaatattcttttgtttatcagatttgacaatttaatttttaaaataattaaattaattggaagaaaattactacaactttctggtagagtgtttatatacgtttgtgagtagctgtgttgttttaaaagagtaatattctaaaatagtgtcattaaaatagggaaaatacattattaagttataaagtgaattcatttgaaatcagtcatttaaaatatgtttaaactggattaatttgggtgcatgttttcctttagaataggacctaatatattgccatggctcactcttaaaattatgagaattaaaagaagcttattataatctttacccacaaaatgcatatgatttattatagggttgtgatttttatccaacactcttgtattgaatgatgatgtttaataatattgtaatactgtatgtcagaagatttattgtagttttgatttctctgagccaagagacagagtacttggatgtgttttggtggttgttgactgataagcaataaaatgatcctacatagacctcagtggtaaatgtttttccaactctctctgattaatatgggttttttttggtgtaatatgtcaattttatcagatttaaatttatcattaaactagctggtagtttcagcccctggaaaggctattttgtctgagctatcatattttaagcaatattatttataccacaaggaaggtcctgatgaaaaaaagtcattcttgattaccgtttgatcaaccaaaaatgtctctataacattagatgaaataaatgaactgtatagctgtaggatttgaaactttcaactattgcaaatagatgagtagaagtttccattcactaaagagtcactacatctcttttggccactgatttttttttttttaagtacaagagtctttattctctagagtgtgaaaatgtctacaatactgtgaggcactggaaaaatgaagattactaaagatgaaaaataattcatgtaaaccgtgtgtggtaagtttacaatatttttgagtttaattcaacaaatatgttttgaacatcttctacatgttaggcagtgtgctaggttgaaggtttacagaagtgaatacatcttaagagagagatgagtggagaggagatgtttatggttgctccatatgaaatagccaagcatagaagcatgctgtataaatgctccatgtacagttagctacgaataggagcatctaaataacttttaacttcttgcttcttataatcttcaatacgtctctgtgcttatttatttatatagcaaaatgcatcataggacattgtgtggcaattatggtttataagtacaatgtcaaagttttttgggggtcattgggagcaaaaagctgttagagatttgaaaggcaaacacatattatggaataaaaattttccatttttttgtcaggtaatattttgagagggtagcgatgaggccactggggaggaagagaatttaacatatatgtgattttcaaggtagcaaaagactctggaacccacattgtcccatttctatgaattgcatcatgcctttgttaaaatcactgtgctaacaataagatttcactcagggaaatcaaataacaactctattaagaactttgaaaccatcaaaagaaatcttgacattatatttatcaaatatttgaaatctacgtataaaacaaattatgattaggaaaggaattatgtggatgtaaagaactgtgtattttgcaaaaggcaaagaaacagcaatttagtactctgctctattaaaacacattccgtcctgggattcctttagtttttatatttattcctaatgaaaattcaccctgtaattttgcttggtattttaaaataacattactgagaaaattggacatatttagtagtacatagggataatttctaaaatacaactataagtatttacaaaatatagtaatttttagtgtcctaccatatttgtttgttatatatgttgggagagatgtcattttcttatctattttattcagaaggaaataaatctgatgatgctcatatattttcaaaattccaagcaaaattgttcagaaaaagagttggaaacaactgaagtttattctgttttatttcccaaaattgtatcatagaaacataaaaacaatctaaccaacatggagaaatcccgtctctactaaaaatacaaaattagccaggtgcggtggcacatgcctgtaatcccaactactcgagaggctgaggcaggagaatctcttgaacctgggaggcagaggttgcagtgagccgagatcacaccattgcactccagcctgggcaactagagtgaaactttggctcaaaaaaaaaaggaaaagaaacataaaaacaaggctaggtgatctttatgagaaaatgcttaaaagctatttccacagagtctttttggtctttttctccatgataggtaagcttttaaaaaccgaaagaattaaaaaatataccacacatttgactttttatttttgtagtaccgattttggtcaaagcattcttgaaaaatttaaaaacacatttgcgacttttaacctagtaatctattcttctcagagagcataataagaataccttgctttccaggtatctgggattatggtaccacaaacaggaaggagaaactgaaggataaaggttaacttaggattgggttttttcaagaagtttccagtgttggcacagacacaggctctatctatgcccctttcaattataaaccaacagctctgccgtgaggatatcgtgaatgttcacatctttacctgtcaacacttctgaaaccctttcagcacctatgtctcagtctattcttgatcaaagcatgacctgctcactaaagctttcataagataataatttaataagaaactcccagccagaagacaaaggaaaagattgtgaaggaggccactgctaatttccctccctacataatcaaatcagtacagctatccagccaggactcataacccttaataagtcactctactcgattaagagaaattgattttcctctactgtggatcatagtgattatgataaatatggtatctgccgttcactgcgctccccgggcccaccccccgtttgctgccagtgtccatctgtttgcaggacggcaggtaaacgagctagagagatgacgccgtgtcattaactgcagttggtatcagtgctttgacagctgtggaattgagtgtttccgtagatcagcctagaagcccgtataagaggcttgcgcagcaattacacctcctgacaactctaccagcagccttcaacatgcaaaactcctatgctgcgatttttaattgggaatagggaaagaaaacagataggtgggaatgactgcagtttgaactctagttttaggatatgaagagtgatgtatagaggccaaagagccacatgctaccttcactagattctaacttgatcctaaagttatttggagtctgtggtgggtatgtcttattgtgatctctgtaatcaagtctagatttccagagaaatcaatctctttttaatttaattaatttttttttagaaacagggtttctctctgtcacccaggttggagtgcagtgatgtgatctctgctccctgcagtcttgacctcccaggctcaggtgattcttccacttcagcctcctgaagagctgggattacaggcatgtgccaccatatccggctaatttttttttttttgtatttttagtagagaaggggtttcgctatgttgcccaggctgctgttggcctcctggaatccggcaatcttcttgcgttggcctctcagagtgctgggatttacaagcgtgagccaccacacccagccgcaatatcttaatacaccaatgttgactgtagaatgtttctgccctttcttctcactcacctgaagaatcttgaagcagttggttttattttaatcattttccatcactgtacatcattcaatagtgcttgatattttaacatcagtaaacaaacaaacaaacgaacaaaaaacaggaaagtaatatattctgtcagagcagaattattcaattgcttaaagttttcatataaactttccatgtagcatgttgaatgtttgtttctataattaaaaatacctaagattattgactgggtatctgaaagggattttatacagcacagtacatagagtagcaataataaagatatattttttaccagcttttgcctttgtgagtattttgggtttgggacatggttgtacatatttcctgtttatatattctacacataatgtggtattacagaatgacgaattatagaaagatctggaatattattcttaactaaggaggcagtaagataattaaggagacattgaaagtagacttcagagttcttttcataaaataatagatttatttctcttgattaaggtttttatttggcctaagtctgacttaagatttttataaattagcttcatcattaaataccaatgtactattttttatggtatactaaattgttgctccatttgagaatattctaatagtattagggaaagttagtcttgttaattcatatcttttcctatatatgaataagaaagggcataaaatatgctttttttttttttttttttttttttttaagaaatagggttttgctctgtcacacagactggaatgaagtagtgcagcctcaaactgttgggctcaagtaatcctccaacctcagcgtccccagtagctgggattacaagcatgtgccactacacccaattaattttttttttttttttgagactgagtctcactgtcaccaggctggagtgcagtggcatggtcttggctcactgcaacctccatctccctggttcaagtgattctcctgcctcagcctcctgagtagctgggactacaggtgcatgccaccatgcccagctaatttttgtatttttagtagagatagggtttcactgtgttagccaggatggtctcgatctcctgaccttgtgatccgcccgcctcggccttccaaagtgctgggattacaggcctgagccaccgtgcctggccacacccagttaattttttaaattattttttgtagagacagggtgttattatgctacccaggctggtcttaaactcctaacctcaagcagtcctcccactttggcctcccagagtgctgggattgcgggtgtgagcctctgcatccagcctcttttctaattttaaagatgaactggagagtttcactttattctcacgactcttattgcagagtctactctcctttaaagtaactttagtgttgttacttcttagcttttctcaagaaaataaagccatcacagtggaatttgatgattatttttttttgagacagggttttgctcttgttgcccaggctggcgtgcaatggtgtgatctcggctcactgcaacctgcacctcccaggttcaagggattcccctgcctcagcctcctgaatagctgggattacaggcatgcgccaccacgcccagctaattttgtatttctagtagagacggggtgtctccgtgttggtcaggctggtctcgaactctcaacctcaggtcatccgcctgcctcggcctcccaaagtgctgggattacaggcgtgagccagggcccccggccgtatatataacatcttaagcacatttaatttgtctttaatttgcatttaactttttgtcccttgagaaataacaaacaaaatgatgataaaagttgttaaaactctggctgtatccccactgatttcgagggacatcctcctgttatccaggggagtctaattgtacagtctgttgagcccggacaagtctgtgcttgagagaaactccccagacgactgcctgcctgtaagagacagtgaggaaacgcaaggcaggagacacattttcttcaattttatctgcgtaagcctgaaactttatgcattgaaatacagccagatatattcataatcatctcttagagcttggccatcccagtatcttcagttctgtgaccctgacagggaaggtcattggtgcagcccttccaagcaaatgcagttaaatttaacagaattttttttttcaatatgccagacacagtggtaaacgtgtaatataaagattgctctgacactcgtttgaatctgaacgactaccaggaaccttccttcttattatccaaagcctttctcttgcaattcactctttcttagcttttataataagggttgactacttgaaaatatggttcaattgtccttaccagcactataagcaattttagtttctcactagttttcatttgcttttcattttttgcaatgaaacccatcacagtctattgacctactacaattattaagtctattttatttgtgattatagtttgtgaaaatacaattaattactcatattatcaatgagagtacaatgtagcataatttccaccacacgttgttaatttaccaaactacttaaatctgatttacggatttttttctcgatagtagtttagatgccgtggtactttcaagatgatgagagaatcatgaacagagaagttcctttcaagtgaaaaatgcagctgtcgcagaatctctagtgtatccaggttagaatatttaaaactatgtattcatattagagagacatcatgggatatgataagcagaaaagagagacactaattgtgaatagataaaaggattcacatatgtcttaaaactttcaaataaaatatgcagagtgagtttttaaaacgtttttcctgtttatcccttgtttaatgttccgttttagttctaagtcgatcctacaactaataacagatatgaaaagacttggaatgattgtctctgtgttctttgtgccataatttaaagtggccagaagcaagcaagtggaataaacaggacaattgcagagtttatggaggattaggccaattgcaggcttccacacttagggaggagaaaacatcctcatgaatatgagattggaagtgtctagctgtgagaaaaggaaaaaaaaaatgtctgactctggctctgtgttgcaaagcatgagggtctctgtgctagaccatgacttagcaaccgcgctgtttttaaaagtatttgtgttgtaagaatttattatataattatattctattaaaggtagaataggagcaatctggccagttctaatcactgaatctatagtacaatttgagttgagatgaaacaaaaacagcaatagaggaaaatgttaagagtttttaatgttactgagagttaatctgattatgcttaagactgtggagttggagacaaactgcttccaaattccctgattaaaaaaaattgaaaaattttattttatacaagtaattttctgatgttgaaaaccttgtattatacctccaaaatctgaatgttttaacaaaaggaaaaatctccttccatgtactttattccattaatacactccattcatatttgaaaattattaaattttaaattcaatagtggattgtacttggagcagttcatctaaccagccatttacctagggtgtattaatactaagcagccttgcagccacatctaccaatgtattaagagcctactaataaaaatatgatttactgcctaaagtttctttttgcatccttcatcacttgtctgatttggaagtgtggtatataatgcagatatgaaaccagctcaaagttaacagttcatagctgtaaagatcagtgcatgctcacggcagaacaattttcagagtatgttggtattattaccattttgcactttctaataaaacgttttgttcatgtaggctgtatcttctgcactcaggctttaaaaagacctttcatccccactttctctgaagttggacagcagccgcagtagcagctgcctctttagtcactttgcttcccctcattttgataattatgggcaaaggtcaatcattttcccatcaaggcaaatcctgacaaccccacatgtcagagcctaagttatagatgacatgcttgtcaacaccaaaactcagagagtatatctttacctcctcatgaccagctgaaagtcaaaaccctactgcaaaccagaggcaggaggggatgaaagaagggtggctgtttgccctgactttgtcaactgcagacatagttccaggcagatttttgtaattttaaactctataaatgaacaattacattccactttatacacatgaactgtgagcgtcctgattgaatgcaaatgcttctgttaacaacatgacctcgtagtgccttagacggaaagactttagttttattgtggcgattgttcttaaacctagctgagttttttagattaagatgaaatgttttaaagctgggaggggggacaaataatgatcttttaaaataataactagattctgggtgaactaaaagcctggctaggaccattataggaatacagacactcaattcagttcagtaaacactgaagggataaggagacagacattttatttatatcatgaaattggatattaaatttgcactgctcagattatgtcagatattgatttagattcaattacataatacctcccagtatccctagaatcagcattcaaagaaatatgcattagtgagtatggtggtaactgggtgctaaaagcctaggccaagcaaatcacagaactacctgcaatggaaagtttgtgctccaagggtcctagggtatttgaatttctgaccatctatcaacatgttacctacatgtaccttcaatactcccaacactttgtcctcccagaatatgatatgaggttaaaatttagcccagggtcccaatttaatatctactgatggcgtccctttctttatataatcaaacatttttgtaaaattatttgggtaattttattacaaatactttttaggggctttctgtttcaaagaaacctataataactcttctttttcttcttgttagaacaataataaatcctcctatacagtaaatcattacctcctcacttctcacttgtttaaatcaaaatttttatttactgcattctatgagtgtcagatagtgagttacttacaagtatgctgtgataaattggtaataggacattcattgtcaggatgaaagaaaacattactttccaagaaagttatgacccaatgtgataatttaggattacaaagaaagtgtatgaagtatttcctgaaatgaacaatgtaatttgatcttatagcaagtaatatttatcccagattcttgagaattaaagtctgcatagaaatgtaatgcgttgtgagtctatgattctgtgttgtagctgagcagtacttactctttcctttatatgctaagatgggatgtacatataaagccccccccccttgtaataggcttataacagatgtactcttttataaacagccattatccttggacgtatatctgttcaggcagaatgacctactattggtcccactcttgaagaccattgctttgcttgtcttctgctctggtccattgccttgttgcctacattccagttgttcaccttccatgatgcccgtaagaagagagtcaaaggctgacaaatgcacaggtgttttctcacttttcttacatcctaccccctctcagttattcattatggtaatggcactttgtgatgtgcaatttctggatttatgacccattcttgataagcatgaatctggactgcctgtgcatctttgataaggttctagttggatagcagtgacctttctggatgtaattctgggaggaagattaaaaagcagtccagaaagtgacaggtttgggacaataacgtatgaatttggctctgctggcaggcaagagatgtaagccgtgataaattagaggcaaaccaaacaagcttactgaatgatttttcatttctgctacatccttgggtaaaagtctattgtatgaattgcactaatactgccatattcctctagccgtgtgttagactacttgtttactaattgcataaactggcaaattattccgttaatgtagttttacagtaaccaaaggctgcatactcaattaaaaatatgggcaccattttgcgtacttgtgctgtcttatacgttgaacagtcagtgagcatttggaagagagtcatccaaactcataaaaacctctctctctgtttctctctctctctctttccttccaccccctttctcatatttgtatgaaaagctattagaaatttccatatatatacccaaatcctgaggacatcttttccaagtttagagagttaaagatggattataaagagaatccatttatcaaggtaacttgttaatacactgtccttaatattcttctgtatttgataaagtcttaaactcttaatatatgttccatgttgaatatatagcagaaatacacttgtatagataattatgtttattacgtatttaaaggataagaacacgtacactgacgtgcaagcacatataccccttcagagaaagacagacaaagatttgttttcctccaaagtgatacttctgaggagtgctaatatataataacctaatcttaaggacatgactataataaaggctaaaaagcagttttgtcaggtggctttgtaaatctgtcttctttgctattggagcctgttgcttatacacacatggaatacaaaataaattgtccacgtagcaggcaaatcaatacgcggtggtccctaccaggattaatcatgggaggagttccatcaccactcacacatggctgcattcagggtgcacagggcctattacttctgcatctgtctttaaagggagccctctagagcttgctacaaggggaggagaaggcagctacctcttctgagggcctgaggtaggtcagacaccaggctaggcatgtgcacatacagagttctgttccagtctcaatgcaatgcagcgacctgtcgctagtagccctgtttttacaagtgaaaagagaagtgtgtttccctgccccttcctcagcagaaagtctggcactcagcagtcactctgtcaacggaaaacaaaatgaataaggccgggagaaatgaagtaactcacctaagattgtactaattgaaagcccagcaaatccagatttgaataggactctgtgtgtcttaataccagcaagcaaaccaataaacaaaaagcaaactgccagctgcagtaccttatgacagctttgcaatttacctaccagacaccattttcttaaacagcagcttttttttttttttttttttttttttttttagatggagtctggctctgttgcccaggctggagtgcagtggtacaatcttgacaatcttggctcgctgcaacctctgcctcccaggttcaagcaattctcctgcctcagcctcccgagtagctgggactgcaggcatgcaccaccacacccggctaattttttctatttttagtagacattgggtttcaccgtgttggccaggttgttcttgaactcttgatctcaagtgatccatccacctcagcctcccaaagtactgggattacaggtgtcagccactgcgtccggccccacagcttttttgaaatataattcatgtaccatacaactcatccatttaaagtgtcagacatcactttaatatttatattttatacttactataaactcagtatatataaaatcatagtgcctcttcttttagctgtgtttaatacttatggactgaagacctgttcatttttaacctaagtagagaaaatatagagtcgagagtatttttctcgcttgaaatcagtagtgcctatttttgctaaattttttgattcctaattattgctattcttcctgcatttctctgacatccatcatttcttgcccatttttttttcatattttttagtattctggtgccttcatatttttaccatactggtgtgtcaggcattgggactattcttagaagttgttttgctactctattccactctgtaaacttacggaccattgaattgtcctaaaacatttactttctccatgacacgtgctattcttaaaataagttatgtcaggttaaattaaaaagaaaggccttcaatgactgtcagtgtcctgcatgatccgatcttaccttatttagacaacctttccttttgtaattcctatcagaaaatgccttttctgcacagaccagccacttaatgtctcacttacagtaatgtttatttctaactttgtggcttatctgacttgtttaaccagtttactctcccttttatttccctaattaatatgacccaggatgagaattaaatagtatttcctttatcaaggcttactctcccacacattctcctaatacctttacctaccttgcaatcctgctgggcttgcaatttgtcccccatatttaactcttggcagacagcggtcccatatttttttcctcatgagtatttcctatgtggacatctcgactctctaacaattttaaatttcttgagaatctgttccgtgcctgatttctccctcagcagctttctaccctctttgcagtatgttcttcttaaaataatacattttgatttgtctcaactatatataaaacgcacatgcataggcatatgtacatagttttgtttgaaaagaaaaaagatttacaatttatttaaactttgtaaacttcaaataaaatattggatcaactacattaactcacattggaaaggactctactgatgaaaaatatgacaaatatatggcactggggttttaatgtaaagttagtcactaatttttagaaagtaagctgactgggagaaggaggtgtagataagtagattttcatcaattccaagatacatgcttttgtgataaacttaaatataatttagttttctatcaggcctcaaataccagatagttgtgggccttgtgaaataattttttattaatgccttgccaagtggaacatgatgataaaaatggatagtagctacttctctcatcatttttttgtcttattttaatctctctaaaggtaaaaacatatattatgataggaagtagtcagttgccctggcacatttatttttttgtcattttctcttaagtgttagtattatatacaatgaaggtacttagattcaaattgaaatgaataaagttaattggctttatacctggtttacagttcagagtctctatgatagatacctggagagtgactagtatagtttagctgggtgtgcatgggctgaatggataatatgaagattacatttttatgggagtccaacaaaggagttctaagtaaaagtgatctgtgagccttaaaaaagtattaaaattaaataaaatgaatattgattcctgagaaacatgtttgaagtttgaaccttctggctctaacaattatggttaacaaaaaaatgtgtatttatattttcaaggatattattgtgatttcttgtagctaacgttctgaaggaaccgctgtattttaagtcatgtcttttggcttgacttttttatatggcatgaagttctaaatagctttatacaattaacagaggcattatttttaaatgttaactaggctaggttaatattgtttaggcttttacgtgttttaaaatactcccacatactctaaaaattaagcaaactatagaactatgatggatctagtaagggagcacttttcttggtttatcatcattttttttgcctccatcacacatcgactgaatgagataatcgatggaaagacttgaaataagtgtggcataaacacatcagtttatgtgtttctagaaaagatcttttctgtcacagcaaatgccatggtaaaattcttattttttaattaatattccctcatgttaacaatctaacagcatgcttattcatttgttcttcagtccagtgtggcattattgctgtttgttggttgaacattggctgtggtctgagacgcctggtatcttgagtttctgaggtgatgctgtcatgctcttcacctgcctgaggtggtgattagaaagcacagttacagccactgctcaagtcatctgaaaatttccttcctgctaaatgttacagggtagaggccattagttcttctacaagctacaaactcccagcctgctgccatgtcatgaagccagagaaatcaaaaagccacctactgaccctgcctattgtctgggcttgtcgtcttctgtcagtagtgtgccacaatcagcgagatacacatgtacctcctgcctgctcagggtttggccgccccctgctcccagcacctgtttgcttatacatgagctttgcatgtttgaatttaaatagacacaggagggtggagagagggaggaagggcgatgcctctgtcagccgtgggtcattactacagaggagacaaacccagcgagcagggaaactgggaagcctggtaacgtggtagtgggtgatgaaagatgagtattctccatggaaatcatttttttccccttttaaagttgaatggggtgggtgattattaagacaagattaataatcattttgattatcatatctatcaatagatgatttcttcaattacatagagaattataaatcagatgatgaattgtgacctgggtcttttccaaagttacctttccttgatctcttccaatgatgtcattgcaaaaaattgtctaatttatcaaaaaaacaacatgaaattcaggtatgcgtacaggtgtaaaaaggccaagatttggccaggcatggtggctcacgcttgtaatcccagcactttgggaggccgaggagggcagatcactgagatgaggagttcaagaccagcctggccaaaatggtgaagccccatctctactaaaagcataaaaaattagccgggtgtggtggcacgcgcctgcagtcccagctactcagagattgaggcacaagaatcacttgaacccaggaggcggaggttgcggtgagccaaaattacgccactgcactccaacctgggtgacagagcgagactctgtctcaaaaaacaaaaaacaaaacaaaacaagaaaaatggccaagatttagtaaatatgtacactggggactcatatctgggatatatgcaatatgcacctgtttatggtagaaatttttttacctaagaagaaacaatactatcatctttctatttcaacttgtttactaaattataattttcttaggtttagcaaatgctcatttagtaattgtgtcatcctgcatctgggcttctaggctttgaattagaaaatctgagactgcttgctgcctttggtatttattagttccatgaccttcggtgagttctttaatctgcctgaagctcagtatcttcatccacaaaaagggagcactggtgcccacttgagggggccctaaagggtggaaatttaatgacatgataattgtgagtgctcttttcaaactgtaatgtgttatataaacatcagatattgttactattaagactgatgtcatataagattaaccatggtctccaaaagatacaatactcatagtttcattactaaataaacttttaaagtaaaaccaaaatactttcaaaaataaattgtattaattattaccaccataatactgaaagttttatggaaatatttcctctctaaagcacaccgttgtatgttagaatgttttcctggtgtactcttttactatgtgtaatttaaaaagtaattctagactatcaagatagaattttattataatattactgcttaatatgacactttcttctaattttattgtgccaagaatttgtgcaaaagttacacaggcagatagttaccttcttttttcctttgggttttcaatacgtactctaacaaaggaaagatgaaagaaatcagggagaagatctggcatttagaaacacacactccctcccacacacacatccactccgaaaagttataaaggatctgttgaatttgggggataccttgaagaacttcaagctgtcaccatttcactaccccatgcggtttgagcaaatgagcagccttgaactttgcacacagagacgcgaggcctgggcagaaggcagtgcatctgcaggtccttgcatgactaatttcctgtcagcaagtgattttattatcatttaaataagaatggataataatagctgtaaacttggcagatggctgaattggtaaattttaaaggaggtaggtttgaaatacttctgtgcttcctccttcaatgccttcacccactccttaagccccgtggcaatcaactattttggttaccacttttgatttaaccactgtgttcattcctatcgattaaaggggctttaatagcacaatattgtgatggctgtttaagcagaggacatactgtgtttcattgcttcttatttacactgggcaagggggaagcccagttattggtaggtacttccctcttctaatcatttctgcatgaaactttttttctttctctcttcactcaacgcttaagaggaaaggaaaactacttgaacttcttagttcgtatttctcatataaagttaaaacaatgtataaaaagaactattgtgtattcagttctcatgttcccattccttaatcaacacaggcttatcaatacagcaataaatgaggacagtctgaagcacaggagagatcactaatattgcagccaattttctttcctaaaaagtacaggcgcaaaaataattcatatcagatgaggtcttacaaatattaaacaccattatgtcaagcaaataccgctaaatatgaaacaaaatattgactctattacataatatagttatggttaacaaaataaatctaatagggaattttaaactaccaatttagcttaattaaaaggtacaatttcctcaatcctgattaaataacagtaaaagcatagattgaatccactccctctgagatttttaaaagaatgtttgagaaagcttgatgttggagttataattacacaacagtaatctgcttattcctttgacttaaggtattaagatcgctactaaccaaagttcattaattgaaagcttggagacaaagtaaatttttttttttttttttttttgagacagtctcgcactgtcacccaggctggagtgcggtggcatgatctcagctcactgcaacctctgccccctgggttcaagcgattctcctgcctagcctcctgagtagctgggacaacaggtgcacgccaccacgcctggctaattttttgtattttttagtagagacggggtttcaccatgttggccaggctggtcttaaactcctgacctcgtgatttgcttgcctcgggctcctaaagtgctgggattacaggcatgagccactgcacccggcccaaagtaaattttaatggtatctcgcaaacatatgtgtgaagatagtagtatttaatgtatactagccatgttagcttggggaattagtatttatgcatgcccttactaagctttcttagcaggtgtcttcatgcttagaaaagtcaacttgcaacccgtgtgtaagacaaaacatttgtcacgagttcagtacttgtcaagtgggatgtacattctcagaggtcaatagtggcttataggagatttagatgtgtctgttggcattaatcagctacacacatcactctcatccaactcacagcttgaacttccttacctaccaatatctgtgttggctgcctgaaaagcaaactgttgagcaacagatttaagaatagatgattgacttggttccattcaatcttgtcccagatgtgatctctattaaatattttggtgattaggccttattcctattttgctttttttttttctgcttttgtgattccattgtccattagtgttgtggttctcatttcctttctctctaaattctgcatatttatttgttaatgtactgtatttagtgtactgtttaggcgggattacaaataacttgtgaaataacaggaaaattgatgaaaaaagaaagagcaaaagacaatgcttcctcaggaaaatgtcacattggatgattattttatttgttcctgattttttccttttctgcagatacatgattatataattgtttcagttatatgaaacaaaaattagatgtggaggaaaactctaaatagggaactctaatgttcttttaaaatgaagaatttaacgaaaacactcaaaactcccctgctgggctcaagcaggttgaaattaattcaagacggcagataaaatttttaaccaggccgagtggagatgacggatgtgacagctctcagttaaaatgtcttttagtggcgaatgcatgcatattagtcaagggatgtgacatagctgtcccgggtgagagaaaatgaaccaatgaccatttgcattgagaacaaaagaaaaattctttatagcaaaacgtaaagaaagacaagtaacttgaggtttcatatttatttgttcgtgtttgacaatatttttggtaatctttttactgcaagaaaacctctgaaagttagcacaaacatatgtttttaagcagtgattcttttctttctcctccatatatcagaaaataaatgttgagtaaaatgtctgtgcccaggaaagtcaggtaaactatttttttttcccttgcaaagaacaacagaaaagtatctgtagatggtcatacttcaaaagttgtagaaaaaaagccttaccaactgaaaactcagtttcaaatttgcctacatgaataaaatattggaatgagaagcctttttttttttattataagaacactggctccctacttttcttctttctaataataagacaatttggttgtgtattataaagcaaagcaaataaaacaaaaatggatgtgattctatgacagaatgttatagggaaggaaaattatttggaaactacaattggcaggatttgaccatgtgaaagtcaagtttaattaactttaggaacagatgctttcaagacatagcagttaccagttagagctacaagtataattgagttttatagtatagggtttatttttccaattaaaatcaaattgcattatcataattttgttattagaagatgtaacactctggcttaaaaggggtactcaaatgtagacctagatcttgtcctcttttgatcaaaagaaaagaatggacaaagatgtattttagtctcaacattaaatacaatttccactttagaaggtagttgttacttcctttaataatgtatcctccccaaaatggtatatgagaacataaaaatttattacaacattagagccaaaaatagaatacaaatatttgtatacaaatattcagtgatgctaactggattcagaaaatgctaccgaattaaaattataatttatctgggtcttcagtgataaataggaatcccttacttaagggagatgaagtttatttaaggcgaggtaaatggagaagtaagtttttctcctgtatttttggccttttcttgtctctcttttctggaattatcaagctttctctcattcagatgaatgctttgtgaatcttctctttttgaatctgcagtgtaattctatgtggacagacagctttctgttaacatacactattttgacagactacaacttgatttgctgttcaggctttgactatattcacattatggcttaagtattttctttcatagtcatttaccaagtgcccaacacatttttaaatcagagaaaaatacattttatttactttccatgccgagctcagcaagaaatggtattttctcctatgtcttgcattaaaaattgcatttgcaaatggcatatttagatgatgttgaagaaattaagcaatatcagttgtaccttttcatagtgtaaacatgtaaaatttctttaaataggaaaatactattggttttcttggaatcgctcccatttaaattctatcctttagatttttttcagtccaatgcctttgcaaatttctagtacacactttctactactgtaactttagtacatcctcagttttactacattacttgaaaacatgcatttttaacaatctcctgctcttttgcttttgattttctgggcatattcctgttactcaatgtattcattcagcagagtacatttatgctacaactatggactacctgttcacagctgtagattattcagaatcttcttgatactgataatatcttcttatttacagtttgctggtatactgagaaaatgcagtagaataacggaagtacaatgtaagccatataaatcatttaaaatttactaggttccatagtaaagaggaaaacaaaacagctaaaattaatttaatactatatttagcctaatatcccaaattttatatcaataggcaatcagtaaaacatattaatgaaatatgttcattcttttttattatactgaatctttgaaacccagtgcatacttaatacttgcagcacatttaattctaactagccagattttggtgatcaacagccaccgctgactgtggccaccatactggatagtgccactctaagaccttgatactcaaagtgccccatgaacagagagcatccacatcacctgtgagtatgttcgttgtatcaaatctcaggccttatgccaggcctactggatccaaatcttcctttcaacaagatcccgaagttactggatgcacattaaagaaagaaaatcactgcatttctggtttcccaaatgtatagaacattggtgttaatattactgcctatgacatagattcttttccaaacagctttattgagataaaattcatattccttataactcacccttttaacatgcaaagctcaatttttttagtgtattcacaattgtgcaactatttcagttatctaacttgataatatttttcttaccccagaagaaacacttctacccatgagcaatcactcagcacttccttctttgcccagtgactgacaaccactgatctactctatctatggaattgccaattctggacattttatataaatggaattatttaaggtgtggtctttcagtctgtctcgtttcacttagtataagtacattgatctgtagtctttatttcttttgatgcctttgtctagttttattaaaggagtttaaaaatgcttcttcttccagtttttggaagagtttgtgaagaatttgtgttaaatctcctttaaacgtttggtagacttttccagtggtgctgcctgggccagagattttcttgcaggacgttgttttggttatgaattcaatatcgttactggttatatgtctattcagatttttttattttttcttgtttcatatttgatggattgtatctttcttagaatatgttccatgaatgaaatatggtcattaagtgaattgaaaaaggcaaacacttttcctttaccattttcccatgtattttgcagtcaagatcattctttgtaattaccattgtgacagtactacaaccaaaatgagcctttagaagtgtgtaatttctgaaattaaatttatctttatgaattttcgaccaatgctgaatagagaaagatattttattttgccacagttgacttcctagttcctgatcacatgcaataatgagaggaagccagactggaaaaagatgtctccttactaaaataatggaagaagtagcccccattccttccttcgaaataacaacaacaattctaccaacacgcaaaaggtcagagccacattttcatggtataaatgacatctaggttaaatccttatattctgtcttggatgaaacttgatatgattcaatccaaccctccatctaataatgattctttgacatttctattttataatcgggttatagccctttaattttcttgaatgtttactataacaagacaatcacctctcataaaccaatctactctattattagataagtctaaaatttaggagaatctttcttattttaagtagaaaactgtctcctttctatacacatttagttctggctctgccaatatgagcaggatggaacaagcttacttcatctgctacttcacagcccttcagatatcagaaaaagcagtttcttcttaatagactgctaacagaattataatgggatcaaactgaaaaaaaaacttgtgagaacataatctacactaataataatcccctaatgcacttccacttgaaaaaatacacatagtttaatgtatcttctatcaatttctaaacatgggtttttctttcttagtacgaaactgttaaaaagcaatcaataataaataggtacagaggaaaaaaacaggcagtgaggtatgtttagctaaatatgtcctcaaagtgttgattttaaaatggcttgtttttagacgctggtgaggctgtgaagaaaagggaacatttatacatccttggtggggatgtaaattagttcaccactatggaaagtagtttggtggttttggaggtttttcaaatagcttaaaacagaatgaccattcaaaccaacaatcccatttctgggtatatatccaaaagaaaacaaatcgtccaaccaaaaggcgcatgcactggcaagttcatcacaacagtattcacaatagcaaagacatggaatcaaccaaggtgaccatcggcggtggactgtataaagaaaatgtggtgcatgtatgccatgaaatcctatgagccataaataaagaaaatcatatcttctgcagcaacatggatgcagctagaggcttatcttaagtggatcatggcaggaacagaaaaccaaatactccatgttctggtttataagtgagagctaaacactgggtactcaggtacataaagatggcgacaactgaaactggggacttatagatgggggagagaaagagtcagggaagggttgaaaagctacctattgggtactagactcagtacctgagtgatgggattatttgtactccaaacctaagcattacacagtgtactcagttaacaaacctgcacgtatactccctgaaactaaaagttcaaaaataaatattcatttttaaatttgggaaaataaataaataaataaataaataaataaaatggattgtttttgaggcaatgaaattactggacgtatggtcagtgctcagtaaactttagatgactgtggtatataggaaggcaggataatggtcctcaatgatgtctgagtcctaatccctgaatatatctgtgcatatatcagattcatagcaagggggaattaaattagcagatggaattaaagttgctcatcatctgactttaacatagggagattatcttgaatcatccaagtgggctcagtgaaatcagagagtccctaaaattgaaagagtggagggggataagggatcagagtcatctgatatgagaaggacttcacttgctctagctggtttcaaagatagaagaaagtgcctgccaaccaggaaataaaagtaacctttagaacctggaaaaggcgagggaacagatagtcccacagaacctccagaaaccccgtaaacaacatgatcttagcccagtaagactcatgcagacttctacaggtttctatgataaatgtgttgtttaagctggtaaattgtagcaatttgttacaacagcaacagaaaacgaatacacatgatagttatttaacagaaaactaacacagctactctgttctggattcaggtctaattactaaaacagttcttttgaaagtcaccagttatctccatgttattaaactctgcacattttcagtcttcgtttgacccctcaaaagcacttcatgtcgttaactattccccctttcctctttaaagtacttgttatctttgccttccatggtctttcacttccttgctttctttttaccttcttgacctctttcgtggtcccttttacagctcagtccacctcagttaaacattttagagccttctcctcttcttgctcaggagctctcatctgtggtcattgcttttattgccactctttctagagagcatgcaaattttcatcttcctctgggcctctcttctgagttgtacccacataacccattgcctacctgaattgttttttctttgtcttaaaatttcttcatctcaacatcatccaaaccgaacttataactttcctgtccactgggcaccattctccttctcctttcaaatccaaggcaccttcagtattgctataaattttgtgtctttctgtactggttgagaagggttgagattgggtagaaaatgcatggcaaatgttgtcaggtttgattttactttagatcgtgttaaacaatgtaagattgtttatttatgcatatgaatcattttgtatttttcataattaaattgatgtcaatcccaattttattgaatcccaagtatcagctggctcagcagtcactaagaactgttgtgaatgtgctattgtacctatgacactggaaaaccattatgagttaaaccaattgtcatacatattagttatttgaaattcagtgggaggaacattttcctgtgtattgcaagttgctgtgagaaatgatcagttttctttcaaggatttcagttgtgtatgtgaaataaattcttaacatttttaagctcctgtaatattgcaggcattttactttagtaaaatagtaaataaaatatacttcatttaattttaacaaatttctgctggtgattagtactttttaatatatttattagaatattaattagaatatataaaaatatttattagaatatataaaaatattcattagaatattcattagaatgtataaaaaatagaattaagctagttaattattaaaaaggcaagaatttgaatagagttcttctgtttctaatgcttatattatttttatctatatcggttgttcccaaagtttggtccccacaacagcaacatcaatatcactcgggaacttggtagaaatacaaattcttggacaaccaccccaaatgtacttaatcagaaactctgggatggagcccagtaattggtattgaccaaacaggtgatgtcaatgatgagtctgcacattaaataggccctacagatgagtttgatacacactaaatgtagaaaaccatattgttataccactgattatatgtctatagaggtgatgcgcccctatctttcttattattctcctttgactcactgatttttgctgctaaagcagaaccaggaaataattcaatgttttattccaacttactaagagatcccatacttaacaatgagtattcctaagtatattaaggttagcatataattgaaaggttaaaatatctaaaattcaattgaatgttttcactgtaaactatattcagcttcattgtcttctgctgaaagtcttattttacttcattatggcagcttaatgattctccaattcccatgttgaatttccaaggaaagaaacttataaaaagtttatgctcggggaattcttttgctttctgtgtgggagtggagcagttctttacacatcttccttacctccattgaaaaagacaaggtaactgaaggctgttggagtccatggggtgaggacttgttagcaattagtaatatgtgaagaaactgtctgttccctattttttggtatgctgaccataaattgatttgagtattcttgctttactttattgtaggttgaagggagctattgcttatgaggaaattcattgtgttctaaagccaattctaaatcagagtttgagacactgtttctatattagagattatctatattttattctggagggcaaaaattgccacttagatattacatgtcagtgcatatatatttctaaatttctcaggggagttgtgggagataaacaataatagtacacagtgaaagtccttgaatacggccctgattgtcccttcttttagcctagatgttcatatttcagttgtttgatttaatgaatagaaagggaaacataataattacaactcaaaattctcatatgaaatgaatctaatctcattcaagttgtctagtccctaaacacagtcagtaaaaggatactttagagctgttctcttgcaggctgagccgaggagtgaaaatggttaactgaaaactttgaaggatatttaagttgaccatgtgcagtgcatgtattggacaccagccaggacccagtaaaccccctgtgccaacattgggtagaactcattgataaccaaaagcagttagtagaacctgtctcagtgagtacgttggtcaatacaggcttcatgggaatggcccctgttattaatgtttgaagactatgacttgcccttacatggctgtgatttagagaactacccactgaagtcactgatgtagttcagtgtgtgaaaaacagacggcaaaccatatgaggtaagttaatacatgtaactggggatactgcaggaaggagacagttgaattctttggagaaaaagtggtttacaaattgaatacattaaaaatgaatattattactggtttactcatcacataaagaatagggccaggggataaatacctctctagctcttgcaactcaagagatgtttttcatatcttagataataaatacttgcagtaggtttagctcataactaaaagtatgtgctaagagactcccctagaagagtttgtcttccgacatgctgaattgccctggggttggtggcagcttaataaaatatgtgagtgttcagtgcggagctgttaagttatttattccacttctgatactgcatgcatgaactgccactgtttgatgaatcactgaagagaatgggaactgacaaacaactcttcctttagcggctgatcacactgacagcatcaatagaaaaacacatcatgggttctaaaatgccacattttcaccgtttaccctgaataagacatgaagctctttaaggaaagcagtagtacgttatcattaagggccagctgacagagaggcaagtgtgctttgaactctctcaagtcatcattcttaatttcttctcttcttagatggaaggcccacccacatgggttctgagcaaggcagggactgttgcaccttttaaaatctcattgatagattggtttcatcaacacccatcctgactcctgcccatcgggagaagctcctattctcattagggtcctgtaatgtctgcagctaacattgttctcatgcaaatagaatgacacagaagatcagtgccatgaaaattcaatttcccccaaccatcattaccctttttcttttagttattcccactccaatctgcaggaggtaatgtgtgcaatctgctggtactgtgcaagatgattactacattttagtgatgaatttcccagctattgcactagggggtgttttagcaggttccctgatacacctaatgtagatgtggcagtagtccttgcagtccttacccagctcttccatagtggatttccacaaggagtggatgcctggtcagtagaacttgtattcaatactgttcattctttagtcatcagtggcacttgtgaaagtagtgatttgtttaatgttgtctgaaaaataaaaataaaatatatctctacctgtccaaattgaaggattaaaagctctgtcaaaagaaatgtagtaatttttgtctttagtctatgatcaaacttgggtaatttaataaggatgtaaaattcagggtagctcatataaacatattgaaattataaaagtgtgtaagttaaataaaaatcctgttttagaaagaactatggagaagtcctacttgtgtgcagctgaaaagtaaggtaattaccaaagtatatttcaaattcctatacttaatattatcctttatctttgaagtttcttcagcaatgggattaaatatgtaaacattatattgtcagtggtttattacgttttagaagttctttgtttcttctgaaattatccccttgcctcttcattagtctggaagttagctgtaagaaaaaataaagggagagagaatgaagaaaaaatatatagattcaccaggcattacagatttgtatgtatgcccctgttcaccacaaacacaaaacatgattatagtttctctggcgattattagcctaataataattgtaaagggcaactatacaaaacacgattttcaatgtaatttttataaaacttatttatttcacaaataaatagatataatctttcccagtgaataaaatactttacatatggtagcattttacgtacaaaggtgactaaaagaattcagagttttaaacatttatttgaaagaaagaatgataattattttataaagtttttttggaaaatacttttttcttacacatggtgatgatgtatttgtagataaattgtatttatgcaattccattcacatgattttgagatattttcattggattgattactggctgaattagacatttttaaattactgaaatgtaccctcttaataatatatccttataattatgtcagagaggctgatataatgaaaaaaggagtcaagttatttctttacctgaattattctgttctataaactgatatatgtaatacatttcagtaactgtggcgaaaccatttagactgtctatgggacacaccatgcagtttagatgtgagcagttgcctacatgtggtacagaaagtcatatttgaactacagttttagtaccgctactttaagatagattctgagcatgtaattactgcagtcttggcatgtaattaccccggagttacagtttatattgacctccagaaataatgagactgtaattttaaagtaaaacatagaacttgagtgtaaaattgtatgttgattttgaactgcttgcattgtgagtttgttctcctgaagaataacttattactatgataattatcccagtttcctatggattcagaatatgtagagtgttattaaagcatcctttatgactgagtggttaactggttccacagataggtaaaagaaggagtactccagtggtttgaaagaagctgctgattacaaaagctccctccctgtaagcttcatggcctgcacttctcagaaagatagactcaatggagcatgactgcctagggcatctgggtcccaggaggttttagttgtttgtttaggtgttgagaaaaacacattatgaccgtaataataattatgtgtttggaattggatttttgcatctgtaacacaaagttccatcttgcataaaatgcaacctcagcaccattttatgcttaatttgcatatgaagcaatatgggactattcaaatataggcttcatttgactacgtaccaccagtgttaatttagtatagtattaaatgtctctgatgaccactcttcaagcaatgtttggactctttattaaggacaaatgtgtgtacacactcttagatgatattaaaactaaggttaaaagattttaaattattttcagtagtgtgtcacttttaaatacttttgcataacctgaagagagtaaagtagttgaacattatttagatagtgatttcatagcaattggttttttattttctgaaatatagcccagagatattttattttttgcttattataagaaatcacatttcaaaatacacaattcagtttgaaaatcagtaagttagctttatttattcccaggtgttttctgaaaatacgttttttttttcttagcctttcttaaggcaagaagcagtcattcaatttcccttattcttttctctctccttcatctttctcctttcttacccctttttctgttgtcatggttttttactaaagcatgtagttcttcttctgtacagaaacattccatgtaatcctcaaattaataacttcatccaaattatctacaaagtcatggtttgacagtaatgtacccacaatatttctctagtgcaaattcagccgtaccagtaatgtgttaaaaagtcatctttttctaaagaagctatagatataattcatctcttcttgaattcaatttgtaaaaatttgagagttaacttatcatattttaacttggaacatttgcaaaccttcttatgtcatagcttctcagtattaaaaaaaaaatagggcatatggcagaaaaccatactctgtaaaacacgacagctcaggagaaaaaaataaaacagcttaagaacaaatattatgtccatacactaataacaacatggtgtatatttgtactgtattttttattttcaccatttaatttgaaattattggatggtttaaatatataattctgaatggtggatagatattaaaataatatttagcttcataagtattgaccttacacatttagatgtcctccagacaaagaatgaacatgaaggtatcgtgctaggaaaagaattaccgttgtcttctgtgtttcattaaaatagctttcaggcagataaacaactgtttccgtacgtaagatccaagaaataccattttatggatgccaagttcagcgtcttagtgagttctggaaacttacataatggaaacagtacacacctgcctctgtgtcactctctccctgattaaaagtgatatggctaaggacatgaagaaccatctccctcttttatgaatcaaataacgtatgctttataaatgttatgtatttattctttcctctaataaggctacacatgggtttaaagcattgaggcctgcgttagggagatcagcactagaggtcagagacattcagaatcctgcagtttagcatttagcaatgttactttcttttttcttttcttttttttcttttgagatggagtcttgctctgtctcccaggctggagtttagtggcacaattttggcttactgcaaccttggcctcctgggttcaagcaattgtcctgactcagcctcccaagtagctgggatcacaagcatgcgccaccatgcccagctaatttttttttttgtatttttagtaaagacagggtttcaccacgttggccaggctggtctcgaactcctgacctcaggtgatccgcctgcctcttcctcccagagtgctgggattacaggtgtgagccaccgtacctggccaagggtattacttttgagttttcaataaaggcagtgttacagattttgcttcatttgaattctatgcaatgtttttgtagttcctgatatcaaagatgtctatcagcttttaaaatgtatatagttaaaggattcctcttgccatctaaacatgcatcaagaataaagaatctatacatagattttacaaaagttattttatgttacataaatcattcagaaatttctattcattcatgtaaggcagaggcatagctgattctgatggtagtcctgctaatcattcaactgctaacttacagagagtccaataacccaatgtcatatgttgtgttgttgtgttgtaaaccattcatttcacaatgctgtgtatttttaaactctttaatcacagaggtcaactataattgctggcatcaatttagagtcctcctgctcttttctttcataatgttccattgtcgcatgctacagtatttataataatttgaaattataactgtatgttcatgtgtttgatgtctgttttctcaacctgactgacaattctatttgttttgttcaccaacttacacctaatatttggacatggtctgggacacatactaagagctcaagaaaagtgcactgaatactcatggtttataatctttgaactgaatatcttactgttactttttttaaaaaaaaatctatatttcaaacttatttctagcatagtcaaaaatggtttctctcaaaggatggatgtatagctaggcagacatacatacagataaaattgatatattcatatacacatagagttctgttcttaagttgtaattatgtttgaatcaactacatatttcatcaacttcccactgcatagaaacagtctgattagaggatccattctaatacagaaacatacatagatgtgtagagatgctacatgaatgttgatactctggttgtgatattgtgctataggtttgcaagatgtaaccattggtggaaactaggtaaagggtgcaatttatctttgtattgtttcttgtagctgggtacgaatctacaattatctcaaaataaaaaataaaaaagtggtatgtggcatttgtgtaaaaattgaaccagacgtagaaaatgaggtgtaaaacaactctttttattattactttagcattagtgacattccatatttatcatttgcacatttaaatagtagggccaggctggtataaagcctttttaccgtccgggagggaggtggggggtcagccccccgcccggccagccgccccgtccgggagggaggtgggggggtcagccccccgcctggccagcagtgctgtccgggagggaggtgggggggtcagccccccgcccggccagccgtgctgtccgggagggaggtgggggggtcagacccccgcccggccagccgccccgtccgggaggtgaggggcgcctctgcccggctgcccctactgggaagtgaggagcccctctgcccggccagccgccccgtccgggagggaggtgggggggtcagccccccgcctggccagccgtgctgtccgggagggaggtgggggtgtcagccctccgcccggccagccaccccgtccgggagggaagtgggggggtcagacccccgcccggccagccgccccgtccgggaggtgaggggcgcctctgcccggctgcccctactgggaagtgaggagcccctcagcccggccagccaccccgtccgggagggaggtgggggggtcagccccccgcccggccagccgccccgtccgggagggaggtgggggcggtcagccccccaacccggccagccgccccgtccgggaggtgaggggcgcctctgcccggcggcccttactgggaggtgaggagcccctctgcccggccaccaccccgtctgggaggtgtgcccaacggctcattgagaacgggccaggatgacaatggcggttttgtggaatggaaaggggggaaaggcggggaaaagattgagaaatcggatggttgccgtgtctgtgtggaaagaagtagacatgggagacttttcattttgttctgcactaagaaaaattcttctgccttgggatcctgttgatctgtgaccttacccccaaccctgtgctctctgaaacatgtgctgtgtccactcagggttaaatggattaagggtggtgcaagatgtgctttgttaaacagatgcttgaaagcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaatcagtgataatttgttgatatattcattagttgtccacattccctaactcctatatttttgtaaacttttaattgaagtataacatatatacagaaaagtaacaagaaggcttaagtatccagcttgatgaatttttgcaaactgaacacatctgtatcaccagcacctggattgtgaaatagaccatgaaaagcaccacagaagccctctcatgccgtatctcaatctttaccaagagaacctatcttctgactccatagagctgtcttcttttatccccaacttttctatttttaaaaatttcagtatatagaaatttcaaagagtaaagagtagcaagcattacccatcacctagatgcaatatttgttactattttgctgaagtctatctctctctgtatgtacaacacgtaccatttgagtgtgttatttgcagatggtgatactttacccataagtactccagcatgtatctccagccggatcaacatggcaaaacccactctctactaagaatacaaaaattagccagatgtggtggcatgtgcccgtagtcccagctgcttgcgtggctgaggcataagaatagctcgaacccaggaggcggaggttgtagtaagccaagatcctgccactgcactccagcttgggcaacagggagaaactctgtctcaaaatttaaaaaaaagaaaaaaaagaaaaaagaaagaaacattcttctacataatcacaatattttcacactcaggaaatttaatattgatataatcttattatttataaaaattccataaccagatatccccaattgattcaattgcatctatcataatgtttttgacacaagatttaattcgggattatgcattgcctttggcccaatatctgtttttccttttctcttgttctatctcttagtttgaaaactttttccagccttttaaaaaatatttaatgacacagaagtgttttttttgtttgtttgtttgttttaggcggagtctcactctgtcgcccaggctggggtgcggtggcgccatcttggctcactgcaggctccacctcccgggttcccgccattctcctgcctcagcctcccgagtagctgggactacaggcgccgccaccactcccggctaatttttttttgtatttttagtagagatggtgtttcaccggttagccaggatggtctcgatctcctgacctcgtgatccgcctgcatcggcctcccaaagtgctgggattacaggcgtgagcccccgcgcccggccgacacagaggtttttaagcagtccaggccaattgtttcatagatagatgcctcatacatatttatgtctcatagaaaaagttacaaatgtcaactcattgctatttatgatgtttctttattctttcttgcacttacatggttcagcatctggcccgtaggaggtaccaaatggtgataagttcattatactatcagtttaaaatcttgtctaccagctctgtgacaaactgtacaaatttgagtaagcctgttagcccctttagacctaaatatctcatctttgagtaaattgactggattatcttccattgataaaattgtgttatttatttaaacattgtatttggccatgttaccatatttgaagttagtattactaccatggaatggaaaattatataaatatttcatcatctagtattctgaatagagtatcaactaattgtacaatcttatgaatggttaccaaagaatttcagaacattctgtgtagaaaatatagtataaaaagtctttgcaattgctctaatttagacttccaagttgttaaaacatcttttgaagacctaggtggcctcactgctaggtatactctctttattcactttatctgttgcatcctttatagcctacttgggaactttttttccttgagctcccagcataagagaggctactggggtggcagttaaacccatatgtataattttgccctgtatttcatttcataaatatataagtctttttctgtattcttcaagacactgaattttctgcatgatatttaggccttaacaagttatggtagtttagaaaaagatatttaaaaaacattgtatcttgttgtgtacattagtactgttacaaaggttaatacatatttttttaatatgctgaattagcccttgggtcttctcacttaacaattttgacaaggttttatggaagttaccctgacacttccattagttattggacaactggaccttcttttctaattgtcttccaaaaaaggggacatgatgtttctctgccgcattaactttgttgtttcctgtaaaacttagcaggcaaaaatctgagcttgtaaatgagagacttgtcttcgtcttgatcagagacatgaaatttgcaatttaaatgagaaaaaataatgaacttaatgcataccttgaaagaagtgttgtaatgtgccaatttggttctcataaagttgattctacacatccctatgaaggtattgattgtgtccatgtagtaaagctgagggtgccgtgaactcctcagtgacttggcatttcatcgttacagacaatcagccttccaagcacttggcttaacatacctccagcccctaaatacatgacgaagtcagtggcagaatggctgtgcaagtagtctggctcttaaccttaatgctagccttggtcttatgaaatcttgttattaagaaaacctcatggctatatacagttaaaaatgaatgtcactgtgaaatctctacttttaaggagttatctggcctccattggtagtatttgcctactcatatttgtcaagttattctttgaaaactagcaggaagaataggaaataagaagtctgatttgaaatcttggtcttccttttcttatttcctttaccccagagacccagaaaatggagctagctacatttctcacacttactgtcatagttacatgtttatattctattagttgtaattatttttcacctatcctctcattagaatgttatacctatagagcagataccattccagttttaattttttgccccgactcctagtaagtacgtgacctattacagggaacttaaaacaaacaaaaagtctgctgagtctgggatgttttaaggatcgaaggaacatgttggtccaatttgccttcacagagggttacctctgctttctaccgaatgtgaattgctcccatgtgattttgaagaattccagtctacctcagggaaggaccacatgtaatgccagagtctgcaaacttggcagcttttaccctctctcatctgtgggattgttttgtcctgggtttagatagctaagtgtctgtaaaaagattctttttgtcattaaggagcaacaggaaatggagagcagcagtgactccatttccagtgtctaaagaagaagacttaagcacaaagtaaggactttccctctccacttgtttaatataatgctctgattgcatccacacgtatgcaaatggaaacattcagattccagctcctaaggacatgtgaataaatgaaatatgtgtccgtgttcttatttgctgagtgaatttatgaacaagtcaataggctgttacagataaagtgattatttaacattgtgttaaaaacttcacttggaaacttggattatttcttaatatttataattggctatcttagccaattatcttagatacctatgattaaaatagccctgtttgaatttttgtcttcaaatttgtcaagttttagtaagcatgtgtcattatctaccagaccacctctaaattaaaataaaaagagataatcagaatactgacttgccaagttgtttgtgaatcacacttaccaggtaccagatttgtagttaaactcctcccagaatttttccattagtgttatagaaatttcacatgctaaatacaatgcaagtatatactgttaaaattttcagaatatcgtttctgaaaattactttgctccctgcaaatccaccctactcacctgtatcatttgagtgaaaacttttctgtgtaactgtgactgagcagttaaaccagaaacctgctttaggtaaggactgccttgatgtttgcaatttttcccacttttttcttttcctttctttttttattttttcattttaaagataaaggtcactctaagaaggtagttcctgagttaaaagtgttccatagggttggggattacaatagaaacagacaccgttccccaccaagggggcaggagttgagcatgagcctccccactgtggtcgtcctggggtctctggggggtgggatggcatctgacagtgatgggcttttcttgatggcttcctttctttgtacctaactctggtccataaatagagcatcacatcatgctcccagactgacaccggggaagcttcataaatcagcaagtgagtgttccggcatgatcctttggccactgccttccctccagagctgacacctgtcaccttttaaagagtgtacattctctgtcactgtagctgattcctgtcttttctttattcattctcatatgctgcctaggtggtattatctgggtggctgcccatatattatttaaatcattaccagtatggcctaggtaggtttttaattatgcctaaaaacttgatagttccagatagttattgggtatacaactaagaatataatacaaaatgcattttatttttaaaagaacatacatatgtgtttaacagatctaattatatatatatttataatcaacaatagaatattgcatttaggtggcttataaataataccttaaagcacttaaaatgataagaattcttaagaatctgtaagaatctgagagttaaggaaagtgctttgaatatccttagactgttaccttttccaataagtcagtaagcattggtgatttgttaatattataaaatacgtatcttctctgtggcacacgtcactttattggagaaacatatgtgactcaactcaactgttatctggtcctattttgccctaattatggtttctatttaaatggcattatagaatcgcttagcttttaaagaggggcagtggaaaagatctgtaaaacttcagcaagtctataatctacatgagcagaaatttacctctcttaaatgtctacatattaatgacattaaaaataaaataatcgacccatgttggggatttctgtgctttccccaaatgaatgtttaaaattttattttgaattctattaaagtgaataatgaccacaaggtgtttgtaattggggagatagtaagtgcaaaatacaagcagagggtgcttaaaaagaacaaaaaaagtctgtttcttattgattggcctgtggtgggataaatgtgtggcttctgcctttaatggaagctgattgttcagggatgtgccggtgagactggtcgattcttgagctgttgtttactgggaaggacaatatgaattttctagagggatgattggtgggatgtcaaggctgtcacccttttctcctcgtcactgacagacagcccggtgacaattaccagtgatgggacattgcctgcactggcatatacactagaggatataactggcaaacaacaagagaggaaagcactcctggaaaaaagatataatcagcagttgtcaggactggttacatatctgatgtctgcataacagggccaaggcacattagctttaccactggggtaacatgcagcctgcttcgtcctgcttagaaaactgatcttagaaattttgggaagtttagaggataacaagaattgttggcattctttctacttgacagttaatataagaaaaaaagtattttacttattttttctaattaaaataaactttgggaaattcaaatggactggaaagtagatatttgtattctttacagaaatagttatatttgtggtatgtttcctcatgagttaacttttatgacttttcttgccaggcttctgttattggcaaaagtccaaatggacactaataagttgtgttgtacaggtatcagaatgagagactcaattccataattttgccagagaagcatcatttaaatggtggagtatgttctatgctaggtaggtagtacacagacatatccaccagattttctataaagattcttctgtcagtctcatgctgtctatttccttccgttccattgcttcggaatttcaaataagtttaaagaaaaagatcagcatttccaaagcctaccttaatgtgtagagaaactaatacctaaattagaccacctggaataaaagagccgtcaagtagctgtatttatttctcagcaagagactattctttgtgttaatttacaaatgtaacttatttaattaatcatgtttaggctaatcacctcttagagtcaatgtattctgctggaagtttactgtttggaaaaattcacaataagtatagttttatacagtcaaatttacatatttttgttctgtaggaattagtcatctctttccacccagggttttcttaacatcaaaatgaaaatgtctccgcatgctcaggtaagaagatttttgtcagtttcccaccaaaatatggactgggaacaccttgtaagcttctactcaaatgcctaatgaggattacttttttcataattggtcactgtagagatgaaaataattggctacctaatgttggttatctcctatctgtgtggcatccatgacttacatcagatgtatttctttttttgtgagaattattttcttaaatgtcttttctgatttttttttaaaaatgtgttaattacagaatttggcaaacattataaagtgcaaataacggtatgaaaatcatgcattattctaccattcagaggagtgcattgttaacattttagtattttttccatttggcttttgtttgaagattttaactgtttacatttgtgtatgttctgttgagtgttttcagtgatgccatttttcatcttgaatcaatatatagacaagtagtgtgattttggtagtgtccttttattttaaataagtaggttttaatactgctgagtgattacatatggaggttatttctggttgggcttataagattccatataaaagttataattaatttccttccttaaaccaagggctaattgattttccattgcactcattaaaaatagatacttagcttttcagaagattgtctcagaaacccaaggcagggcccaggccctctgggatgccatcaactgaccattccatcagtcctagaattgtgaccctcctacttgtcagaactgaagtatttatcccatttcccagcagataaacatttgcaaggcaaataataaattagccattaatcagaagaatgtttgcattcgatgaactctgaatggagtggagatgtcaggtagatagacaaggtaaatcaacatggcagaatcaatcacaaggaagagccagccataatttagaaagcattgacccaaatatttaacgactttggaaggtaagaacattttgtaaaggaagaaagctatttagaaaaaggtgtgggtagattttaataatagatagcaattaagttttaaacatttaaggcttcagcctaatgatagacatttggaagtttgatttgaaaaaagagacactgtcaaatatttatttttaaaggcccgtgtgttcaaataattttttctttcccaggagtgctctcatgaaatgtacccacattataattttttttcaaaaaaacaatttagcaagtatattgttttaaaagcaagaagtgaccttgttatgttggtgttctttgattcctaattgtgtttgccccttcatgtgtatgatgcaaagactttcagattgagagtctgaaagtcccatgtgttgagctttgcttggccacttaataatcatgtggtcctggggaagtaacttaaccttttatgacccgcaatttcctcatttgtaaaataggtcttggcaccattcatttttttacgtagaagacatatgtgtgttgtataaatttattctaaggcattattcatattttaaaattcttaaaaaaatcagttattgttacatatcttgttctcatgtctaatcagttagtgcatatcttgtttctgaaaatgttatacctaaagggattaaaaggctcagtggttataaaaaacaatattatttctcctaattctcatgaggttagaaactacaacctttgttttcttagaactgaccatcagggaaattgcttttgactccaaacacctaccatctggcatatcctatcttctcattataatatgtgatgcctaaatttgtgagacatcctggactctccacatgtgtgtttttcatttcttgaccccaacgtagaagaaaggatggaagtaaatggaataaacataattctcaccgttgctttcctagttcttcatttctcacctactcactttcttcccatgagtacaattctatcccccagttaggttgtgcagatgaggtatcttttcaagtaatgacacctttaaaccaaaacattaactgagtcctgggtgtccccctccccatagctttgcttgactaagaaaattcttctaatccgaaattttaaatgaaaacatgtaatgttgattaacattgcctgaagcacagagtacgattaaaatgttttgagattttagaatatataaatcactcatgcaaaaaaaaaagagttttctttatacaatctagaaacaattatattagcccgtattaataggcttcaaatgaaaaacattgaagccaatacatttcaactgggtgttcatgctacttgctgtggggttttttaaaaatttatttctagttaataccccttatccccatgccatctttgtctttctgtcttagcaggtaactttaacctaaatttcctgaagaaataggaagttattgtatgtgaattatttattgcttacctcaaaatttctccaaatcttcatttatcatttcctatttctgttctgatactcatgtctgtgactaacaaacctatctgcttatgtttatgattttcatttactccagtcgaaacctgtcaaatagctactttttcagtctcattctttattaattcttccttacaatataagcatacccagttctcctccatcttaaacacaggagagtatagataaaaagaaaaattctataagatttcatggagaaaaggaattatgtttagctttggatttcaaaaaggcttcataaaagaaatggcatttaaaaatatcctgaaacactaatattataaagcctgttttaacataaatactacttactgtcaccatacggtttttgtttttaaagttgctcacttctaatacctgaggctacaataaggcacataatcttcctaacagtttcaatttataactcatatttttcatgacaaccctgtcaggtaagttgtattactattctcattctgccgatgtggaaactgagtcaaagaaagattaaacaacctacctgaaactatatatttagtagtaattgttagaaccagagtttgtacctggttggctccaggttctgtgcctggccactattcttattgcttctccacatagtacttgcatatatgattaaccatgaagctgttggctttagaagtcttgcaaatccattttcagaattagtttgggtttttgggttttttcggggttttatagagcatcaatagggaaatagcatgaaataggaacagaaatgtagattggaatgataatgtagaggtccttaaattctagactgaagaattctgacttaatttaattggcacacgatgaggaatcgctcaaaattttgaacatgaagtgatattgttggatctacgtgttagcaacagtggacagttggaggcaggaagtgtgtgaaatggataatcatttagaagctattgcaaccgtgtgggtgagaaaccaggaagcctaaatcaggaaggtgactggaaaggagatacatttgtgagaatggtttaggtagcatttacaggattggccaagctgggatagtcatagatcaaggcaagcagggagagaggtgactccaagattttaaatcataacttagaagataaggagctgctatctgaacactgatcaaatcagcctgaatatttattaataatttgggaaatatctgccttggtacatgttgactttgatatattaatggaaatttcagataacgttttggaaacgtcattctgtaagtagggagaaaaatcagagacagaagtataattttggaagtatctagccaaaggaagttgaaaccatttgagtagatggaataatgaaagaatgaagtatggaagctgaggtggagaaagcctgaaaaattagtctgtggtaggacctccattaaatcagcaaatagcaggaacagaaagaatgagctgggtaagaagagctccaaaagattgagggagaactagaataaggaagaatcataaacaataaaaggaaagggaattctaagaagcaagagagggtcaaaattcatttacttcagagctaattgagaaaaaaaaggtgtttaattcatccaaaatctctaaagaaaaccttctgttggccattattacagataacctttaacaatgataaatgtacagtaactacttacatatgaatgagtcagtgaaaatactcggacggatttttccctttcggtgcattcagggtctgtgtggaagaattaatgctttcagaatatttgtttgtaaacacaccatctctaaagaaaattttagggtttctattgattttttgatcaggtgttcacatatgtttaaaattataatggaagtcaatagataaacgtgacttggtgtacaatatttacctatacatggcattctagaagcatatatcattagaaagatcacaacatagtttgttccattttatgaattgattcttatttatctctgctgccaaaaacttgtggatctcactagagccacacatgcttaaacttaaaaaacaaaaatattttagattagtgaaatccaaaatttacattttacattttttaggaataaactgcattatattaaaactgtatcactggtttgcttgctagatcagaataaattttgatccagaagtctgtgacctcttgtttggatcaagggttgtttcttatataaaacttacaagttcaatactgagactgaacaaagccaggaaacaaaaatataaatttgatatggtctgtttgtagaaaagacaataaaaatgttgagtacttatttacaaagcatgtcttcaaatttttctttaaagaatctgtaggtaatctgtattgtggattcattaagtttttgacttaaaaaaatggaaaaaacacaaaagtaggaaaaagagatttctaaaaggttattgttaccactggttacttgtaaacctacagttcactttgcactaaaactttggatatgtctcattgattagaattttataatataaaaatgcagccaaaatattttgagttttgcattttaacaaaatttcaagtccaaaacctctgaagatgttttttctcattgaactaggcaagtcggaaacatactcttaatcctgtcaatggttctgagagcctctctgctttaaatatatgataatactttgtttcatgtcatcttattattggtagtacagtcatccctcagcatctgtgagagattgcttccaggacctccaggggatatcaacatccatggaggctcaagtctcttctttaaaaaaagactttaaaagtactgtttgcatacaatcttgtgcatcctccttcatactttaaattatttctaaatcacttataatatctaatgtaatataaatgctatgtaactggttgttatactatatttttttatttgtattacctttaattgttgtatggctattcttaaattttttgccaaatatttttatctgagcttgattgaatccacagatgggggccattggatatggagagccaactgtggtttacagtctagttttctatttttctagttaaatatataagtagaaaattaaatttttaatcaataggcaaaagagagcaaggccatatactttacaaagaccatgaatgatttgtgaagtagatctctttcccccttcatgttttccaataagtcaacacaaatctctcttccatttataattatgtacgtatatgtgctaaataaatattatgcttcccattcatacttctgcaactccttcattattttctatttccttcattcagctaatatttttctgaatatttatgtgtctagaagtgtttaggttcaaagagagagcagtagacaataaagacaaagccctgtctctactgaacttcctggggaaagagctcgattgaaggcaaatctataaacaacataaaatttaagattaagtagacagtaaagacaacatcacagaagataaggggtagaacatgctgttgaggtatgggcgcgctacaaggtaggatagatgaagacaatggagaagagcaatgtgttgcatactatttccatgccatataatccagatttatcttacccctccattgatcgttttgccctgtagatctgaagtttccaatgcacaaagatacagtggcagaatacctcaaatctctctcaaatctctgccatttagaactttttgttgatgcctagatggttggctttgtttcttaaagggaaaaagtactctttcagtgtgtttgctctcaactcatgctcaacagcaatgatctcaaatctccaacacttgctcatcaaaaaatatatgctcgcgaatagatttcagtgcttcagattaatgaaaaaatacccatccttactaaacaggtgagaatgcaagctcaagagagccagcaaagagaacattttaaaaaatgttaggcactaataacactttgaataagtgtcattttttgaaataaattttataccccccacagtgtgtatataattatatattgccatgtacatattttaaaaaataatttacataggacatatttgactcagattgcacttaaatattctcttaaatatactcctgaagacattcttatttttagtgctttacagaaatattttgaaaataggaaggctactattagtaagagcaaattgaatttgagtttgatttgttaagaaatacttacgctgttctctctagtcttagtgtggtttcagcattagtcttactcgaggcagttgaatactgatatgattgcagataacttggcaatctgctaatggttccaggaggttcattttgatgtatttagtgaatcttaggtaggtaggtatgtactaacatatcatagtatgtggtacttactatatatattcctcttatttacagctagctacaaaatattgcttagaaacactgaaaatgaaaggctatttttttttaaaaatctgtcttttcctaataaaaattcaagagctttaatatttagtaactgcctttaggtttagtttgtcagtgcccttcacgcgcttaataataggcttcaaaactcctggtcacttgctaataactcttcacttctcgggagattgaattgctataggccagttttcctaataagcctgcaaaaaaaaaaaagttaaattgaagactcatgtacgtatttccttttcagctattttttatacattgccatgcaaatatatttcattttttcatatagctcatgaatgtgcatgaatacatacatatgcacttaacaagaattttgttttgaaaaaaaatactgtggtatatgagaaaaattgtaatattttaaatgaagatattagtaccagagaaatagctaatcaaatgtaagaggcaagaaaaaaaaggccacacattaaacttgtgcatcatcaagatttaaaaaattaataacattaaaaacagttggttaacattcttttcttttgctatctatgtcccgtttcttttaaaccttgaatgtaacatataacatttaatctcctataaaattgtaattattttccaccaaaacacaaatgagtaaacataaacaaaacagaaacaaagattggcctttatggaggaattacatgtgactacaagaagagattttaaacaactgctagggtgcggttaaactgtctcttacaagttgcggttctggatgtactctgttaaggagatagtttcatgaacaggagcccgtttgtaattagataaggaaaactgacagcagcagttgagttagtggctcccatggaatgacaggtattgactgaaccctgggctgtgtttgagatggggagggagtcgataaaagcatcagggcttgtttggagtaacactgccagcaatgctttaatttgccgcctggaaaagagccacagacattcttcccccatgtttagtgttgatgagatctaacacttacatttaatcttctgtttaccactaaaaacacttgtaagtggtatatggcaccacaaagaggaaatagaacagggaagcacattttgtataaattctatgttgcagcccaagtctagaaaaaaacacctcatttgaatcattgaatcaagtgtggaaggaaaagtttaacaacaacaaaaaatcagtttagaacaaatgttttaactgattttgaagaagagatagggagtagaaaatgtttctaaactaccttttgaattctctctctctctctctctctctctctctatatatatatatatgtatttttttttttttttttttgagacagagtctcactgtgtcgccctggctagagtgcagtgggatgatctcggctcactgcaaccttcacctcctgggttcaagcgattctcctgcctcagtctcccaagtagctgggactacacaaattctttatctatttttctatataccatattggtttaatgaaaaaaagactgtaaatggaaaagctgtgatgttcatagacacattagggatgtattattatctctacataatttaaagattcaattttgtactctgtttaaaagcaaatgtattcttattaaatacttcccagatatttttgaaatgtcttacataaaaacatatgtatatataaattctatgataaaatattaatgtatagttttatatgtggtatacactttgacccataatatctacccataaaaatccacaaaagcacccagattttaatactgaccattagagaactcaagcaaaatgatttttgaaaaagagttacttctggaccagatccaacctagctgcatttaacttgctgccaaactcaacagacaccattataaaatttgcacctacttattattacaaattcaagtaatcccctaactgtgaccttcagtgcctaattaaataagggcagcatttaaaaatactagatgacttcaatcttacttagttgccagtgcttaatgcttcccacctgttgtaacacagaaaatgcccaaggtagactgcaatgcctttggttttgccaggaaatttcaaaagcttagggttttgtagtgaatccacactaaactcctgttaggctcaattagatgatgtactgagattatctgacttgttgtggagataattactgtaccagggatgagaggccacccatgcttccaggggaagctcattgaggaggctctttccctatttccatatatattccaaagctgtgtgtgtctgtggaaaatgaattcaccagtgactgagaatacggctctgaatttattaaaataggacttgctgtgctgaaagaattttatttcggtatataattttaagcatggaaaattaaagaaaatcaagagataagtataatagctagtactgtctcacacacgcctaggatcccttagatgtgtaaaatgtatccccccttctaaagtttctgcagaaattaaagagcagaggaattaggatttaaccaaataaaatgtttcgcttgaaaatgcattaatgaatactgtaactaaaagaaaatgatgctcaatattcttgcttttagtgtttttcagaatgtatcaataatgttggatcgcattattttagtatatgtaaattttcaaatatttaattatagtgaaaatattttaaaatgcgaagtctcatatcaattacgtaacatatttttgcaccaagtccaataaacttgattcagtcagccattacataagtagggacaactgttaacatctctcttactggtacaatgattgattgtagttaggataaccctgagtacttcacgtttcacaaaatcagtatgattttagctatatctatcctactgttatgaaagtttttagtcaccttctgatattttgtagatggttatttctttgtatacagttgtttcatgcatagagcttcattttatttctttgcaaagaaatatttaatttatatttgtcagcttttgtaaccatgattaacaagactaattgagattaaagtactgcctatcaaaaaatttccaacagttgggactgaatatttgggcaattcatatgaatttatatttatggtggtggaaaaagccaaataattcagaatttacttgttcattcaacaactaatgtttgagaaccatacttggggttaagctgggacaacaaaagtatacacaagttcctttcttaaaggatcgcttgtctaggaggagagaaagacatgtaaataaatgattgtagagtacagtgtgatcagcacagtaatagaggcatgtgcaagcttgaacagttattctgaaggagggagcaattaattctgtctgagatgggacaggggaaggattgaattcgagcccgttcttttgaataatacatgaaagagcactagtccatcctcctaaattgagtagtttagccaaagagagctgccaacctatcgatcaactgatgagaagacagaacttagacctagcaggcctaaatgaatagtgagctgacacaagcaggtatcagtgccatttgtagctttatccctgaaactgcaatgagttggtgctctcaacaatctctccatagagactctgtgttcccacagctgaagaaactttatacaaaggtgttaagtaaagactgtggagagatgcaggtaactaggtggataaatggtattatatgagacctcctgaatgcaaaaacttttcataaaatacaagtcaccaaatctctttgaatgaaaattttatttaagcatttctgtatgtttggtaaggtattctccctatcttagggaatagaaggaataaacaaaatgaaacaaacaaacaaaaaacctttacttgattttgttctctgcctcaggtcattataatctacccggtcaggctccagactgtctctgtaatttcatactctgtaattcactgatgctggctcctgttttatcactaagccattaagctttctcaaaaataaaacaaaaaacaaaaaattgtatttgttctagcctccaaagctgaaacgttctttcctttatcttctcccccataagctttaaaaatttcaggaaatctagaattccacattctccaatgttgctgtagggattaccttctcaactggacatatgcctgggtggtctataatacttatgggctgagttatttcctcacaaacttcgaatgttaaaattctaaaccctagtgtctcagaatgtaactggatttggagacagggtctttagagaagtaattaagttaaaatgaggtcatcagggtgggccctagactaatgcaacgggtgccctcataagcagaagaaattagaacacaaacacacacagtggaaagaccatgtaaggtcataggaataagatggccatcaagggcagaggccttagaaagaaccaaccctgctgaccccttgatcttgaacttctaggatccagaattgtgaaacaatatatttcttttgtgtcggccacccagaatgtggtattgtgttatggcatccccagccaactactacaatagagatgacaggtattgtttgtgtatttcatcagttcattagcattgatgttttgttccaactggagtttcttaatcacctcttgtgaacatcatacagattactgttcccagagtaagcaccaatacattgctgttgaattgattaactttcttttcatgttttcaaatgatatgccacaattcacaagttgatttgcactgtgctgcttatcacattagcacacagcgtcaatttttctgctgtctttaaccaccatatatttcacattaggttgcatatgagcttagtatcttttcccttctgatcctggacatcattagataccatgaaacaactgaacctccaggataaaaatatttatagctctgctcattgaatgaagaggagcatgtttataagatggttttaatgaatgaaggctctggaggttttcttactgctggacaacataacctgaatctccagagctggttttcactaattacaaagtgtatgcgttttctccttataaatcttgcatcagctttatttttaaattctgagatttgtgaaatactgggtcttttaaatcaaaaatgcaaaactagaaatacagtcattcatttaccaaaaaattttgaagcagctatgcgtgaagcactgtgggagatagaaagatgaattagaagtggactttgccattaataactttacattatgataaagggaatattatatgcaaaaaaggaattatgagtgagtggaaaaatatatgatccagaagtgatgcagacagaatgtgaagaggtcaaaggatcacttctgtttatgggaaccaaataatgacttctggaaagttggtgattgattttagcatgcctaaaacagaggatggggtttgggtttgcacatcagggagatagaagagagaaaatttcaggatggtgggacaatgtgagcaaaaggtaagaaaatatatgtattttcaatccttatctggatttaaagaaaacattgaaataagtttgcttaacattagttaatccttcagtgttagctttaagaaattataggaagtaaaaatacatctactgtttctgagtatgggtttcacatgaaaatgtgctgcgtcttttatgtatacaatgaattatgaagaaaagctttggataatatttcaggacctataattggacaagtaagactgagatgatataatgcttatttttgcatcctcagattctagcatcatagatggcatgtagtagcttacagaacttcttgatgaattcgttgtaatttcagcttgaaatagctaagtagccatagaaatagagtataatgcatggagcagatatctgaaaacagatttggcaaaatttgacaagtctctgggttcagcgctgccataaacagaattgtcaaatatgattttaaggcttgaagctgggatgagaggtagaatgatagttccatcaaaaatgaggacaggagtcagtttattgaaagataatgacttcatttggtgatctgctgttggaaatataggatagtggataggcatcttagattcagatatagataaagtggagaattatctctttggaatggttgttacagacagattactgaaggggaaagtatagagagtcaaaggtgatgctgaagagcaggtttttagtgaatgagtatttttgaaggagagaagaaacggaagcatagaaggaaagaaggcagtagtcagacaaatagaaggtacatcaaaacgtcagtaacaaaaccacaatgtaataccacgttagtcctgcaagaatggccataatcaaaaaatcaaaaagtaatagatgttggtgtggatgcagtgaacagggaacattgctggtgggaatgtaaactagtacacccattatggaaaacagtgtggagagtccttaaagaactaaaagtagaaccaccatttgatccggtgatctcactactgggtgtctacccagaggaaaagaagtgattatatgaaaaagataactgcatgcacatgtgtatagcagcacacttcacaattacagaaaggtgcaacctacccaaatgcccatcaatcaacgagtgaataaataaactgtgatacacacatatatatatatgtatatatatgatggaatactagtcagccataaaaaggaatgaattaatagcatttgcagcaacctggatgagattggagattattgttctaagtgaagtagctcaggagcggaaaaccagacatcgtatgttctcactcacaagtggttgctaagctatgaggatgcaaaggcataagaatgacacaatggactttgggaatttagggggaaaggatggaaaggggatgaaggataaaagactacaaattgggtgcagtgtgtactgctcgggtgatgggtgcacccaaatctcaccatcaccgtgaaataacttgctcatgtaaccgaacaccatctcttcccaaataacctatggaaataagtttttttttttaagtcagtgtcataggaataggaggttagaagtagacaaaaatgtttaatgtcatggggagattaaaatgaagttagtggggaaagacctttggttttgaagaccagaagctttactggtgatcttgtaaagagcaaattctatagattaataactttagattctaactggtaacagagttaagaaataaatgagagattattaataaagtaggaggtgatggtttacaggatcagcaagatgagaagaaaggccctttggaatcaagggagagcatgcaggcaaggctgaggaattgaagtaataatagaaagctagtcagtgaagcagtactttagtcaaatgcaaaagagattatacggagcacagagggcagtctaggacttttacaaaactaaggatgttgatttttcccccatattgagagaattgcttttaatagtcatctctttaagtgtgttaacaatccttgaaggctgatattaataatttcattttagacatcaaaactgagatttttttttgagagtaagcaatgtgattccaaagatataacctggctttaaaacctgcagcctttctactattaccatcttgttttttaatgtttgtcctgactgattagctaattttaaaaatgctttaacttcctttgattaggcaatattatttatagattgaactggcttgctgaattgttacatgttacgtaatgtaatatgaaccatgtcaatgtcagctgattataactcacacttgcggtattcaagaggcaggaagtgaaagctataagttttctgtaatcattgtcacaaatgtaatcgcagctattgtttcttctgtaagattctcattgaagtaaatgaaaatgaagacaaatgaaaacgaagacatcaataagactgatccttcattgtaaaaagctaaaacaggaaagcagtatcaggattaaataagacatctatattaaaatatttcttctatgaagtggataggttagaagaatatgaaattattattagatcctcttaagctaacttatctatctagattaacttgaaactggccattcagcaaagtgcaaactattaataacacattcaggttaaaatgaaatatacctaagatttgtttttgccattcttaggcatccaaaagttctgattggtatcccaaaggcccaacatcccaattgtaccaaaactttgaatacagttcaaaataagtacacttaaaattagcaaagtctatgtcaaaacagtaaaatatccttatatttatgatgattgctttttatctctatagttgtttttggtctcgtttttacaggcaggtgaatataatgacttgttgcacttataaaatacttcagtcccactgcagaatctgtggatcatccttacagtcgctgcctcatgagcaatgctacatattagtattttttgaaaagactttaggcaatctcttcaattttatttattttggcacttggaatctctcttcatattaaattgtagaaaaagcagctctgtaattattttcagtccccaaaagttcagtcttttcaagaataaaaaagtgtattatgtttaaaatgaatgtatagaagtataattagtatatttgtattttctttcatcatagaccattgaaataagtagcagaaaatgactttgcttttttactttaaaactcagtaagggatgaaagttggtaggtaataaaacatattaaatgtaatcaagaatactgactgtctaaatgtacgctataaataaaattatttccaacctctctattaccataaactattagaatagtattttcaaagaaggtgaatgagtaagaccataatttttgtaacattaaacataagaagtcctagatctattatgtcttgcttatgtatcaattatctttgatattatgtggattcttcttctgaattatcagtgttactaaaaaaaagaaagagacagaaagatttgaaatgaagtaggcttatttacttatatattatttgctctgaagggtaaaagccaactaaatggacttacaaacatacggaaaaattaatgtataggatatttttccaaccaaaggattaaataatatgaaagagaaacactaatattagtcaaacagagctacctttaccctagagagttattaaagtctagatgtgttttatatgcaaaatggcctgtcaggattatggaaaaaaattctgacacctgcttctcatcagtgccccagaaacaaaggtgaagaaatgggtttctgagcatgggactgcattgcttcctgggtttgtcttaaaaatacatgtgtttttatgtggcattttcatacttatgtatgagtctttcattcgtttaaggcagaaaaagtgccagtaaaagtaaatgtctagtgctaaaacaaaatacacccttttcaggataaaactggcaacaagcattttattatgttgtaagagaacatttttactgttttctcatatactgttacatctctctacattctgtgttcaccaaaaatttaaaaatcactagtcctgaaattatgaaaatcggccactagaatatttgactaatatatttttagaattatagtcttacatagagccaaatagcagactagaataaaagggattattttaatatattttcaaacaatgcttggtaggaaatgataacatttctagttcaagatcaaatatttgaaacttgaagccagattacttttgtaatcttgtgtgtgtgtgtgtgtgtgagagagagagagagagagagagagaaagagagagacttggctttctgattcaaaatacagaactttttcttatataaaatacgtgtttaagtagacatactgtgtcagacactattaaaaaatgactgagattattccagctgaattagaacccttctcacagattatcacagtgatttggcccccgatgaaatttctgagaattttatacttgtgatgtaacaaattttgtaaatgattattgtactactttgttttggtttgaaattttaaactcttacaactaggtatgatagggttaacatgtggaacatcttgaagattatatggaaactgaagaagttacaggtttgctgagacaagaacactgaagataagatttgtaacactccctcttagaaatgaccatggaaagatgataaatgatatttacctcatatgtcatgataactgttttttaaagaagatatctgtgccctctgttatcaggggtatgggaacatgcatcacttacaaacactcaatcaccgtgacataaagaaatagcaaaccttgaacatgtcagaacagtgcctgttcaatctacttctgtttcttgaacaccgagtttattctcaatattgtatccccaaaacaagtggtctttagaatatgatgtttactttctggtgagacttttgtgaaacatgtaagcgggtatatgagtatacacagtatgtaacaatttaataaaaatatattttagaggcaaaaactatttcgatagaacagcaatgtatctgtagttgtatctttacttaaactgttaatatttattgaatgctttctatatgccagatgctttgctaagagctcatattaaacacaggctggtactgtttttactcccattttacagatacaaaaactgaggcataaagagattaaggagttcaaggtttcccagatgtagttctaccttaagtataatttaccacattatttgaattttctgatactaaattcaattggcttaggttactggtgttagcactcttgtccgtgatctttataaagtatacacttttcatctccatgaaaaagaggaagtagtttgggttgatttaacattgactttgaaatgacgtatttgttcttctgtagtaatatagtatttttctgggggaaaatttgacccttgtttctaaagaatgcatgaaatttctgcaaagatcctatctatattaaacatgggttgtattccaaacatttatgaaagactagtgtacaagtaaaattggatagttatctcaaagttactagaaaattctagctgtgctcagaaaaagtcttgttttgtaggtatttgcaactttttcagagttgcattatctgtgtgtaaaatataaacaagaattctgacctctattcttaactgttgcaccagatgtttctcaaaataaacgatattgtctgagtgctctataaacagattccaacctgaatgcctccttttagcgtccctcccaatttaacacataaatatgaactctattttcttttcagacaaaacctgtatagtgtaactttttttacgagaaaacagtgaaatgtagcattataatctgtgaaaaacaagcaggatcttggcaggcagagtctagcaaggaagtcttgtgttttggctgaacatactctggacttttatcttggctaaagctttttttaaaagaacatgccttaaaataatttgtttctgctgctctatgctagattttgaagagttttatttagtgcctggactcctggtctatgaggaatgtgaagtctgtatacaaaaccattatactgatgacactttaaggaacttctaagatggtagtaaatttgtgttctttatataaattatagaatgatgtacaagaatggttaggtaacctttttaaaaggtgaatagtcctgctggcaagaaacataaatatgaacctcagaaaaaaatgcatcacagaagtccatttttaaataggtgctcctggaaatatttcaaatgttgtaagcaaaaaatcaaaacacagaacttcaggaagataaaaacgaattaacaaccttgctttttgactatagactcccattaaatgctaaataaacacattatacatgtgtgggatatttatctaagttcttatggtcagttaatagtaatagaatacactgtaatactagctacatgtattaatgacttactgggtgacagacattttgcttcgagtatattatttcatttaatcctgaaataaccctaatcggtattgtaagtttaccatgaaaacagattaatgtgagcaccttaattttttgacctgttgtgccactggttagtccagtagagagccataaattgagcagagagccttaattgctcagggactcggtgataggcctaaatagtcatgagggatttcactagatcattcaactctttaaaattgtggcctaagacagataggaactgtgatctctagggataagaggctaatacattaaacttgtataccatcttgcttttggcatttaccatttcgcccttgtattccattttatctaataaaattcaaggcacttggagttttttaaacgtggatattgctgaaagtttcatctaactgggcaaaggctacaagttatgatttagttgttaattagacttaaagaacaaagctaatgctgttccatttagtgagaaaggcctctgaggacctgagaactgaccaatattggttctcctgctgggaaaacactatgcataaacaagtccccagggcttcattactgggccttttacacaaacacaaaatgcatcttagtttatttgaaaatccttacaatgaagctttattgcatatctataaatttttcacgttgacatgtcaaagacttgtaaaagtatactggcgagagaacgataaacattataaataacactttccctttaaatgtaagatgattgtagatagtacacagcatggtcataaaatgaatacagttctgtttggggaagcaattgtgggaatgagtagtaatgtctaaacaggatggcaaactctttattgagaaagtaagcaatgtaacattatttagcgaagttggatatgcaatttttgaagattaggagacaaggtatgtcattttatttggtgattttattaaaagacagttcaaaaataaattttaaatgtcaatatattctcaatgatattattctatctttgcaagtatttttagtgttctgccttatgtgtatgttttaatatgctgaacatgattctttatttaaaaaaagggaaagtacattttcctaagaatttaaaatgtaattccttcatttcataaagtccgtgggtcatactactacaaatttctctactttgccatgttttttatacatatttcttaggaccaattcctatagaataagtataactttaaatgttgaatgtagctattcaagtttggtcatcattggaatgttagtatttctatttatctaccaactaatttgaaccactgagtaaacattcttagctaaaaattgtttcagttattttctactggtcatgcagatatcaaatgtggggctctaaactcagttatttctcattaaatttggaaaatcttttccattttatgaacaaacacaattcctttttttttttttttttttttgagacagagtctcacccaggttggagtgcagtggtgcaatcttggctcactgcaacctctgcctcctgggttcaagcaactctggtgcctcagccccccaagtagctgggactatgggactgtgccacctcacctggcttatttttgtatttttgtattttaagtagagatggggcttcaccatgttggccaggctggtctcaaactcctggcctcaagtgatccacctgcctcagtctccaaaagtgctgggattacaggcatgagccaccaagcccggcccacatttccatttttaatatatactgtgctttacaaatattataatatgttttaaaatatgttcacagaagcacctggtctgtgaatggcatgccagcattaaaaaaaataagcattctttgaatatatatttagttttttaatgtggtaggaaaatcaaagccagagggagtagaaacaaaatttgtgattttctaaatacttcttggctgcagggaagaaaccacgtcccaggcgaagtcctacctaatttgatgataaaattacatggaagggattcttgttggcatgaggacctaccaagatggtcaacagataattcaaaaaaaaaaaaaatttagagataaggtcttgttctgttgtccagaccaggttgtagtgcagtggctctatcatagctcactgcagctttgaacacctgggctcaagcgatcctcctacctcagcctcctgagtagctgggaatacaatagtacaccaccatgcccagctaagttttttttttttttaaagacagggtcttgctatgttgcctaggctggtctcagacttctatctaacctcaagtgattccaacagataacttttgatgaatgtgagaacctttgtaatcttctatgtacttacattaaccaagtaatttcacagacaaatttccttctttttgctaattgggccatgaccttggagtagcaaagggtgaggacaggtcatgacctaatcagcacagggaaataaaattatatcatccctctggtttaagaatttgcaccatagggaattgctctttgaacaagttcttgttctgactgatgcaaaacccctgatgtttcttaaaatttatacaaatttttccagtttccataaaactggaagaaaaaaaagaataaagtgaagcctaccccctcctttttgaagttctgcatactaagtatagtgctactaggaattatttatttgacaaataagtattcatctgttttttaatgtgaaaatcaggaactatattttcagatatttagattaattttatattctgttttgtttttcccacacaactgtcaaaatcaaaagcaaataaaagcaaagtaacatgttgtgtgagatgacagttgatgacagacaccaatgggcatgaatattgattcaaatattttgtttttattatttcacatccaacccagaaacatttgtataataagctagttcttatagttacagttgacagtaggatcagtggcagcttaatccaatcaatcaatttacagacttgctccagattctctgggggtctctccactgaagatctcttcttgtcattggccccattcctgctaattaatgcctagttgtcctgtggtccctggacctactgttctttacgtaagttcacttatgccaaacttaacatggctattagttacctttggcagctcctttctttggctgttacttaatctcacttccatactttctggttacttcagactccttcttacattaaaatcttctgattacatatactagatttgtatttaagatttattttagtgactgcagaaaaatgagttcatttattcaactcaacaagttgaattcattacttgaattcattactgggaattcattaattgacatatgtatattcattgggtaaatcttgtttataaatctctttttaccaatttgaaaaagaactctaaaattttctggaatcagtgttaggttaactgtgattattagtttattctgtctttgacctgttttattgtttaaaactttgcctgaaatgattgatttttggccattaggacaaaatagaaaatataaaattgcattattgggttattagaaatatggcattggatgaaggaatagttatagtataaagcttgatttgtaatattttatttctatcacaaatgcatttttatagtaatcattgtattagtataaatatttaatttccattgttggaaattaaatattacatggctcttggaagaaagaatttcataatataggggcaatgtaattaggattttgcatgttggaaatggcagtaaaatctatcaatatattcccttttataaatctcaacccatgagagaaatgtggtgttgcttcctttcagtgcctaaccaccccttcaaatatgtttttctcctagtttcattacattcaggtaaataggacgctatacagagtataaatctaatattcttttttccccgttaaatttgccatatgagcaatttgtcattgcatctttttatattatatctgacttgtttacaaaatgtagaacattttattatcttgatttttacatgtccaatactttggtgaaatggagaattacaggaagtcaatcaatgaaatattaagcagttataaacagaatgatgtaaacatttttcaaaggaaattttatttaagttaggtttatatagctttttctctttcaaatgaaggtaaatgcactgatgagcagttcaagaaaaaaaatctaaactgacagtaaaattgcaaatgaaattaaggaaaaaggaacagataacacaaaataattttaaagattctcttctttttaacaattggacatttaaagttcctggaagtatagttcacagcaaacattttaaatctgtcttatctatattaataaaacattctaggcttgctttataagaaaactttttagaacgaaatataagcagttttagacttccagatatagcttataataattgtctgtacttgccttgcaaaattatattacaagaagaagcacacttgttatagaagtgctgaattgtatggaacctaaatctgtcaagttacctgtctttcaggtccgtctccccacctaccagacctcattatattatcccgaaaagaacacgatctctttaaggctaggcaagtattgcgctgatgagccagggactgcccaccaattggcaggcccattgggtgataaatgtccaaggacctctaggctgacgacacatttttcatcattaatccagcctattgtaaccagggccactcacattgattcggactagggggcatcatctgctgttaagagggtgatgactcgctaaaaatgaaggcctgaaactaatcaaatatatttagagccttccctggcaacttgctgggagagcagcagtagacagctaataggggagccccagacaggtagcgcggtgctcaccatgctttgtatgggaatgtgagaaatccatttggaagcctgttgtgtaattccagctattatacattgtagtacgaatgtctgtaggattagtccaatactacggtatttgaatgttgcattaaaaatgtagttgagaaataccctgctttttttttttttttttaacctggaactcaattacaaagaacagagaattcgcaaacccagatctctttggaattgctaaattgtttttgtgtttttgaaagtttgcaacagatggtttgagacatatgcttaatatttattttactgaagttgcaaaatttgatgaggagggcatcttttttttttccatttgcagaactcaacaaatagttatgttttgctcttttatactttttaaaacctaattaatgtgtacttaatcagaatatacttaaatacattgtggcagttcaagggcatatgtacatgttatttattgatttttattattaattcatgcatatatattcattttagataaatctttattattttaatttgcattaataaaaaatggcttgagttaagtcataggtggagttgcaaacttgtttgccttaggcaaatgtagaaaaatatgttctttatttcctgcttacacctgattaagcaaaatcaggtacaagtaggaaatagatttaactgattagactcgttcaatggaaaatttcacttatatattgagcctaatatatcaaaaaagggcaaaatatgagaacaatttggcttaattaaaaaaaaggagacctaatgaaattgcttttgataaagaagaaggtagagaaaaaaaaaacaagaaaaagaaaaagtaaaatgaataatgcagaccctccaattgttcaagcagtcctaatgttctacacaggaaaccactatcttctaaaatattttatggaatcatgaaaaaatatttctgctgggtgggaaggcttccgtgtgatttctcttgaagaaagtcttcaatcccattttgaaatctcaattcctccaaattccaaagctgaaatttcacacctttcatgtttgcaagttttaatgagaattatatgtatacttaggtatcaactgcttctagtgttggatgagcttaggtggaaagcttcattaatgagcaatagacaacctcactgaatctacttcgcaatgaatattcagtctggagttcatcttaactgggtccatgaggcacactgccaaaaagcaacttgctattaagcatcaggtaggagcagaaaagagactgggtaaaataattacgttctttaaaaaacaagtttgattatggaatctatttaggtcctgttggttctagtgaagttgagtcagggctagtaagaaaatgtctggaaaaagaggaactgatttgaacactgctgacctttatgcttctgccatcagaaagggggtgagacttcaacagccaatgcaaaggaagctgagaaaaaatcaatttagctttctctgctagacagaataaaggtctctaaagatatccatgttctaattcccagaaaccgtgaactgttattttatggctcaaaagggattgtacagatttgatttaattagggccttgaaatgggaggttatctcaggttatctgggtgtggccagtctagttacatgcacctagaatgtggagaaccttccccttttgtattcaaagggagatgtaattatggaaggcaggtcagagagatacaacattgctctctttgaagatgggggtgagggggaatgagctaagtctatttgtgtatttgtactccaggccctagctagaatgccagcttcacaggggccagaattttgtcctattcacatttgtatcactggcacccagtacagtgcctgacacatagtaggtgcttcataaatatttgattgaataagtgaactagtgaacaaatgaatcgattactacgggcacagtttttcaaattttgataacccataagcataaagaaattgcatgatctccttgttacttacattctttatttataaataatgtctattcatcatacattaaagcaaggggtgattgatagagaatagcaggaaggcctggtcagggtggtcagcactgagaaggaaacatttaagttgaaactcaaggatgagaaagactcagtcttataaagacctaggggaaggaaattttagacagcaaaaaccacctgcttaaacttcctgagatgaaaaagcagttggctgatttaaagcaatgaaagaaggtccggtggctggagagcagtgaacaaaggctagagttaactaatgggaggttagaaggtcattgtggcaatgtcccaatagtgggacacttgaggaccaaaggaatgagttcagattgtacatggctttttcagccgggccccaaaatatttcttagaaagacattttatttacggccaggcgcagtagctcatgcccgtaatcccagcagtttgggaggcccaggtgggcggatcatctgaggtcaggaattctagactagcctagccaatatggtgaaaccctgtctctattaaagatacaaaaaaattagccagacatggtgctgtgtgcctgcaatcccagctactcgggaggctgaggcaggagaatcgcttgaacccgggaggtggaggttgcagtgagctgagattgcaccattgcactccagcctgggcaacagggcgagactctgtcctaaaaaaaaagaaaaaagaaaaaagaaagacattttattttaccaagtattttgtaaaaatatgctctatgttaatgtccttggcattcaatggtccctaccctcaaagattccagactcaagggagacaagtgtgtaaacagataaataaaatacagggtgatacatacaaatgacattgtaaccaacagcaatgattcccagcaggataatattcagtggaagataaagtgtttgctcctctggtgaaagatattttatcatctcatgcaagattccttcctggatttttatctctttgaggcagtacccactccttcactttttcatgcaattgttttccctcttattttgccataccttggagtttttatctaacaagtcttaaatcatcattgcctgtttcccttggaaaccaaggagaacctggttgaacaccagttggggaaatagggatgttgcctgagcttgcagatggtaggagcagacacagtcagccaccagtctttaaatgacggtggtcaggaggtgaccagggagccaccacaagcatattcagagaaaaatcatataggcaagttcagctgtttttattacaggttgaaagtcagtgatttcttagccaaaatggttgatgtcttgttctttagctgattcatctattcatagcggacactcagtgactgaggctgtttttattctgatggactcagtcaccattttttttttttttttttttttgtgacagattctcactgtctcctcaggtctgagtgcagtggtacaattacggcccactgcacctcagcctcctgtgctcaagcaatcctcccacctcagcctcctgagtaggtgggacaacacgcttgtgccaccgtacctcgctaatttttttttttgttgtttatagagatgatgaccccactatgttgccaaggctggtcttgaactcctgtgctcaagtgatcctcctgtctcagcctcccaaagtgttgggattacaggcatgagccactgcacctggcctaattagttattctttatattccattgaaatatactcttagagatattgtaatggaaatattcttattacatattattgcatgcaacaagtaagtgaataaaagagcaggattttatttatataaatttaaaaattatacacttttagatgtataagtatgtataaaaacgacattagaaggagacacacaaagctatctactatttgaaagaagattgcatttggaaggtgttatgaatgactttccttctaacaatgtttttccaacattttaaaatgtagtagtaaagaaatatatgctaataatttgtgtgtatgtatatcctaactaacatattttatatatatatatatatatatatatatatatatatatatatatatatatatatattttagtttctataggtaaagggaataaagcaggaaacatttgaaagattccaaatctggttacttttggtaggtgtcgttattattaaatcaattttagagccacgaagaaaaacacaataaatgcaacttttaaaaatttcaaaaattaaatgggtatcaccccctcatcagtcatacaaaagttttccaaaaacaatatttatattgtgttatgtgcaggctgagggtcccatgaacagttcttttgtcttgcataaagacgatgctcctagtctacaggcagaccagctgttctttccattgtaaagctttatcagaagggctatagttcagctcctttcttagtcaccatatgactttggacaatgaaaatgaaaacaatcacaatgagaatgttcttaaaaggagaaatacctaaaagccattttattttctgagatggtatatggtgtgttagttaccagtaactggagggctgatatggttaagcacattgtgtctgaataacataccaactggcaagcgagggttaccacagacaccataggccaggcacaccttttgcccaccaaggcctcaaattccaggcaatgcataagtacacagtagcacaagtcttttggctgaaaggattatatataattcgaatgcaattattaaacttgctacctctgtcattgctcctgttctttctagttatcatatatgaagctcctactaggtgttcatcattatcactgacctaactagtgaagctatatgacttcattattcttataacaactttgtagggtaagatagtattaacctccttatgctcagtgtggaaaaccaaagctacagagattttatgtaacttgctcaaggtcacactgctcataaaatagaacaacctggagttgaacccagaactttctagattttgtgctctttctacaacttcacattctttttctttttagtgagggaatacctgaccatttcgccactaagaagttttataaatgttataggataatgtaagtggaaaatctttccagaaagcagcaaactccattgcagcgatttgtgcttaactgggaacttgagcacataataacaattacagtttaatttttcttattttttaagttatatttatgatgttactctttgtgcctctaaattgatttaataacaaggccgctgaacctttgaagaccaaggaacatgataaaatattttagaaactcatatatttttacatttgaagatataatatcaatttttcatatttaagttttacataaaagtatgttggtctgtttcctttcactgtatgtgacattgcaatagggcatttatttctgtgtgtcttagcatgtgcatattgaactgaacttgtgcatattcattgtatttgttgcctaaaatttatataatagctggatcttgattttgaagtcatgggtattatttccatgaggggaaaaaacacaaaaaactagacttgtattctaaaatctacagtaagaaacggtgagatataactgccaacaaccagcttcctaaatattgtttatctttagatttttgccttgatcttcaaggacaaaacaagttatgggtggcctaatgggttttactaacttaaaaattgtacatttagattactcacaaattcctaggattaaaacaaattatatatacaagctatttagagctaattgaggagtgtgtatgtttctcaatctacatttttaattaaagcaatagctttaattcctgcatgcctagataggtatgcacattttagaagtcaaagaaagagtcaagaatagtatcaacgatcagagggaagccatccaactgtgaaactactggtcattgagttttttctgagttttaaccatatgtgttaatagcatttgttatacaaaatgttgatcattgtgactgtacaaaatggtatcaacacattttctgcagtgcacaacacttctacctcatgatactttattctaatttgctttatctgattacatctacattttagagtgatagagaaatgctgaatggtttgaagaaagtcaaattaatgatacttctggaggggtgatatagtaacaactactagtgtttttaatatacatctgtcatccttttcattaaaacttagggaaatgagctgggaggaggttgttctgaaatatagttatttctgtccttgtaacttcatcatttgctttaaaaattattattcatagataatttgttttttcttagcatgagtaatgaaatctaagaaatctaagacagccctcaacttattacttgactccccgacttcattcttttccatcttccttcctctattctctctttccccattcccttccctccttccttcttcctcacattcttcttctctttctttcttctttatttccttcattcatcaaatatttattatagtgcctatcaggtgcctccctgggtgatggtagcagcttcatgaaatgaaatttttcaccttctcaagatcacatgaccaagtttaaggcaaaggccttaggacagaaaatactcatccaggacagtttctagcagagctgtggttccgaacttttccagcagagatgcccttatccacagtgtattttagcatgtaggaaaacataatctcagccactcacaggaatgtagctggattggttggcagcagagagctttcaatatcaagtcatggtgtaaagtcagttgggatttgaagggaggtatgtctccctatcatgacgttttgttttatgtccagcgaatcaataaaacaagtaatttattgttccagttccaaatatgcttaaagaataaaagcactgcacataaatgtgctaccctaattgtgtgaaggatttatgtgatttgtaaaatattttttgctagatcactttatccacacttctgattgtgttgactaacaaaattaagtaatctttgatgcaaacatgtcttgagggtgattgatcacactcagttcttgggggtggggtactgttacggcatattgagaatttgcaaataatcttaggttaagcatctgtttttttcttagactgcttactgtgtaaaaataaatcaggttttatatctttgggaaggaaaacctgaataaggaagattgatgtgtaaccgagttatcggaagccaatgatggtgctgaaatttaaaatgtcagttttacagtgtttgaatatagtttctctgtaaaagttactgaatcagacttgtctttttcaagaaaccaaatgccaatttattattcacatagatttcattttttcgtcccttatactacttcacatttttattgaaagaggcttcgaggcttctctttacaagacattttgataatgattgtgttgatagtggcggctgaaactgccgctgttggaattgatttagcagtattttctcattcagtttttgctgcaactctatgagacaggaactttattcacaccgattttgcagataagcaaactgaagtacaagtgaattatggatgtcttcaaggccacacagcttccaaaacttatgcccttaattatgatgcaaagttgcctctctgcatggaaaaagtaactttaataaaagtaaggcctctcttttggcaactatctcttttaggataaaatacagcccacaatttggcctggccttaacctcatgaacacaacttacagaggagataaatgtgctttatagtagaaagtaaataagaatgactcaccatcttggttatgtaaaatatattgaggtctattttgagttagggctcccagcaaaacctggtttaattcttcagtatcctaggaggaactagagatgtaggttcagcaacccagcacaactccatttttacctctgaacctgcttcctcacaatcaatagtaattccctgatcataacatggcattcagtgcatgcaactaaaatatgttactttttttttagcaaaatatgctacttttattttgttcacattatccaaactgtaagaatttttactttaaataaattatatttgatgcttaattgatagatgataaagaattaaggttcagctttttttgtccctcaacaaatatgtgaaatcatttttatgatgcatttatggcaagagttttgtagctttaagtgccatgtttttttgttaggcttttataattttaaaaatctatatgtttaagtttgtattttgaaactttttagacttctaggcctcccttcatttctaataaacatagaaaaatagttaataatttttctagaatatgcaattttcatccttccttttagaggtccaattgactatccagtgggccacctgacagcatgttttataatttagtgttttctctcgaattgtaaatgtgtccaccacaacaaaaacatacgcttcaagacagattatccatgttgttttgttgaaaggtgtaatactgcccaattaaattaactaaaatttaggtagggagataggaatgggtcaagattcgtatcagcagttcaactgaaacgcgacagtccactgattccccttgcggggcctgtgacaggggtgtagctcccctgttcagttgctgcggctgctcagacccctgacgggaggggagcacagaccggcaggtgcaggagccgggcggggcaagtgctctgggctgcagccccgtggtaggtagtatctaggagtggatgcctggggctccagtgttgcaatgctcttttagcctttctgtccgcagacagcttaagtgttaaccagctcagtggaaccattaccttttcaccagggcagagggctagtgtgacagctttctgtatcctgaattcttgtccagtgtcccagaaggatcgggtcacacatgggcttgaaggatgaatttattgagtggcggaggtagctctcagtggggagctgggcgggggcaatggactgggaagatgatcctcccctaaagtttggctgtccagcggccaaactcctctctgagcacccccagcagaactcagctttgtgttcacactccttctcttctctctctttctctgccgtgccgttctgctgttcatctgcttgtctctccatctccttgcctccttctctgctcctggagcctggggttgggagtttatgtgggtacaggatggggggacatggcaggccaaaaggcaactttttgggcttgaaaacagaaatgcctattccccctaagggcagcaggtatccagacttgagggtggggcctttgcatgggaaccttcctcttctaccgtatttccctgtctcctctccatatcacatgcacatgtagtcttaaaccagcttaataagttgcactattgtagaaacaattttacttttttaatgtatgggcaaaaataatactgccgattatatttcaaagataaggaactcactttgagtgaagataaggcaaatattgaaatatatagaaaggttctcacttgaaacatgcgtaagatcagggttacagggaataagaatgtgttagtttcctagggtgactgtaacaatttactacgaaatgagtggcttaaaacaacagaaatgcattatcttacagttttgggggactggaaatttgaaatcaagggacacactccctctgaatgccctgaggaaggatccttctttgtgtctccattttctggtgccctcaggcattccttggttgggctgcgtaactccggtctctgccttctcttcacatgctgtcttcgctttttttctgtcttaacatggtgctcttcctgcatctctctctctctctctgtttttttcttattttattttattttgagacagaattttgctcttgttgctcaggctagagtgcaatggcgcgatctcagctcactgcaacctccacctcccgggttcaagcgattgtcctgcctcagcctcccaactagttgggattacaggtgcccgccaccaagcctggctaatttttgcatttttggtggagacgggtttttaccacactggccaggctggtctcgaattcctgaccttgtgatccgcctgctgtggcctcctatagtgctgggatgacagggtgagccaccgtgcccagacctttcttactataagactccagtcttattgtattaaagaaccacctacccaagtatgacttcatcttaacttgattatgcctgcaaagactctataccgaacgtggtcacatttataggtactgggatttagaatttcaatatatctttttgaggaacacagtctcactcataaagaagataatatatatttttaaaatttttatattatttctttttggaataaggtaattttaatgctagccttttttgcatgaaattaatttagtagtactctcatcagaaaataattacttggcatttttaagtttttgatggacattctaaataacgttgcaatattcttgaattgatagagaattcaagaattctgtaatccattgatgaaaccattcaagaattccagaatccattgatgaaagaagaaaaacatagacaaacagctcaaaccaaggctatgcattatgtgggaccagctcgttaatggtacacagtattttttctgctttcattaatggattggtgatttcaaggacactaactaacctttgcatcataaacattttgtacctataaactacaaataaagaatatagtttaaacaatcgtatgcaaatatgggcataatattaattgaattgatttatttggcaacgcaaactatagttataaataatataaagactatttttatttatgttttgtttttctcacttaccacttatctgcttctctaatcgtctctcttataagagatctaaaattttgaaggagtttgggatatgggagcatttaactggacaattatttctttttctatctattttagttagaatcattctaaaataggataaactttatatgataccaaaaatccattcggacagtcacatttttcatagtaagcgtcaatttaaactaactcttctatatgacataagtcagaattaaagttttgatctgaattatgtatttagatgcttaaatgcctctcattaacttaaggtttttgctaatgcttctatcttttgttcacttagccatcattttatctttaaaatatgcataggaatgtacataagtggagtcataacatcatttttagataaaagttaaaaatgagactgtaattcatttttaacatatttgtatgttgtggctgtacaaaatccaaaagtattttcactctccaatggggatgatgtgcagctcccaaaatggaaatagaggtaacgttccagtgatcataaaaggacagtcataagcttttagtgtgcagcagttttaagactatcctcagttaatgtgaggcaattgcagattcactgcatctgagtttaaacctctcactactttgagtgaagtctattaatgatatgccttccatgcagctgacattttaagatccttgctgcttttcaaaacgcgtgggcactaaagatgtcttcttgctcttgagaattgatttcatacacaacaggagcttgtgatggattcgctcccactgtgggaattgtccgtgagtatccgagggcaggaattggctcagataaaggatctatcctgagcgctctcctgtaaagagtaagatgtgcgcattagaactagctgatgccgagtttaattcccagtctcttttgtgattctaaaccatttgacaagcctctgcctagtgtgagcagattgatcaggaaatttattcatttcatgaccttgtctactcatttatagctcttaaaaaagtacctcacctggaactcaaagctccctaagaatttaaaagttatgaatatatttctttcatctataaaactacattttgctttggataaaatatctagcatttgaggagaatttcatgttagcgcaattgattaggctctatgttacatagatacatcataaattgcttttataataaatttatgttttcttttgttttaaaggacatggggattgagttgcaaccaatagatacagttacacaagccggcatggtcaatagcatgtggatagctgataacaaacagtactagaattgtcagtgtgttttcattgactcctgacctgttaaaacttagctcctgaagacccattagactggacaaaatatacccatttgaatggacagaactaacaggcagatactattattataaagccataaatgagcaatcagtctcatatgtgtttgaagatagactatagattatggttctatgccttatgatacaattactgggttatttgtgtaatttgaaatttgggttttaagaaaaccatattttcttatttcttgaggagaagaaagaaaaccgatatggttggtcatagtaggtaatgagaaaaatggcagaagatgagttcagagagaaaggcatgtccagatgacattgggctgtgtaggttaaaaccttagtacttggacttcattttatctgccaaaagaaccactggagtgctttaaataataacctgatatgtttcatatatttttgagagatcattatggcttatgtattacaaaaaattctgcttcatttctgacaatttataaaatgatttcaagaaacagatctcacatgtgattctttgaaaagcaggcacgatcttctaaagtaaataaagatttttgtacagatattcatctattatctattaaaaactttattccagaattatctggtaatgttaatttcacacagccaatataaacagtaatgaagaaaatggaactcagttatttttgtttcatgatctatgaatctaagaccaaataaattataaaaaataactattcatttgccttagataatcaaaaaacatctctgttgctgattatcaaaatatttatattacaaaaaggttaatggattagtgtcacataaaaacatcttaactgaaggcaaaattgcataacagtattttacttttgcaatgccatctaattttcaatacgttcaaggtaaaaaaaagcaataaaatggaaatggcaataaacataattcattaggcacacactccactttatgagatgatgcaatgaatgtcattagacaatcaatttcttccctggttggtcatttaatggtagaaccagtgggccgattataacgtgggtatgccatattgacaaccgaggcaaattaatatagtggaaaggacactcgtttgagatttaggaagccttgatcagcctattcaactaaagagttgcacaaaaaccatgtttgtggagttagtttcctaatctacaaaattagaggattgaagtagatagtagatccaaaatgctggtccaaggatgaatgtcaggctggccttatcagaattattaggataacttttaaatacaattgattcccagattcttcactcagaaatacttacttattgtgtccagagtggggtctggacagagatttgtaaaaatcacccaggtgattctaatgtgtggggatcttttacaacagatggaatgtatgaccccaaaacatctttctttttgaaagaaaaatctttgaattctgtgtttctctaggctgtttccaagaatctttacattataaattaggctacattacatttgtggatttggtactaaagctcaagatttttttcttctgctttggaggtaagcttatgctttttctatagttagcagcatcctgcacagacatttgtacaaatatctcaattttccttcttcattgtggaaaattgagacatttgtacaaatatctcaattttcctccttcattgcagaaaatggcctaaaaatttgcatgcattttagcctagccattttcttctagtaattattcctaaattatgttcaaaaatgtatgcataattaatgttcttcaacatattttgtaatagtaattaatttaaaacattacaaatatctacaaacaagacataggttaaaaagaattttatgataataatataatattgttaaaaattgtcatataacaatacaatataccctacaggacttaaaatttctgttctagaacaatatttattgacataaaaagtattcaccatatattgctcggtaaagaaacatcaaatggtattcccctatgtttctaaagatgaaaaataaaatctcacaaataatttttttattatactttaagttttagggtacatgtgcacaacgtgcaggtttgttacatatgtatacatgtgccatgttggtgtgctgcacccattaactggtcatttaacattaggtatatctcctaatgctatccctcccccttccccccaccccacaacaggccccagtgtgtgatgttccccttcctgtgtccatgagttctcattgttcaattcccacctatgagtgagaacacgtggtgtttggttgtctgatcttgtgatagtttactgagaatgatgatttccagcctcatccatgtccctacaaaggacatgaacttatcattttttatggctgcatagtattccatggtgtatatgtgccacattttcttaatccagtctatcattgttggacatttgggttggttccaagtctttgctatcgtgaatagtgccgcaataaacatatgtgtgtgtgtgtctttatagcagcatgttttgtaatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctctagcacctgttgttgcctgactttttaatgatcaccattctaactggtgtgcgatggtatctcattgtggttttgctttgcatttctgtgatggccagtgatgatgagcattttttcatgtgtcttttggctgcataaatgtcttcttttgagaagtgtctcttcatatcctttgcccactttttgatggggttgtttctttcttgtaaatttgtttgagttcattgtagattctggatattagccctttgtcagatgagtagattgcaaaatttttctcccattctgttcactctgatggtagttccttttgctgtgcagaagctctttagtttaattagatcccatttgtcaattttggcttttgttaccattgcttttggtgttttagacatgaagtccttgcccatgcctatgtcctgaatggtaatgcctaggttttcttctagggtttttatggttttaggtctaacatttaagtctttaatccctcttgaattaatttttgtataaagtgtaaggaagggatccagtttcagctttctacatatggctacccagtttccccagcaccatttattaaatagggaatcctttccccattgcttgtttttgtcaggtttgtcaaagatcagatagttgtagatatgtggcattatttctgagggctctgttctgttccattggtctataactctgttttggtaccagtaccatgctgttttggttactgtagccttgtagtatagtttgatgtcaggtagcgtgatgcctccagctttgttcttttggcttaggattgacttggcactgcaggctcttttttggttccatatgagcttgaaagtagttttttccaattctgtgaagaaagtcattggtagcttgatggggatggcattgaatctgtaaattaccttgggcagtatggccattttcacgacattgattcttcctacccatgagcatggaatgttcttccatttgtttgtatcgtcttttatttcactgagcagtgctttgtagttctctttgaagaggtccttcacatcccttgtaagttggattcctaagtattttattctctttgaagcaattgtgaatgggagttcactcatgatttggctctctgtttgtctcttattggtgtataagaatgcttgtgatttttggacattgattttgtatcctgagactttgctgaagttgcctaccagcttaaggagatttggggctgagacgatggggttttctagatatacaatcatgtcatctgcaaacagggacaatttgatttcctcttttcctaatcaaatcccctttatttccttctcctgcctgattgccctggccagaacttccaacactatgttgaataggagtggtgagagagggcatcctgtcttgtgccagttttcaaagggaatgcttccagtttttgcccattcagtatgatattggctgtgggtttgtcataaatagctcttattattttgagatacatcccatcaatacctgatttattgagagtttttagcatgaagtgttgttgaattttgtcaaaggccttttctgcatctattgagataatcatatgttttttgtctttggttctgtttgtatgctggattacgtttattgatttgcatatgttgaaccagccttgcatcccagggatgaagcccacttgatcatggtggataagctttttgatgtgctgctggattcagttggccagtattttgttgaggatttttgcatcaatgttcatcagggatattggtctaaaattctcttttttttgttgtgtctctgccgggctttggtatcaggataatgctggcctcataaaataagttagagatgattccctctttttctgttgattggaatagtttcagaaggaatggtaccagctcctccttgtacctctggtagaatttggctgtgaatccatctggttctggactttttttttggttgttaagctattaattattgcttcaatttcagagcctgttattggtctattcagagattcaacttcttcctggtttagtcttgggagggcgtatgtgtccaggaatttatacatttcttctagattttctagtttatttgcatagagttgtttgtagtattctctgatggtagtttgtatttctatgggatcggtggtgatatcccctttatcattttttattgcatctatttgattcttctctcttttcttttttattagtcctgctagcggtctatcaattttgttgattatttcaaaaaaccaactcctggattcattgattttttgaagggttttttgtgtctctattcccttcagttctgctctgatcttagttatttcttgccttctgctagcttttgaatgtgtttgctcttgcttctctagttcttttcattgtgattttagggtgtcaattttagatctttcctgctttctcttgtgggcatttagtgctataaatttccctctacacactgctttgaatgtgtcccagagattctggtatgttgtgtctttgttctcgttggtttcaaagaacatctttatttctgccttcatttcattatgtacccagtagtcattcaggagcaggttgtttggtttccatgtagttgagcggttttgagtaagtttcttaatcctgagttctagtttgattgcactgtggtctgagagacagtttgttatcatttctgtttttttacatttgctgaggagtgctttacttccaactatgtggtcaattttggaataggtgtggtgtggtgctgaaaagaatgtatattctgttgattttgggtggagagttctgtagatgtctattaagtctgcttggtgcagagctgagttcagtttctggatatccttgttaactttctgtctcgtttatctgtctaatgttgacagtggggtgttaaagtctcccattattattgtgtgggattctaagtctctttgtaggtctctaaggacttcctttacgagtctgggtgctcctgtattgggtgcatatatatttaggacagttagctcttcttgttgaattgatccctttcccattatgtaatggccttctttgtctcttttgatctttgttggtttaaagtctgtttaagcagagactaggattgcaacccctgcctttttttgttttccatttgcttggtggatcttcctccatccttttattttgagcctatttgtgtcgctgcacatgagatcagtttcctgaatacagcacactgatgggtcttgactctttatcgaatttgccagtctgtgccttttatttggagcatttagcccctttacatttaaggttagtattgttatgtgtgaatttgaacctgtcattatgatgttagctggttattttgctcattagttgatgcagtttcttcctagcctcaatggtctttacaatttggcatgtttttgcagtggctggtaccagttattcctttccatgtttagtgcttccttcaggagctcttttagggcaggcctggtggtgacaaaatctctcagcatttgctcgtctgtaaagtattttattcctccttcacttatgaagcttagtttggctggatatgaaagtctgggttgaaaattcttttctttaagaatgttgaatattggcccccactctcttctggcttgtagagtgtctgccgagagatcagctgttagtctgatgggcttccctttgtgggtaacccgacctttctctctggctgcccttaacattttttccttcatttcaactttggtgaatctgacaattatgtgtcttggagttgctcttctcaaggagtatctttgtggcgttctctgtatttcctgaatttgaatgttggcctgccttgctgggttggggaagttctcctggataatatcctgcagagtgttttccaacttggttccattctccccgtcactttcaggtacaccaattaaacatagatttggtcttttcacatagtcccatatttcttggaggctttgttcatttctttttattcttttttctctaaacttctcttcttgcttcatttcattcatttggtcttccatcactgataccctttcttccagttgatcgcattggctactgaggcttgtgcattcatcatgtagttctcgtgccgtggatttcagctccatcaggtcctttaaggacttctctgcactggttattctagttagccatttgtctaattttttttcaaggtttttaacttctttgccatgggtttacacttcctcctttagctcagagtatttgatcatctgaagccttcctctctcaactcgtcaaagtcattctctgtccagctttgttccattgctggtgaggagctgcgttcctttggaggaggagaggtgctctgatttttagagtttccagtttttctgctctgtttttttccccatctttgtggttttatctaccattggtctttgatgatggtgacgtacagatggggttttggtgtggatgtcctttctgtttgttagtttttcttctaacagtcaggaccctcagctgcaggtctgttggagtttgctggaggtccactccagaccctgtttgcctaggtatcagcagcggaggctgcagaacagcagatattggtgaacagcaaatgttgctgcctgatcgttcctctggaacttttgtttcagaggagtacccagccgtgtgaggtgtcagtctgccactactggggggtgcctcccagttaggctactcgggggtcagggacccacttgaggaggcagtctatctgttctcagatctccagctgcatgctgggagaacgactactctcttcaaagctgtcagacagggacatttaagtctgcagaggtttctgctgccttttgtctgtgccctgtccccagaggtggggtctacagaggcacacaggcctccttgagctacagtgggctccacgcagttcgaacttcctggccgctttgtttacctactcaagcctcggcaatggcgggcgcccctcccccagcctcactgccgccttgcagtttgacctcagactgctgtgctagcaatgagcaagactccgtgggcataggaccctctgagccaggcacaagatataatctcctggtgcgccgtttactaagaccattggaaaaatgcagtattagggtgggagtgacccaattttccaggtgccatctgtcacccctttctctgactaggaaagggaactccctgaccccttgtgcttcctgggtgaggcgatgcctcgccctgcttcagctcatgctcagtgcactgcactcactgtcctgcacccactgtccgacattccccagtgagatgaacccggtacctcagttggaaatgcagaaatcactcgtcttctgcgtcactcatgctcagagctgtagactggagctgttcctattcggccatcttggctccaccccacaaataatttttttaaacaacctaatgcaaaagtaatttaatattaagctacttctatctctaaagaggtggaattacaaaatattattttgtttttatttagaatgccatatttttttcaaaatatatatttattgcttatattactgtatttaaaaaaaatcactcttatcaagtgtgtcagatagattagggagaccagggcataaagccacttttattcttctcaacctgaaaatgtaaagatccatttcaagacaccaagtaattgatgttagagcttcaagggacaggacagagcttgtcaagggaaaattagagtggtaaagctgacacccatacatgcaaggcccttaatctttctttctttctttctttcttttttctccttccttccttccttcttcttttcttttctttcctttttttcttttcttttctggagtctcactctgttgcccaggctggagtgcagtggtgcgatctcagctcactgcaacctctgcctcctgggttcaaacaattctcctacctcagcctcccaagtagctaagaccacaggtgcacatcaccacgcctggctactttttgtatttttagtagagatggggtttcaccatgttggctaggctagtctcaaactcctggcctcaggtgatctacctgcctcggcctcccaaagtgctgggattacaggcatgggccaccatgcctggccgatttttctactgtcaacttgaaaataagcatacttaatgtcagcatggacctgatttagccatgtaacatttggctgctgaaaaagcatgatgatgtgttttttgctcctggtcatcttctgtcaatagttctttattttgtcctagtttcatgttgtaattaatggaattatatttgaagagctcaaaatgaaatgcttaattatattcagctgcaattacagtgattaattgatccaaacttattagcatgacacctaaaggaaaccagttatataaaaattgtaggaggcaatactttgagtatgacactcatgtgagctagctatctagattaattctattttattaaattgtctaagttttacagcttctggaattcatattggaaacccagggtctagactaaactgttatttcataaacaaggacaaaagaaccgaaaaaagtaaatgaaatattacagacaggagtagttctccctcaaatgagattatctcattattttgaaattatttatatgtttcccagtttggatacattgtcagctcctgattatccatgccaaagatagctttaaatctccaaaaagagattttatcaaatctatatgcatttcccaaatcccaagaaaattatgagtcatagtttagagcatagacatcctgtttcagttaatgctttgtagggtctaatcatcatgtatggatgtgttcaatccccttgctctggatgctttcactggactgggtattaaaaagcaaattcttcaaactctgtacttccaccatgcctgcccacctcatttctttaatatgccaacctccttctcatactaatgtattttgtacatttctgcctggaatttttctcgatccttaggcttttcttgtttaattcctaccatccttcatagctcagctgaaattatacttttttttttttttttgaaatggagtctcactctgtaacctaagcttgagtgcagtggcgtgatcttggctcacgcaaactccacctcctgggttcaagcagttctctgcctcagcctctcaagtagctggtattacaggcacccacaagcatgcctggctaatttttgtattttttagtagagatggggttttaccatcttggccaggctggtcttgaactcttgaccttttgatccacccaccttggccttccaaagtgctgggattacaggagtgagctaccgtgcccggcctgaaattatactttcctgtagaggaagtataattaggttatcatgtcaccctcttcttttccattataagtattctgcagtcgtagtgacacatttatttgtgactgactaatgcgtctgacttttcctttacaatggaagtgctacagtatcaagagctgcacattttcattgacactctacatccagaatccaacacagaacacagcacattgaaagtattttattaaatgttcttgaatgagtggaattttcatttttctaatatcttttagcagtatgtttgatcgatttttgtttgttgtttgtttgttgagatggagtcttgctcttgtctcccgggctggattgcagtggtgcaatctccgctcactgcaacctttgccttctgggttcaagtgattctcctgcctcagcctcctgagtagctgggattacaggtgcctaccagcacgccccgctaatttttgtatttttagtagagatgggggtttcaccatgttggcaaggctggtctcgaactcagcacctcaagtcatctgcccgcctcagcctcccacagtgctgagattacagacaggcgtgagccaccgcactgggcctcgacttctttttagatagagtgcccattgttgctccttttcatccatctagtagttctccttcttttgcaatttggttaaatgattataaccaaacttattaagctttattttatgtgtaaaattttgagagaatcatcttgactgtgtgtatgtgtgtgtatatatatatatatatatatatatgtatctgtgtatatatatatatataatctgtatatatatatatatatatatatatctgtgtgtgtgtatatatatatatgtcacctgagtgctttcttttgggggtaaagtatttgactgagacactaaagatttgaattgttgttctgcattttactattgaccatgggccttaaggaagtcatttagctcctgttagcatcagtttgctgatttgtaaaatggttaaacagtagtatttgccgtctacaagtcacaaagctattgtgaagatcaaatcacatatgacattcaaaaatgctttgcaaatgttagccctttactaatttcagtccatatcaaaaatccacattgtgtagaaaatttgtagatctttgaaattacataatcttaaaaatatttgtgaaatacgagatgtagatctgaatttctttaagacaaagttctttagtaatatggaaacaatgacatatccaagcagaagcatagatggcaatagaatttgttcagaacatggcttcagaaaacatactaatagttctgtttttttgtttgtcttgttttgctttgagatggagtctcactctgttgcccaggctggagtgcagtggtgcgatctcagctcactgcaacctccgcctcttgggttcaagtgattctcctgcctcagcctcccaagtagctcggactacaggcacgtgccaccacgcctggctaatttttgtaatttttagtacagatagggtttcaccatattgtccaggctggtctcgaactcctgacctcatgatccgcccaccttggcctcccaaagtgctgagattacaggcatgagccactgcgcctggccgagaaaacatactatagcttttcacagacaaattggcaacttctccatacataaaaattacattttaactgcaaatgaaaatatagacatactaagagtaggtaaaaaattgattattaatttaaaattaatcattttaactcaatgctttacatatattaaaaagtattcatttatatatgtcattttttatacgaataaaatatttaaatattataatctctattattttaatatagttcaattagattccttgtggaaattataaatgattctctaaaaaaataaagtcattattctgtcaagatgattaaatggacattttcctaatcttctagttgaaccattgagtcttccagtgatgtatacttaaaatcatgtaagttataaataaactttcatggtaggtgtaactaacttcatctgactcatgaagagagattagtatctcttttatcatttagacgttaatgaactttcagtcctacgcagcaaagttacccattcatctttttgaaaaaaagatgaattattgttgaactcacctcctaagtattgctatgttgtataatagtagaaataatagtagaataatagtagaaaccatactttttctattataaaaaaatagaggaaatagattggaaaatataatctgaatgaagtcaaagttagcattgagtgttaaataccattgtcagtgtcctttacatatgtaatggtaaagctttccaatgcatcttgggttgcgtgagctaaatacttttggcaaggaaaacatcagttatatgaacactgcagacccacataggcctggtgtacagctttgtctttccatggctctagtggttcatacctctgctgcacttgttcttgactgggcaccctctgccagtgctgtgtgagctccccaattccttgctgtccttatgtggttccgtaagctgacatttcatcattcagaccaagtagatagaaggtgttgcttactcttttaaaatgagttgtataggattacattgttttatttgataaccttttggtaaatacagcagaaatacaacttcagccagtttaaattaaaaagaggcttttgttttaaagctagtaagggtgacactgatcgaatgtgaaagaaggaagcagaggctaatattgggattcaggctcaatccagtcttttgtgtatctcatatctacacctcccacaaatatttgttgtccgccccctcttctctctctctctgttttggtctctccctagattgatcttcttatatatcttcttgtcatgcatcttacctagtgttccccaaatgaaaataactcaatgactattctacgtcaagtgcccatccattcaccagttcaccaagatatgtaaaaacttggcagtttggaaaagatctataaaataacaattcccaaaagaaggggatttctgtgaagatacacaatagttgtccaaaaaaatatgctatatatttgttttaaaaaattgatagcccaatggactttttcttttttcttttctttttctttttctttttttttttttttttgagacagagtcttgctctgtcaccagtctgtactgcagtggcacgatctcggctcactacaacctccgcctcccagattcaagccattctcttacctcagcctccagagtagctgggactatagccacccgccactactcccagctaatttttgcgtttttagtagagatggagtttcaccatgttggccaggaggctctcgatctcttgaccttgtgatccacccacctcggcctcccaaagtgctgggattacaggcatgagccaccgtgcccggcccaatggactctcaatacactatcttactttaccctcctgtccaaaagcactaggtggaaaagagatgttacatttatttttaaaagttgagatatagatcatatccaaaacctgctatagaaatatactacattgtcaatatgaataattaggtatagagaatggcacctgcttaaaatcctttaatctcactgatttggtgtgtgttgtttccccagtgggttacatgttaccgataacctgtcagaatttgaatatcgcagaggattttcaaagtcagaagaactgagtaataaggagatgaaagactttttcagaagacttttttttaaatggaaacttatttttaaatatagaggaatgtaagaacttgcaagtaagagtgaattggtttgcaaagtagattctgttttcccttcatgtgagctttattggtttatattctcttcaaattttcttcatgtcatttggaaacaactgctgttcaaaaactatatcttcatatgcaagcatttactataaaacttttctttaatgtgtttaaagcatttctttttcacttaaacatttttcctttattttaagctagtgataagacagaatggtgatatgtccatttgcttcatttgatatgcacatttgttctatgggaaaatgtggtctactcctaatttcattttcgtttcctaaataagaagacccattaaaaagcagacatctggtgtacaaagcacttaaagctgtagctcccaaggagtgctttcttccctctttaaatatgcatgaactgttgttttggtaatccacttcaccctgtcaaaatagaatcaaatagaatatatgtgtgacctcttccccttctatcctgggaaaatgagtttcaagatcactgaggtgtacagtattccgaagccttcactttccgttttattcaccctgaaagctcttacagttacagaagcttaaagtttagctgaaatctactttaataatagctacactgttttagttatgaagaatgactctatgaactttaaatatttgaatcataaagaatgaatgtagactttcaaaaaataggctttgaaaggagtttaagaatatctgtaccttcattgatttttttatatcagttagagctcaaggtttttaatacagttacctcaaaaattctgtgtgcaaaatagttacatttaacggatattgaaactaaatatggttaacttattttcctaggagaagagaacaactaaaacaggcgcaataaacatttttctttttcagttgatgcacatttaatgtcagtttgcttccttgaaatttagacccacattccccaagattgagtcctgtagaatattaactttccatattcacctactctgttccatgcaaaaggatgacatgatcaaatggtacataccttgctttctcctatagattcataattgaaatttggatattatactttctaacaatgcttttagtaaatatatctgtgctagcttggttcacccaatttgcctaagtatatttaacacctaaacattaaagaaaaatcacttttgaaatctgtgacctagattatgtttatgtgcagattatatcagaaaatagtacaaaactttatgaagacaagagaagtatctcattttttcttccttctggtttggattgtttattttaataaaattatatcagtctgatttggttagcttggaatattgttttgttattgttctataagtagctgcattatccataatagttcatatatatcttatttgtgtgtgtcatcctcaatactgttcaaatattttaagggagacaaatggatacttttgcttttagaatctatttacaagttttattcttctaaatttcagtaaatgagtctgtgccacttctatgttttaaggtatttttggatttagagtacttctaaccaatgatcatgaaagtagtagtctattaattttaaatcatattttctaacattgtctattaatgtgtttttgacaaatgtgatgcctatgagaagacagcttcttcactagaggaaagtaaaaggagtttttgaaccttgatccaaatctctgaatttatttaccatgttgtcccaatcgaaaggcattgaacatagtttttcacaagccacaaatgtttgagtatcagagctgaaagattgcctaactaagtaaaatacagtatttacaggatgcttggggaaaagatatctggctaatttaaaattatgccagtgatattctttgcttatccatttgtgacaaatccttatcagccttagaaaatgcacataataaagtacagagaacaacatttgcttattctttaaacttatagtcttgtaatgctgcagtgctatcacaacgggtattaatgatcgttgtatttattgtatatttgagttaaatccatattaatcctagggtttatcttaaaattgtgtgtgtttctttgtttgtttgtttgatttatttggaaggtgttttttgtttttgttttattttagaactaaactcctcaaatgactttatttactagcttgaggtgtctttctcctaaaacaacagaaaaagtcatgatgaagggctgggcagaagaatcttgatagtttgaatttcaaagctacacagattatagataagatatactttatgttattagacatttatttttccctagataagaccgctgatagtggatgataagactgatgaataatatttgattagtcaagtttccatcaaatataggaaaagttttaaattgtagctataggtttaacataaatagccaaatttatcattatatgatttttttacttttattgtgaaaatttttaaacatagagtattagaaaaaagtagcataatgattgatacataatcatgagctagatataatcataagtaatattttcccacaatttttatctatccctcctgttctttactgtgaagtacattaaagcattcatttcactgctatatacttcattgttcacaaaatatatacagacctcttcccacaaaattattaaaatttattgtaggcactttgttttttaagtgggagataaaaaataattggaattactatgctcatgttgtttcattgtactgaaagcaaaaatggatttttttcaaagatatttcctcccattttacttttattaatagattctaattccgtcaactttgcgtaatatagaatgatgaaaaagccccttttcattccttctgatagcttttggattccattgctcagagaaagcttgtcttcaacaatatgctggaattgtgtgaagtcttgttatttttttttctccctgttcttcaaagtacaatttcttgaatgtacctgcagccgtgcattatcaggcaacctattttataaattccataataaattaaataagcacctctgtgggtcatttttgattaacctgatttaaaataaaatgatttactaaagatttagagggaggaaatactatgtgcttctaaatcaattctatgcatattcactgtcaaacaattgcatgtaatagtgtattaaatacacttaatagtgtaaaaaaagactcactgcaattgaattaacacttgcaagcttataataatgtttaaaagccacaaacattgaagtaaaattcatttttatccagaaatagaatttgtacatatgacttcctgctatggagattttatcacaggaagatgttcaagatgtttaatttaggacagcatttcttctaagttcagattataaggaggagcattttaattagaatagtatcatgagactcatgtaagcatatgatattacacatcggtattttccctatagtctggaacattactggaatgaaaatttagagatgcatttttacttctccagcacatgcaagaaataatacaacatgaatccttttttattttaggaatgttatacccacaaaacattgaagtatgttttaagttaagcaaacaacaagttttgaccaagaaaattagaaaattaaggttttcttagaaaacaaacaaaattatggcaagaaattactgtcctagtaaaataagatgaccctatatggaccgttgtacgtgaatatttatgtccttttttttttcagtttcacgtatattctttaatgaacacgagaatacagttttagttttcatttgatggcagttttcttcactctccatttcttcaccacctcctcctattttcttccccttttttctgctattcctccactcttcattacacctacatggcttagagttgctggtagattttggtgcccatgctaaaatttgaacagaaggaacagtataaagatgagctgaagtaaatcttgaacacctactattttgccttcttatatcatctcaattgacaaagtcaagattgcagactgccttgacttatgatggggttatgtcctgataaactcaaggtaagctggaaatattgtaagtcaaaaaggcatttaatatacctaacctacccaacatcatagcttagtctatcttaaacatgctcagaacacttccattagcctgcagttgggcaaaatcatctcacacaaagcctacaataaagtgttaaatatctcataaaatttaccaaatactgtactggaaagtgaaaaccagaacggttgtacaggtgctcaaatacagttgctactgaatatgtattacttttgcaccattgtgaagtcaaaaaatcataagtcggtgactgtgctcggttaaaaagtagtggttgctgaccaacttcatttttctttaacagcttcaattgtgatgtcaaagtaaatgtaacttttttcaacaaatttttgtcctttaatacaacaaaaatgttgcatcttaaaagcattttttaatgaaaagaattttaggcttacaattttcttgtaacagtggaaaatataggctctgattttcttttttttgtagtgcacaaaggtaccttttcttagtagttaagttgttttaactacctcaaaatataagttaaaaaataaaagcaagaaacatgggctaaaaatgatattgcaggtggtcataaaccgcagttaaaacatatgtctttaaaatattcacataagattcagacatagcattatacaactttttcattttgccttttacctccaattccatttagaacaattaagaaaaataccttcaactatattatttttatggcataaatgaatttgaacaagatatttcaaaaggtaaatattgaaaaaactctactgcaatgcattttgactcctaaaataggattgtgataaaataattaaattttgatattttaatgcacttgaagaaacacccagcacagcccatttctaaggaaagaacaagttaaggataacataaaatgaagttgactttttgtaaaggtgatcttttcacttttaaaacagcactcaatgattctgccagagacagtgtctacaagtgaaaacttgtttgtatgtgatgggtttgactgacaggttggatcaagttgaggtggggaattggggtggacaaaggagaggaaacaggttatgctattcactcaagtcaatcaaataacctgattgttctttcaactgccttactctgtcattgactgtcaagtcagtcaaaatagtgaaactagttttcgcatgtatgcagagatttattttatgacgctattacctcacccttgtaaacacagacataacaaatatctaagtccacatgttgaaaattatacacaaatattgcagatgtttatgggtgcagaggtatgtagaagagaaaacatgctgaacttaaagccaacactgtaatttcctaatgtttgacttcctatttgacagagactgatataattgatcaagcatacactaagatgcttctttagagaaacattcagcagtatttttctgtattatagtatccaaactagtaatatttacaggaattttatttttatttttgtttctttttttgagacagaggtttgctgtatcacccaggctggagtgcagtggcatgatcacagcttaatgcagccttgaactcccgggctcaagggatcctcccacctcagcctctggagtagctgggactacaggcaaacacaaacacacagctaatttttctatttattacaggaatattacagagagtttgcattaaatagctcagaaaacaaacagatattgtattacatgcacaaacacacacacacacacacacaccctttttttttaatttcaaaaattactttgcccactttttgatgtggttgtttgtttttttcttgtaaatttgtttcagttccctgttgaacaatgagaacatatgggcagagggaggggaacatcacacactgggacctgtccacctgtcccagggttggggaaaggggaggggtagcattaggagaaatacctaatgtagatgacccgttgatgggtgcagcaaaccaacatggcacatgtatacctatgtaacaaacctgcacgttctgcacatgtatcccagaacttaagtataataataaaaaaaaaacttgcaagattaaaaagaaaatcttaacaaaatccaaaaacactaaagtgagtcaataagaagacccaattatgtctgatctcttgaagttactctgctgaaatgctcaagtccaggttaacctcatcaatctaaatggattagcttaattcatttaaacttagaaatagttgaactactcatttttaggtctcatgcaatttacctgtgtgactcaacatcaaatctgtctgctaggttcatttggcatgttttgtccctaagatatctgccaaaccaatgcaatcaacctctcagaagcttttttcatatttaagaactgcttttaatttctaagccttcgccatggtttctgtcatgtatttctcacaaatgacagctactgatatggcagcagctattggttattgggagggagatgggactcaatgttatatagctatgtatcgttttgagattattatatgtacattacctaattctctcttcagaaacatcccgagagtattattactactattactatactccccagagtagtattaatactatactattaataacagtgtactataatgctaatattattactatactatgaacagataaatcagtggaggcttaaggacattaaaggaatggaccacattgcgccaggtgtggtggctcatgcctgtaatcttagcactttgggaggccgaggcaggtggatcacctgaggataaaattattcttttattctactaaaaattaaaaaaaaatatagccaggtgtggtggtgggctcttgtaattccagccacttgggaggctgaggcaggaggatcgcttgaacccaggaggtagaggttgcagtgagctgagattgtgccactgcaccccagcccaggcaacagagtaagggtaagactgtctccaaaaaaaaaaaaagagagagaatggaccaaattggactagctcatcatggtgacagaataggaaggggagaccagtgcttgctgcagtctggggcaccgccattctctccctgtgctgccaatttttcttccttctaggtgatatttatttcaacccgttgaaatcaagaggttattatttttactgacaatttattattgagattccctccatgaagaaagatcaagtttttacttcaaagggatggtaaaaaaataaaaattgtttaaccatccttgtcttaggcttgatggtgaaagtataaattaaagtaaactactgttttatctggtgaataaaaagcttgagctttattaagtgattttctcttggtattgggaagtgtatcttttactctagggttgttacttgaatcacccatgctagacagtttttttttttgagacagaatctctctgtcacccaggctggagtgcagtggcataagctcatctcactgcagcctggatctcctatactcaagggatcctcccacttcagcctcctgaggagctgggactaaaggcatgcaccacctggctaattttgtttcctttttgtagagacagggtctcactatgttgcccagattgatctctaactccagagctcaagggatcctcctcccttggcctcctaaattgctgggattacagacgtgagccaccacacctggcttacatagctttttttaaatacaagagcaacaacaataatataaacgaaagttattcttcaaacgtaacattaacctagatttatttgaagctgaaagtgaatgcaattgggtgtgccaaaggcaatgtgggaaaaacaattaattcctttttgttagaattggacatatgtattcgcaccaaatggaaccattgttagggcatattacttttctattagtttacttttctattagaatcattcaagcaaatctcaaagtttttatctgaaaattgttttgtttcaaatttctttaatgaaaatactgtaaggttggcttccacattaactacacggaaactaaagttactagaaaagacaggttagttattaaattgagaaagacattgaacacttgatggtaaggaattatgcaaacaagatccgggttttcctaaaattagacttttttaatgcaaaattactcttttgcgatctttttatgaaaataattaacttagcctttagcgtatctagattttgattttatgcattatttttagcaagtttctaagatactaccttcataggcaaattgatttttagttaaaaaagaaaacaatttgtgtgattgaacatgtgcttggaagttagtaaaaagaaaaatattgctttatttagaactgggatctactttctcactagttaagaatccttctaggcccattgcggtagcttacacctgtaattccagcactttgggaggccgaggtgggcggatcatttgagtccaggagttcgagacccacctgacccatggtgaaacttcatctctacaaaaaatacaaaaattaaccagttgtggtggtgggcacctgtaattccagctactctggaggctgagacacaagaatcgcttgaacctgggaggaagaggctgcagtgagccaagatcacgccactgtactccagcctgggcagcagtgagtgagactccatccaaaaaaaaaaaaaaaaaaaaaagacactaagctaaaagacactaagctaaaataaaagcctcatattatcttaaaaagtggggaaggatacacacttaggacccctgatgaggtccccttatcctttattgggtgctttaattatatgccttactttattctttgagtttttaaaacctcacctcctactttactaagaaaatagaggtggccacgctggaatcttttttcacctgtaagttcttaatacattacattattattttttttccttaaaatctcaggacagacttgactctactgttttaccccgccgaaaatcccgaattggtgtttctatttctcatcctgtcagccttctctggagtgttattttgtcgtttttgactttgatacctctatttgttttctctccacggattctttgtctccactcacaatctttgatcagcaaaaagtagattattccagtcttttaaattttaagaatctggcctctatccttgaggctctactgaaaccactctctccaacgtcctttaatgttttacccagtccttgttttctgtagctttcaaattattgactatcctgtcatctttggatatttttctttctttgaattcagtaatattatacactctaggttctcttcctatcatcaactttgctgtattgtttcttcttgccgaaattccatttcttttcatcgctatttattacatacctgctatgagtcgagtacttttagtgaagctggggatacaaaagtgactaagaaaatgtcctgctattataaagttgcattctggtgaaagagaaataaagtcaattaggaaacataaataatataatttaagttggtggttaaattctatgggaaagtattataaattaatggagtaggtggccagggagagctatttagctggagtggtcaggaatttcctttcttggtgagtggcatttaaatggagacccttttggcctctcttagaggctgttctataaagtcctgagtagagaaactagtggaagaaaacagaaccagtggaaagagtgagagacaagaatggtgaatctgataaaaatggattctttgatttgtaggagaatggtttgaggacatgggaaatgaaaaggtggagaccatgagttaactgtttctaaaagcaggctctgatatgcttgagatatgcgatattaaaaatgcggatattgtgacacatttgtatgctacatggaattacccaggattgagggaggcattacctgtgcagaaagggatggtaattgttggagtgaactccagcaatgttggtgctcttggtattttgttggttgtttttgtcaataatgtgatggtgatggtctaacttgtactttggtaagttatatgtatgtctatgtctttcagtagattaaaattaaaatatttcttactcttctttgtcctgcccatgattgccttttctaacatctagtgcagtgctcaaaagtgtctgtagattttggttgcctcatcattttcaaaatgtttctgggtttaagcctaaaattatatatgatttcatttaatgtgaacaatggccttcaaattaccaataccagttgcatctgaggcatattgaagagctttaaatccaagttattgtgtatgaaactagtgcttacaatataagcaggtggaatacatttagtctacttatatggaaaagctaaaggggaaaaaagtccacaaccgagtcatataatagtttttaacctaacttcctggtcagttttcagctctgcatagctactctgattgattgttgccccatcaactaatatgtttgaaaattcaaagtgaataataccatgaacaattcagtaatatcaataaggtgaagcctgattgtattatttttggaatatgattaaaataatgcaaaagaaataatccttgcccccccctccactttttttatttttgtcttcagcagttctgtggtttacaggtagcacatctgaagctgttatgcactggtaaaaccaatgtggattacaagaatacactattaggccctggtgacaggagacaaaagcaacatctgcttcctaggctttctgtgttacagaagagaaggcctgcccatcactatatgtaaaatcactgtattatccagtgcctggaatactcatattaggatctagaagctagttgggatttaattgtatttcaaattttagtataatactagtataatacttttatatcagtatcccatgttaactgtatatgcactttattattttaatatttaataattgaaatcaagtcttatgtatttatgtaaatttttatatgttacattcatatactgatgtttatatcaatttagaaaagaaaatgtgagcaattaattcttattaattaccttatatctggttttcgctcaagaaaataatacttaaatgaaatgaaatttatttgcttctaatgtctacataaaagacaaaatatccactagtgaatccacacagcatacaaatatatatgttaaaatttgcacaacttaaaaatatgcatactgtatttgtgtttctgttttctaaaataaaaaccttgggatttataaatattcctgaagaaattccttgtatttcctagctgaattagttctgagtttggcatttgctctttacagcctaaccagggagtggaccattagttttcctggagctttgggactttgggtttttgcctttggaaattaaatatgtaatattgctttgtctgggctggcttaggacaggatcctcccttcattccagggcaacgtcaaaattcacagaagagcaacagttcatattgtctattgaaatcaaatctgattcttccccctcccatctcccacgcctgcccttgggattgtgacatcattaccatctcaagaacccctagggttgttttccctgttaaaatgaagtgagattagggttctaggagagagcagtcaaatatttgagcactaatcatgcctggatgtcttttactaattttcaggcagtggaattcttttggtttcaagattacaccacagtcgtttaatgtaaatgtggacagaaaagaatacaattaggtgaatcgcacagacaatctgcttttttttcagcaatccttgaaatgaaagatgcatatattagaaggttatctggcatatgaaagggacatttatcccccaaggagagaaggaaactacttaaaagaaataaggttttattaatatttttcaattaaatgttgcactttctttatccttttgtaattttcatgttgacctatgtaagtgctttgttcatgtagcattcactctttcttggcaagtcatcagatggagcaagtttattgaaaaagaaacagaattaaaaattcaatgacaaaaattcaaatagtgtctgtttagagcttatcttcttaatgttagggcttttatggttattggttggggacttttgggagtgtttcttaatgctcaggtgggtgatgccagtatcaagggaagcaatggcgttactttaattccaagggttttgatgattgcattatgtttaagcattgtgaagatatatatataattttagcgtacaaaagtgaagcagttttgtgattgaattatttaaattagaaaagacagaatagcacaatcatacaaaatgaaaggtgctttctttatatcttctcccaaaatatggttaatggaaaaacaattactttttattatattttggtcaattttgtaatctatggtgataaacaatattcgataacctttattaaaatacatatttgggagaatatcatacatagaattatgactaatcatgaaaggctgaacagcattcaatgctattgtttttaaatctataaaatgaagaattgctgcctgacctgcaagatttcatccagctctaaaatcttatgcattctataatatgagaggagaatatttttttttttttttgagacggagtttcgctctgtcgcccaggctggagtgcagtggcgcgatctcgactcactgcaagctctgcctcccgggttcacgccagagaggagaatattttaatgatgtcaacagaatttacctaaacataaaatatgaatgtgaacctattatacctttatacattcctttttaatgaattactcaaaattgtgatatcatatatcagcaaaataataaattcaactatatattaaagagaaagtctcagatatttcagaatacttatttaaaaatatttctaccatgctttctgccaaaaatgaaatgtaattcaaaagcatccattggaaaaattaaacctctttctgccagaataatctagtgttagcatttcatgccttcttaaaaacagattttatttttcaaatcagtttgaagtttacagtgaaattgagaaggtatagagatttcccatatcctcttccccctagacatacataggccccctcactatcaacatcccacactgacgtggtacatttgttacaactgatggacttacattgacaaatcattttcacccaaagtccacagctgatgttagggtgttgaccaaaagagtcaaactctgtaaaatatttgaagagatttattctgagccaaatatgagtgaccaatgacctgtgacacagccctcaggagaccctgagaacatgtgtccaaggtggtcagggcactgtctagttttatacattttagaaaaacatgagacattaatcaaatacctgtaagacgtacattggcagttctgtctggaaagtaggggcaacttaaacgttttctaattggcaactggctgaaagagctaagctattatctagagacctggaatcagttgaaagaaatgcctgggttaccatgataagataagagttgtagagaccaaagttttatcaggcagataaaccctctaggttgcaggcttcacagagaacagacggtaaatgttcatcggacttaaggtctgtgccagtgctaatgctggtcagcttttcctgaaatctgaaagagaggagggaatgatgacgcatgtccaactctcgcttcccatcatggcctgagccagtttttcagggtaacgttggaatgccctggccaagagaaggggtccaaccagatggttgggggtccttaaaattttatttttggtttacatgggtacactattggttggtaggcattctatggacttggataaatgcataatgatatttatttactcttctggtatcatacagaataattccactgtcctaaaaattctgttctccatctattatccatcctttccactaacccttgccccctgaaaaccactgatcttttttaactgtctccatagttttatcttttccacaatgtcagacagtatggaatcatatagggtagccttttcagattgacttcttcagtaatatacatttaagtttattccatatttcattgtggcttgataaccattcctttgagacaaggtattgctttgttgcctagattgcctaggctggagtgcagtggtgcagtcacagctcacagcagcctcaacctcctgggctcaagcaatcccccaactccagacactggagtagctaggactacaggcacatgccaccatgcccagtgctttttaaattttgtatagagtcactgtctcatcactttggccaggctcttctccaattcctgacctcaagcaattctcctgccttagactcccaaagtgctgggcttataggagtgaccatcatgcctggccacttgacctttcttttttttttttttttttcatttttcttttgtgtttttgagagtgtcttgctctgtcttccagggtggatggcagtggtgtgaccacagctcactgcagtctcaacttcccagcctcaagcaacctcccatctcagtcccccaagtagcagggaccatactgtacgccaccatacctagcttttcttttctttttttttctttttcctgtttttgttttgttttgttttgtgtgtgtgtgtgtgtgtgtgtgtgtgtgtgtggtggtgataaggtctcactatcttgcccaagctgatcttgaactcgtgatctccaatgatcctcccaccttgggctcccaaaatgttgagattataggcatgaaccactgcacctggtgatagctcctttttaagtgctgaataatattacattggatgtaacacaagtccatatagtgtatctatctattcacctattgacatgtcagttacttcgtagttttggcaacattatgaataaagctgctataaacatctgtgtgcagttttgttgttgttgttgcttttcagctcctttaggtaaatgccaaacagtggaatttctacattgcatcataaaagtatgtttagttttgaaaggaactgccagactgcctttccaagtggctgtaccattttatcttctccccaacagtgaatgacagttcctgttgatccacatccttgtcagcatttggtggtggtgttgttctgtattttgcccagtctaatagatgtgcaacggtatctcattgttttgatttgcatttacctgacgacatatgatatggagcatcttttcatatgcttatttgccatgtacacatcttctttgataagatgtttgtgaaagtctctgacacaatttctaatcagatttttttttgctgttgagattttagggttctttatatacttgcataacagtcctttatctagtagatcttttacaaatattttctctcagcccgtgtttgtctattcattcgctagacatctatcatgtagcatatagtttttattttaacaaagtccattttatcaattttttatttcctagatcttgcctttgatgccatatctaaaaagtcattgacaaatccaaattcatctagattttctcttgtgccgttttctggaagttttatatttttatgttttacatttaggtctgtaattaattttgaggtaacttttctgaaggaaatctggtgttagcattccatgcctttttgataccatttatccctgaaaataaagtctacatcattattattttccattttgccaatttgattgggaattcttatgatttaaaattttcttaatagctttctattaaaatagatttgaatgaaaaaatatttctatgaggaacatttacatttctaaatatttgttttaatataactccaagtatattttaaatctaattttcttttttagaaacagagttcatttagtaggctaaagctactttcctaatactatggtaatatttaatttttttataaatataatttgtatgagtttgggcctttttaggcaaacagaccaccttggtcctctacatatactttctcccagtgtatattcagtatccgctatgtacatggcatcatagtgacgtagatgtttacactggagcaattctgttttctcctctacttgcagatagaggaggtggcagatatcttgagcaattatcattcatttccttgtgtctctaaggatgcacaatcatcccttggttccaggaccgcccacctccccaagaataccaaaatctgcagatgctcaagtcctgcagtcagccctgtggaatccacagacacaaaaagtcagtcccccatgtccttgggatcctcatccctctgtgtctggaattggtgggttcttggtctcgctgacttcaagaatgaagccacggaccctcacggtgagtgttacagttcttaaaggtggtgtgtccgcagtttgttccttctgatggtaggacgtgttcggagtttcttccttctgttgggttcgtggtctcgctgacttcaggagtgaagctgcagacctttgccgtgagtgttgcagctcttaaggcagcgcgtctagagttgttcgttcctcccgtccagagttgttcattcctcccggtgggcttgtggtctccctggcctcaggagtgaagctgcagacctttgcagtgagtgttacaactcataaaggcagtgcggacccaaagggtgagcagcagcaagatttattgcaaagggtgaaagaacaaagcttccacactgtggaaagggaccccagcgccttcccactgctggctcaggcagcctacttttattcccttatctgaccccacccacatcttgctgactggcccattttacagagagctgattggtccattttgacagggtgccgattggtgcgtttacaatccctgagctagacacagagtgctgattggtgtatttacaatcctctagctagatgtaaaagttctccaagtccccactagattacctagacgcagagcactgattggtgcgtttacaaaccttgagctagacacagggtgctgactggtgtgtttacaaaccttgagctagacacagagtgctgattggtgcatttacaatcctttagctagatgtaaaagttctccaagtcctcaccagattagctagatacggagggctgattggtgcatccaggaatcccaagctagacacagagtgctgattggtgcatatacaatcctctagctagagataaaagttctccaagtccccacctgactcaggagcccagttggctttgcctagtggatcccatgccagggccataggcggagctgccagccagtcccatgctgcgctcctgcactcctcaacccttgggaggtcgatgggactgggggccatggagcatggggcggcgcccgtcggggaggctcgggccacgcaggagcccaccacagtggcactcgggcatggcaggctgcaggtcctgagccctgccccgcagggaggcagctgagacccggcaagaattcgagtgtggcgcgggtgggctggcagtgctgggggacccggcgctccctctgcagctgctggcccaggtgctaagcccctcactgcccggagccgtcagtgccagtcgcccgctccgagtgggcccgccgagcccacgcccacccggaactcacgctggcctgcgattgccgcacacagcccgggttcctgcccgcgcctctccctccacacctccctgcaagcagagggagccggctccagcctcggccagcccagagaggggctcccacactgcagcagcgggctgaagggctcctcaagcgtggccagagcggacaccgtggccgaggaggcactgagagtgagcaagggccaccagcacgttgtcacctctcacctcgaatactgtatttttgacccactgttagctgaatccagtgatgtggaacccatggatatggagagccaactgtatagttatttgattaaatttatacttctttactgcctttcagaaaagttgacatttctgctgaaaagaagctgctaatctttacccagatagaacagagaaaatcagagttgaagggacatgtttagggaaacttgtacaatctaactttataaagcagcccaagtgtcacatgaaagtgaaaacacacaatgaaaatgagcatcagcctccagtaattctaaattttatctacaagtgtattcacaacttactttttgttattttttctgatgattagccaaaggtcagggatgattggcaggtacaacagttcaaatagaagtagttcacaaactgcctgtaagcctttcttgataaacagttttgatgaattagtaaataaagtgttttattttatacagaaatctctgtactttttcatatttgatcatttgtgcgtccagtgacatattgtagacatatacattcactgaacttattactggttgccaagatagtaatagcaaaatctcaaaagctgcatgacaggaattattcaaatagttctatatactgataaatcaaggtttaactatacaacaccctctagtccaatgaaagtagaaattacctgtgaaaattacaatttattttgaatgttcacaaataatcttatctttttatttgtaagtttgactcaaactataaactacacaaataaaaaagtaaaataattatagtaagtagccaaattttattctagttttcttgtttcattcaaattcagtttgtgctccttaatgataacactattgtcaataaaactttacactttaagtgactttccacagttttcccatctgataagaatggtactgataaataaaaaacaacatgcactatccatcttactttcatagactagagataaatcattatgaaccccaattggcagaggagaaaattcgggtgcagacaagttaagtcaggtggcagattcacacaggaaataaatagtggctatgctcgtataaaaacatcaatcttctgacctctaattcagggcttttccagcactgcagtatgattaatcaataccaggaagcaaactaagtatcaagaaaagatcatccatttgtatcagtctttcctttatgtggttggaatctaaaacaccaagtgcataaaggaatcaaaagtcggaagctttgaccatttgtgaacaatcttttctgtattattaacaggtctgatgataaacacagacatttactaggcccaaattgtgaaaaactttgtagacattttgctaatatgcgggaaataagctctttcttttagcaacttactttgattttcttttatttttatgctgctaagaaagcactcagatgcatgctgaaatatgtattaccttatggattgcagctggcagggactattagtgttaaagattcacacatttgaagtaagattggatacatttatatttgtgtcaggaaaaaaataataatagaatttaagaatttaaaatgtaaccaaaaggcagaatcatggcttttggctgaagagattagcagcattcttctctgttccctttttttctgaagcttagttttctagctaagttttggcaaacaaaattcttttctgtggtatgtattctattttaacatcttccactgaaaagaaaagataatgatataaataaagcaatttaaatcaagtctaaggtataggaaggtatttaagaaagaagcaaacattctctagatgttgttatccaaaatatattctcttttgcagtttactgaaataatttcttcagtgtgtgggaatttcctttgcatccagctttactatagagatgacatcacaccaacagtgacacgacttgtttacaagagggtggtataaacagcaaatgttcttccttaaaacagatttcttgttgaacttcaacagaaaaagaagcgtaaatgtagaaggaagaacaggagatagtctttaacatgtagggtaaaatctaaggtagaggagagagcagctgataatgtttttatgtgtttgctactttattaggaagtctacttccttcttttccatatctagtagagtcttcaagttgtacattgtctttatattaatatataatggcctattgtactatgtcttaatagtttcatatcttccctggtttacatgaattaaatgagagcggtaacatcagaaaaggaaagagagagagagtgaatatgtgtgtgtgtgcatgtgtgcgtgcgtgtttgtgtatgtgtttctgtgtctatgagagagagagagaaaagacagacaatgaaaatgaaaataaatatcttctccaacctatcttagccaactttctgatctaggatgttaggacagtcactcactgaaggaattttagttatagcaaagcgtcatccatctttttcaactgtgttaactttaatttcccataaataataatagtttgcagaatacatctcagattgtacctgaccatattgcaaaataataatttgcttcttgtgtaagaatcattatttaagactaaataaaactaggtataagtaaaataaattaaattcagccctttgaataatcatttagatcatgactgctaactgtagtctagtactaattaaagacctacatggttatttttcttagaacgtgagaagtcttaggagcaactgtttgaacaccctgatctggagggaggagtccttaccaggagatttctggagctgggtgtggagggtagttcagtttccacacattagcccataagagaaaatcatctgggtaaaatagggtgactattctggacacggtcatggctttgctactatagtcccctccatttttcttgggagatgcattggtgcttcgcaaagctgtgcagtcattgaaggtgctcagcactggtttttgtcattaaaatacttgagcttgaaacccagcactgtcaatttagtgagcgcggccttacacaaagttatctaatttctctaagtttcagtgttatgatctatgacacaggttagtaatccctcctttataggaatgtttaacattaaataatgcattaaaagcactttagatactattaatctcaaggcaaatgtcatgttatgtggtatggggcatataagtttccctggcattctcaaaacctgaaccctacactccagctcaaagctccttatagacaaggaccatattatgaaattctgttgtgtttttcatagtataggatgtacacattgtgggatttcaaaattggattgcttcttggtatcaagtatccaaattgctcagagccatagtagtaaaacaatggagaaacagtagtgactgtatcattataatatacgtaagtgttcatgttagtttgcttaacatttattgaattcctgatacataaaaggcctcaggctaaattttgtcaattatataaaagtaccttttcctcaataaaggcaacttactggaagaatcatgttttagtgggggaaattaacatataggctttataaacaaatgaattaagtgctaaagagatgaacaagacacatattgtaagatatcagaaggagaaatgataggggaagacagtagttgtcaggaaaacatggtaaaaatacaactgttggacttaggaaggatttcagtagtttaagagacaaaaagataggaaaacgtttagcatgcgcaaagtcaaagtcagggatccataaatatcattgggtgtgtaatgaattgttagtagttggatgggggatgctaaaatataaagtgagagatccttcatatattttcgtttcctacccttagttccagatattgatagagatattttagaaaatcccaacttaaggccaggcgcggtggctcatgcctgtaatcccagcagtttgggaggccgaggtgggaggatcacaaggtcaggagatcgagaccatcctggccaatatggtgaaaccccatctctactaaaatacagaaaattagccagatgtggtggtgcgcacctgcagtcccagctactcgggaggctgaggcaggggaatcgcttgaacctgggaggcggagcttgcagtgagccgagatcctgccattgcactccagcctgggtgacagagtgaaacttagtctcaaaaaaaaaaaaaagaaaaaaagaaagaaaagaaaagaaaatcccaactgaagtatatgtgaacaaatgaacagctttttttttttatcaaaaaagcaaaggtctttgaaataattttattcagattttgctcacaaatattatatttccatttttatttaaaattatgaggatgatggctaaaagtaaaatgaaccaagttttgtgcatgctgcattttaacaagttgggtgtctcattggaatgcactgccttcttgttccacatttatttttggaatttaataaggcgcctgtcatatctgcctcaaggctaaaaaacatcatgggggagaaatccaaagtactgtcatgtttgagtgacatggagccaattttattttatttccttttcatggggggtggctcaaattagccaggctcacttctgaaaacgcattgctacatcatctgttctaaaggccttgtgctggttaacgggtaatgacattgcccagtgacatttgttaggtagatttgactcagaaaaccaggggaggattttcattaaaaaattaattctgtgcattttactgcaaagctcattctcatgatagattctggtacagtgccacatatctccagaattgggtctggttacgtgagaaactttggaaggtaataacttctttatttcttctttgtgctcccagagcacataattaacgtactgactcatttagctcaactctccaaaggatgaagctgtgtggatacaagggagattcagagaaactggcaaacaagtatggtttctgattctcattcgagtgagggaaaaactctgccattttcttcttctttcttttaagttgatgtttagtacaatgtgactgtgtttagcagaacataatatgttaggattacaatggaaccatcatatttttaggaagtttaagtgagacttgggatagatgtcacagaatgatgttgccatggctgagttagtcataaaattagaaatcacagtaagctgaaggatgtctgaggcataaaaataaaccatgtaccatgtaatgggtgtgttattgtaataactaagataagcatttcaaatgttttactgattaaatcagaattaagtcctgtgttttttagtagtgactatcaggaagtagattgtttaaataacatgaacttaaaacatgtaaacatagtaatttttatgttaaaaatatatagtgtagacaaaatcaataatttgtagctagaaagctctttctaccttcatttaggacttcctgcctcatgggtaaatggaaaaggaatagtaaatctaagcaactttttcatgagtttataccttcttaggcacaaagagaaatctgtgatctcttccctgtatcctagaagacctctgcgacaggagtgagaattgaatttggttacaaactactgagagtgtatgtgtatgtgtgtgtgtgtgtgtgtgtgtgtgtgtgtgttttgcatgttggctaagtatggaggaagggaatcattgtaggaaaatttaatcctgagattttgtggctacactcactttaaacccaaatatgtgggttggatcaatccttggttatatatgggagatcacttagtggtcaggccaggtctaaaccattaggtattgagccactatggagcaaacaaagagaaacatgagacttcaaaatgagcccacccccatgttaaacgtgctctacacttcagcatgctccagggactgtgaatcagaaaaagtcaactgcattttgaagtgtcggcacgtaacattttcttttcctttgttatggaattccaaaactatactgtacagattacctaatatattctgaaagctatcaagcaagcaatgtaacactttttttgtggacaatgattttaattaaataaatgccatttcttggagacaatttacctcttgagtatagctggtcttcatcttattttacacaagctatctcttgggggcataaatttccaggcaaggaaacaggaaaatttattggctatttgatttacatgtttattgggctctccaaaggctttactatttaactggtcattgaaagtagaacaggggtggggtggattatattcaatttaatggaagatttaggtaaagtcttttgaaggaaaaaatatgggtcaacttttaaaatatttcactttcagtaaacaattgtatctattattttagtggctatctaccaagagctgaatcattctgtacagactgaattctttagtccatgtctcgagttttaagttttccatgctaagaagtgctttaacttaaatgtgtcaataatgatgctgctgtggaattgtgtcatactattcccacgagcagcccagaatagctcccaggcttggagtctaatctttattcctggaggtggcaagagtaggttgtcatggagctagtggagaaatcagcagactctatttatgtggcgagggagaggatacagtctttcttctgtaaaattttagaatgaggctgttccgcaaggacattagtctgagtgctttaaaaaaagagcgtgtactctacacgtggaggctcaataaagtttgtttacagtgctgagagtgattccatattcacatcccaaatataaggccagttgccatccttcaattattctctcacaaatacagtggctcctcctctcttcagtaagagtaattgtatcagttagagaatatttcctttactaccaggaattctgagaattagaatcctcttccttgacggaaaggcactagattgacaattttgcaaatgcacgtgctctctttttgctttaggttatcattcttgcggaccatttcccttagtatctcgaagcgtctgactgacagggtttgaatcccagatctgccacttacttactaatcctttgaaactaagcaagtaaaagaatgttattaaattcataatactgataggaacaggatgcagggagatcctgggcagaagacagtgggtctctggcgagggccccaccctcaagctgaaaagcctggaaccatggccaaaagtaagagcttgcatccctgttttcctgctcgaatgttgcctttccacccacagccccaccccacccccgtcctgtgcctgtaaaaaccccagagctcagccagcagagaggagaagcagctgaatgtcagagactgggatggatgttggagagaagtggtttgacttcagagggacagcttaacggtgtagcttcggagaggagtccggtggggatggcccgactctagaggaagatcaccttcttgctccatcccctcttcacctcccctttctgctgagagccactttcactggcaatgaaatcccctgcatttaccatctccagttagttcatgcaacctcattccttctggatgccagataagaactcgggtgccacgagtgtgggtgcaaaaactgtcacactgaccctccgctgagctgttaacactgaaaaactgtcacactgaccctccactgagctgttaacactgaaaaactgtcacactgaccctccgctgagctgctaacactgaagccatctgcagatggcaaagctcaaagggttttgtcatactccgtctggggcttcaggggtcgcgagcacccccctggaggctgtcgcggggcccacatggagttttgctcctgccagcacccaaaggtgctcaccccagctcctgcgctcgctcacctgcgccccctcccttgaggagtggaagtgagaccaaccgagtgagtccagcgcgaaagcagccagcgaggtccagggcctgtgaggtccagggcctgtgcgctccagttcccgcccacgaagggggcaggaaatagctgcttcaacatcacttgctcttttttttttttttttttgaaggaagaattcgtaaaataagtttggagatcacttgaacataaatattttggaatatgagcccactcataaatgtgaaagtcattacttttattttttaagacagggtgtcagtctgttacccaggctggagtgcagtggctcagtctcagctcactgcaacctccaccgcccgggttcaagcgatcctcctgcctcagcctcccgagtagctgggactaacttctgtgtttttagtagagaaggggtttctccatgttggccaggctggtctcaaactcccgacctcaggtgatccaccagcctctgctcccaaagttctgggattacaggcgtgagccaccgcccctgcccacatttttgttttaatttgggtttttgtcacagtgagaactggaaaaaaacaaaaacaacaaaacaaaacagaaaaacctctgctgaattacctgtaaacgaccttatgataaaatattctgttttgtcttctctgtatatatattttttacaattgctttagtttcagataatattctgtacaatttgtaatttagagataaataatcaaatattcatacatatatgaagcattaaagaaaaatttcaaaaactctgaaacgtcatggcatccagtaagaacaaagtttctgtaggaatttgcatagaaaaaggcagctggacttaacatagcatctcacggcacctttaagaggtccttagctatagcagccagccctatcttcatattgcaagagataattagtttcagctgaatactcccatccatcactttaaaatgagatattgactcaaattttagaagttacaactttttttttatttaaaaatgttatagttgcccaagtacttaaacatacaaaacttaaacctagttatatatttgctaacttaatttacatttaagtaatgtaaaacaaatatcagtcagaaatcagagtgtttcttttaaaacaattgtcttacaccaatcaaatttgaatatagctactatattttattattattattattatataggacccatatgcataaatactgaaaactaagacctggctataaagttactaagtgttagatttaatgggttttttttttcctgattttccatatgtataaaagttttacttgaagaactctgcatttaaggaagcatccaaagtaatttttttctataaaaacacagaaaaactgtgttatagcataccagtaatgcacaaggagaaagtcatattacagaattaaaatattgctattacataaaaaatgctataagattactttaaaacctcctacctagattgcttcaactgcaattcagaataacatattaatttaaatctagaaaggcctagaactgaattctgtctcagcttttgattgattcagttttcattcttggtcaagttatttaatattgctgaattttagctctcctcatctgtaaaatggagaccctaaggctacctggtaagatcattttgaggattccgtctggtattgtgaaagatgcctggtctgtgctattccatactgggcctccaacagatgtttagcctttttcccattgtctccatagtttcataaatggaaatgccttttcccttcccctttaatatccagcctccttcacaccttctcctgctggcgagacgttgttaggttccatatatccagccagtcaaagtctgtgtgtgccatgactgagttgtacacataaaatagcagctgaggcagacacggtctttttttccccggaatcacacatccatgtgttaactgactgtcttagtctcttgtgttttgctaaagcagaatacctgagactaagtaatttacaatgaagagaaattgatttggctcgcagttctggagtttggaaagaggagatgcatctggtgttggccttcttgctgcagcattccctggcaaaaaggtgggagggcaaacaagctcacatgagagatggagggtaagggggctgaactcatctttttatcaggaactgactcccactataactaagtcactccatcataatagcattaatccattcatgagggcggagtcttcatgacttaatctcttctgaaagatcctacttcccaacagtgttgtagtggagattaagtttctataacataaactttgggggtcattcaaacatttcacccctggctctccagggttgcagtctcatgtctgcagctttctcaggctgcagttgcaatctagtggccctgcagttccaggagctcaggggctgctccactctcaaggcttcactaggcattgccttagtagggaatctctgtgatgaacccacccctgtggcaagtctctgcctgggcccccaggctgtctgatacgtccttggaaatcttagtggagattgtggccattaaaccgtggccccacagctcttccattttagggacctgcagatttaatatgatgtggacatcgccaaggttttcagcttgtatcttctagagccatgggtcaagccacacacacctggactcgcttgaattacaagtgtggtggccaaagggtgctgttttggaattcagggagcagagttctagggcagtgcagggcagtgaatgctgtggtcttgcaggcacctctctcaaaacgttgctctcaacgccctagcttgcttagaagatctcagaattgcctgataagatacggtcattatctctttatcctgatgaagagaatctggctttcttctgtccatgttaattactttaggaaagggttgcttagccacacccttagtgatatggatttgttgcgtcccgacccgaatctcaccttgaattgtagctcccataattgttgttaggagggacctagggggagatgattgaatcacgggggcggtctcccccatactgttcttgtgttagtgaataagtctcacgagatctgatggttttacaaggggtttccactttcacttgactctctgtctgtctgccaccatgtaagatgtgctttcgccgtccaccctgattgtgcgggctccccagctgagtggaactgcgagtccgttaaacctttttctttatgaattacccagtctcaggtatgtcttcatcagtagcacgaaaatggactgacagacttttttattatttacatggccagcctggaaaatttcaaaatctatccattttgcttccaattataaattttatctttaaattattttttcttccctaattttattgtaagcagtcaaaagaagccatgtagcactttgaacactgtgctacttagatatttcctcagccagatatcctagtacattgctcatcagttttgcctttcagtcttacgacgtgaacattattctgtcaaatttttgcaactgtataataaggatttcctttactccattctccaacactttcttcctcatttttgtctgagatctcatcagaatggccttgaatattcatatttccagcaacattctgatcataaccacttaagtaatcccttacaaaatttaggctttccctatatctcttatcttcttatgagaagagaccactcttttttaaataaacaaacaaaaacaattactgactcagcaacaagatgtgtgcatagcttattcatgaatcaattcattccttttaaatgacacttgatgcatttgaaagagcattttatatatcattattaaattagaaatagaaccaggcgcagtggctcacacctgtaatcccagcactttgggaggccgaggcgggcagatcatgaggtcaggagatggagaccatcctggctaacacggtgaaaccccatctctactaaaaatacaaaaaaattagctgggcgtggtggcgggcgcctgtagtcccagctactccggaggctgaggcaggagaatggcgtgaatccgggaggcagagcttgcagtgagccgagatcgcgcccctgcactccagcctgggcagcagagcaagactccatctcaaaaaaaaaaaaaaaaaaaaaaaaatatatatatatatatatatgaaaaataaacagacggttttaataaatgaattccaacctgtttagaaagagtactctatttgataaaataatattaaattaatttgtatggctagctgtactaatttcaaattatgctcttttggaaaaaaatatggatgtcccaaagttaacattacaggtatttgtggggcattttaagatctaagttaaagagaactaggaagtgttctaagtaaatttctgagacaccacagggtaagggttctcagctagcatgtctcgtgttacttcagatggctgtcagatgctcatatctgattctgtaaaaagtggattatctctgaagtcatggtttcaacgtgcaaattttgattttactgagaatatttaaaagataattgtggttcctaagagacttttaaaaaatggatttagaaattaactgtaaaagttcaaggaagccaagcaagcatttctatgagttgaattatgtatttaaatatacttgtgtggaaggggtatgtaaagtcagatcagctagagaaaaatgacttctcaagaagttattcacataaagacctatgtgacataacctgcaaagtttaatattcactaaaagctctattccaaaaataatattaaattttatcatcttttaaaaaaattaaatctggtattcttaatctattatgaggtgtctgtcccaatgtgaaacaaagttttccctaggtgggaggactctacatctgcttgggcaatggaaatcatatgatttgagtgatgggcctggatgagtttaaaatcatgaaaagcacaattattttcttctttgtcaatgagaaataccaataaatgtcatcagagaggcaatggcatattcttgtgttctaaatatttgggtcatttccataaaaaggctgcagttttcagagacaaatgtgaatcctgaactctagaaccagatcatattcataccactagaaatagaggtaaagaaatgacctagaattatgaatataaactgatattatttacgaacctctaatctgtaatatttgaaatattttgttcaaaataataaagaaaaagggtatatcttggacataatttttcttatgctattctgtttttatactttgcttgagcactgtaaggagactttggcaaagtagtcagcatttaattcatttgaaaaggtaatgaaaatatttttgtttttcctttaaagatatatagcctgggcaacttagcgagaccctatctctacaaaaataaataaatatgtaaattagccaggtatggtggtgcacctgtggtcttagctactcgctgaggtctgacaatggcttgagcccaggagcagttagaggctgcagtgaactgtgattgccactccactagagcctgagtgacagagaccctatctcaaaaagaaagaaaaaatagttttctgctcttctagtgaatagtgatttccacattaagtcaatgtattcattttttaattgaatcaatacaaagcctaatttgtctaatgcagtagatattttccagagagtaaacagaggaagcagctttacaatatattaagcaattaaaatacttctttttttttttttactttttgagagaatgatgattttggacccctctcctatggtggaaacttaacatctgaaaactgaagtacaaaatattctttttttagggtcttacatgatgttgaagttgaatacctttcggaactattagagaggtggagaaaattgttccactttttaaaatttggttttattataagttgtgtttattcttaataatctttagtttgttgtcaaacaagattgagaagttaaagcgattctgatatcacatttgttaaaggcccactctgttctaggcacttatttcacttacttttatttaaccattatttccatattgaaccagcattttctcttgacataaggggaaactgagagtcaaaggggttaagtgtcttgctccgagtcacccatcaaaaagtggcagaataaaaacaaggtcagatcttctgacacaaggtctaatgacttttccattcaacttcaattgccagttttgtgtgtaataggggcaggttcctctatctgtcttttctgagagggaaacgtattccgaaatgtaaagtttaaactgtgctgttaaaaggaagaactagagaaggtgagactttccactaagattccaaagatataggaaagtaaattttagattaacactggggagactggattttcttttggtaaagggacagagaaatgtaaggttacccagtgaaatatgaactcagaggaacaaaaatctatttggaggttttgaaatcaaattaagttacatgagtccaaaatgttgagcaagcctttcttaaaggcacctgtaaatgtaaagaaaaaagttggtaaagtgaaaatgataagaattcataaaatcagcattctgtaaagtgcgtgaagttttaaaaccaattcaactatgagtagatgtcatgtaggcagggaatatagtaaagccccattctttggagttgctaaccatgtgaccacaaatctccactgccaccttgtggtggtatgtatatttcagagacaggctctgaagaaaattgacctctgaagtgctgagaggtaaaataaaaggtgtctggtggtaaccaacctcccactttctgaactcaggaaccagacagatttggggaacacaggatccctcttttggagttactatccaaattcctaccatagcaatttaggagataccatagatttggagagcagggctattatacagacatcacaagggtgaaaaccttgagcaagagtaggaactgaattttctttcagattcttttgtgttcatggtggaggaagatattctattttcaagaggatcctaaatatccaatgcagttttcatctagaaaaaattttaatctattctgtataaagcaatgaggtaacattctcgtcaaaggaaatcctatgggtatgtgagaatggaaggcttccagtcacttctttacatttagttgcattcataaacgtgaccaatggtgtttctgtctagagcttaatgggttacttccgcttatacaccagttgtgctttcaactctgagcatgacatcaggaaatgtgtttgattccaaaatgatcaattacagaagcatgtgatagctaatgtgcctgtaaactcattaaccgaatgaagccacctaattgtcaacagttcaacagaattttgtctgcaggttatttgtttttaggtgtcagtggtattcctgttttaatttcgccagcagaagtgggattaatagatcaaaatagtattacagcacatgacaatagatgacaagcaaagacaaatctaaaattattctgattgatcattctataaatgtaataaaacatcagtacttaagtgtagtcatcatttattttattttttatagtgctcaaaaatatttataatgtatctgtgctaaaaacaagtctctaccaactgcataacatgtaatttgagcaaattatttaacctcttcccttttatgcacaatgaagataacattaacatcattaagaataaatgggtaataaaagtaaatcatgggacattctcaataactgtgtgtgtgtatgtgtgcatgtgaaaactataaacaaaaaaaaatctcttttattcagcagaaacatcttgacatcttatatcttaataaacctgcaagttaaataagaggagggcttaagcattagtacaaaaaactattatacagtgctttatttgtggagaatattgatggagaaaggaggaaagaggaaaagcctattcccaagagaggcttctgcgaagagcagagcatgaaaccaaggctctcgaggaacaccaaaacaaacaaactctggcagtgtctgagtaagccagccgtctttctctcaataatttttattgtgcacccagtgatttctcaggcaatttttagagccttttggaaagtggtctccaaattatgcactaatacaacactgctaatgaaagccctcattgcaactcattagctctcacttttttttgctaatccacaaattctgtcctatgtggtggacacctggcagtacacccctcagccccatatctcagcagagatgtaattgccaaggcctggagcgaggtttcatattacctagacgtgtggcttatgcaagctcttccatgagactgtctgttgtcaataattaagagctatcaaaacacttggctaatttacacttgataatctgaaatgagggcccctgtgatcaccagcttctgtcttattatttaaatacacatagtataaaaaaagcagaatggggccaaagcaagccgtatcagggaaaagaccggctttccagcaaacaagatatagcccagtggttgtaagcaagtacagcacaaggctgaacaaacatggcccagtgagtgctttttatggctgagaagcttcacagagcaggtgggattgtagaggatcttttgaacactgagatgtggggacctggcaaagtttaattggcaagctgttgtagtcaaatgcagagaccatgaaaatgggcatgcgttatggacatgagtagggagctcgcatggtatttcaaaaagagtgattgctagaaataataggaaataactatgtatgaacagaaaagaaataaaaccattaatttttaggaagtgcaaatagtcaaaataaagaagggcagtgcagtctgtatgtaaacagtgaaaaaccctttgcacagttgtacttgggttttcagcaacattagcttagcataggaatgactgcgtaactaatctcattatttgttcagaattcagggcatttctgattttctaattccaacttacaagataagagataagtggcgtaattgaagatgttgttaccagtatttttggttcgtattatgggttaaattcagcaatacatactgagaaaaaataatgtgtaataacaaggaacaaaaccttttgataataatatgtcaggatatgtcattttaacctatctgataaggaaagtgctttgttataatgccatttaaaccttttttagctaaaatgtcttgactagaatttggggaaaaataacttacattaaactctgctatactggaagtgtatgaaaaagagtattgattttataacctgttggtgagacacatttccttgtgaatgaaaatacagtgggctgtaaagtttgaagtaaagtgtcaacgtgtcagagtaagggccacatgccgtgaaaaatgtgtataagagatttgaaaggcgcatgtagttcagattcacttgtataaagttcgagtgaaagtgtagctggaaattttaggtcaacactcaagttaaaagcaagattactgctggcttaagttataaccaaaataatgagaaaatatactaaataacctgtgagagagggaaatatgagtgctataaaagtttaagtctgttactttttacctaattgtatattcctccccaatatttttaagtttagaaattgagaaattatactcatttttgtcagaggaagagatagttttaaaagtccaggtaagattagctggccatggtggtacacacctgtaatcccagctgctcaggaggctgaggaacaagaatcgtttgaacccgggaggttaagacttcagtgagccgagatcgcaccactgcactccagcctgggtgacagacggagactttgtcttaaaaaaaaaaaaaaggaagaaaaaaaaagtccaattaagaatttcatgcctttcaacacttccttttgctgatcctcttcttttaaattccacctcatcttcaaagtctagcatcaaggcctccttaatgaccttctagctatgaataagctaaatatctcttctcaacttccaaataccattctttgggaatttatctatgtacaagaaggttgtcttggggacaaaatttcttttaattcatggatgctttgcaaggagtttccttacatacaaatccttcttgattggatggtgctggattctgtctttgcttctttctatattctcccacttcacattccagctctgctgaacagttgactgatctctgcacagtcagttctcttttcctggattgtcttttcctgcacgtctccttggctaatttcttctaagccttcagctttcatttaagatctcacttcctgatactctcctcgtattcacatccaatttaacgactctgcgctctgttctcagaaaattaccttctgctattaagattagtatttcacacacctgttattgcctgctttcttgtctgtctccttgaacagaatttcttctctctctgagatgagaatcataagattcatggtcagtgctaaaaaaaattaagaatgcatgtaagaattagcgttcatagaatgtaagcaccatagaagttgcgaatttgttttgcgtgtctctatatctctggtgcttggaaccatgcctggcccacagtatatcttcaataaaatagtggttgaatgaatcagtgaataaagaaataaaaatattatgtattttaaaaagaaaacaataggttactaagaggttgtgttataaataatgattacagctgaacgaaagtactaaaaatgtaaatgatgacaaaatgatagatgagagtaaatagaacttagtatttggaagtaaaataaagagcaggaacaaaaaaggatgattgcttactagctgctgttcttagacaaataaacccttattctctgaaagtttaccttagcatttcagcagctgacaataataaaaaggagtaagaggtatgaaaaattacatgtcgttttacaatcacttccgtgctttgtctgtttgctccattgtgatggttcagatggttccatttgaccccaacctctagctgttccaacctcagaaccaatatttattgccacatatgggctgcgcatggcagctgcaaaatccagatgccaagctttggaatgtatttttacggcagcaccatctggggctctggccagccttctttattgtctcttgaatgtttacactaatagctttgctgggctgtggcactacctgtgggacacgctgagggtcaggccgtttatgagctcatcttgtcattctagttagaatttccctttaaatgtctctcacctgctatcaacttattccttttaatgtatctacaatgtctgatgaaagtaataaaacaggtggtcatcgagactaggaaagaaaaggactgttttcacagcggtgggtccatgttattcatgggttctcagcagcccatttgtgagttttggggggaaataaaatactttttcaatttactgaatatattattttgcttatatttcattgaaatagaagatatacattattatagcccttaacccaacttactggagtagcatattgatctctaagggaggtgataatactccacagcacaaatgaacagtattttaattcctagggaaacttaaaaaaatagtttatttttagcaatcaatgagttgagttatttgaagattcacctgcaacttaggatggataaatgactatttgtgatccttagaaccatgatttagggaattcctcaaaggtgattcaagcagattcatggttttgaattgtgaggaacccgtcattctaaaggaactaatgcaacacgaagattcagctcaagtaataatttagcgtgttatatccagcaaagggaatcagctctgagagtttaaatgacttatccaaggtcccacaagcggtagatccagagtcaaagtgaagatgaagtttgtccaattattcgatgacagtaggacttgtcaggagagtcaatcctgatcatcgagcccccgaaatgatgaaatgacctgaatgattgtgcgacgtccctatttgctttcacggccccgacactcgttctgccccagtgggtaacctcaccttttgggggtggctttgtgggtggaggctgtggagcaggactgcagtcagacaaggaacatgaaggaaactgcgtttgtgtgacctcttggaagcctcctcctggtagctgggcttcctgggattgtcacagagagactgccatctcagaagtagtgacaaaattaggcattcccaggctcacggtttctaatcaatcagcctgtcacgtatctgaggagatatttcagagtgaagatagcgtatgggaaagcaatttccttggacttctgcctctgagttctatgtctggagtagaaatgaggtgcttagtgttaaacaaagccaagtagggagacagtgatgtgactcttatgcatgcctggaccaaaatggcaaatgtgtgcctggggaagccacaggaggctcccagaagcagccttccaggttctgcagacacttaagaaaacagccacaattaggtccaagggaagggtgatattctctccaaagacactttaaataagaaagagctgttaaagctttcctgtaggctgaggatagaccttttaaaatgatatttagtctcaggaaaaaagaagacatattgttataatgtgttgtcagttctctaaggaaatggcataaaaaggagattttattgtggcttaatcctttgttctggagaatctgcgcttttatatacagtatatattttaatgaaaaccatgacaagattactattcataaatcagcagtgaaatactaaggacatagatgctcacagctgcatgcatgtgtgcaggaggtgaggggggtggtgcatgtattttttcaaatgggttcattaccacaattggaagaaaatcaatgcaactatggcaaaacctcattgctttgttgccaaaggatttctgatttcatttttttttttttttttgtaagacagggtcttgctgtcactcaggctggagttcagtggcataatcatacctcactgcagcctcaaacccctgggctcaagcaatcttcccaccttggcctcccaaaacattgggattacaggcatgagccaccatacctggcttgatttcattctttgtgtgaaggagataggagaagggctttcagcactctgaagtatccttaaattgattgatgtattctcaaactctctgaaaaatagtggcttcaagttgcccgcctcataatttttgccacttcaaatttgtacattctatttctggttggaaaataaatacttcacaaaactattatagttggacacaaatatatcaacaactccatcatttcatacaatagctggaggatatctttgagatgaaggtcaagcaaacattctcaagtaaagccataggttatatgtggtgggtaatgtccagtgattggaaacacatcagaggagctactattttgtctttgtttggaaatctgttttgcagattgaaaaatgacagcatcgtgatacataaattactagagacttacaaggaattaagaaagtaagtagtaagataaatgatcaattggaacccaatttttcttgcatgaagtactcacaaatgagtacttgtgctgataggtgtactgggagttgtgtattcacaatgagaaagcataagtgtctttggatgggccttagctatacatccttgtaagtaatatattacaactgaagaaatccctgaggtacatctggcagggccccagcttcaagttgaacctgaagtagagagtgagcttacaactcttgcgcatgagtgcacacacacactcgcactccaaaaatatatgccaaaaaaagcttcccagaaaaaaataatttaaaaaaatccctgaaagctactggaaagtcatacatatgttaaatttggtcatttagcatcataaattgaagttggaatatcatgaaataggcagatctgatcctcccacattccccagcatttacaggaagtctgagacagcagaggttggatggcgatgatggtgatgatggtgatgagtatgatgaatgtgatgatgaaggtgacagctaacctttattgagttttgctataaactaaatgccactctaaatactttaattcataaaattctcacaacagtttattttacatctgagaacactgagacacaatgcttagattgtctgagtaacacagtaactaaatgcaagattctgttttctacgttgtagtgaaataccatcgatctcagtggaacaagttgcaaagtaatttgtagaaccattaagtcaattagggaatttaaaattctgaactatggtggtagaaaaaaagccacatttcaaatagacatgacttcagagaggcaaagctaaaatttaagccatttacttgccagtttttatttttattttaatatttttaagttttattttaagttcagggaaaatgtgcaggtttgttacataggtaaacttgtgtcatgagagtttgttgtacagattatttcatcacccaaatattaggcctagtacccattagtaatttttcctgatcctcttcttcctcccaccgtccattatctgataggcctcagtgtgtgttcttcccctccatgtgtccatgggtccatatcatttagctcccacttaggagtgagaacatgtggtatttggttttctgttcctgtgttagtttgctaatgataagagcctccagctccatccatgtccctacaaaggatataatcgcgttcttttatggctgcatagtattccatggtgtatatgcaccccattttctttatctagtctatcactgatgggcatttatgtggattccatgtctttgctgttgtgaattgagttgcagtgaacatgagtgaatgtgtctttataatagaataatttatattcctttgggtgtatacccagtaatgggattgctggtcaaatgttatttctgtctttaaagttagaatttcttaactttactatgaaccactcaaaatacttgaatttgcacatgtgcatgcacacacacacacatagttagtgttacttaatctaagcattgtgtcttggtgttctcagatgtaaaataaactgttgtgagaatttaatgaattaattatttagagtggcacttggttcatagcgaaactcaataaaggttagctatcaccttcatcatcacattcatcatattcaccaccatcatcatcaccatcatcgttatcaagttaccaacctcatctgccaatttttaaccccactgccatagatgccactctaaatactttgtaatttttaaattcagtgcttttaacaaatggaaaaaacagccgtgattttcttctaaaagatttttaaacaaaaattatataagtagttataaaaacaggagattgttcataaatcttgatctaggtaaaaacttaaaaagacccagagaaatttcacttttcacctttgttggtcttatttttttaacaactcctgactttgttcattgttcgccgaatccatctcggcttctttgatttcacaccacactggttttgtgcgattgccatttcacatgaacatctggattttttttctcctgtgcttgtgcacatttggagaaagatagtaattttcatccaaatttattctactttactcagccatcagaggaatgttaactgtacatgttcataatgtttttttttaattctaaaaaagatctatgtctgccaggaagagaaatatcctttagtttgtcaactggatccttctagaggagtcaatagtatttttgtttttgatatgatcttccatcaccattcacagacttctagaatcacagcttcatatgctggttaattctaccatatagatacatatatagtaagatggaggcatttctctcgagttcctttaacactctctgtttctttgatattcttcttagtcattgctgcacttctgacaagtctgaatagagagttgtctttttgttaattgttgaatagatgaagagtatagttaagatattatatttcaacatttttaaaagctataatgcggcctgttcctttaggtgtatcactatagaaaaatctctttattcttgttcctttagaaataccttgaacaattagaaaatttcctggattgatgattgcccattttgctacttaaacactaaatttggtcacatgatctgatggaattggaatatggtatcattaaatatctgttgcaactcagaaaccaatttcttctaatgtgctcctccaagggcttcatttacattgcctgattcatccttacatccctatgacataaaagaagggcaggtatcacattatccccattttccaattgaggcatctgcgaccagaaaatggaggcacttgcctatagttacacactatgtcagaggcaggagtaggcaaagatactacttttgttcactgccaatccacccttcttttcattagtcactagcctccttatttcgtaaggtgtaggccattagaagattgatcttgtggggaaaataacatctgttttaaaactcaatgccttttacaagtttatatgccttgatataattttaataggtgcatcattgcctgcttttctttatgagagatgatataaatatgaaaaaatacacttgcagaaatgaaatgaaaataataaataaagccctcttccatttccattattctaagtcatgctccttgagacttcaatctcaatatgatgttaatagaaccattagatatgattcatatcatacataagacattcctattgacaatttcatcttgaccaagggtcaatggatccattacaatgcaaatcttactgtatactttccatctaaatcaaaagaatttggtcttgtgtccattctaatatgtttcatgaagtagaatccaatctcagacatgaagtacacatctgtttctcatactaaatcatgcctgttcctatttgctctcaatttaaaagataattaattacgttttacatcaatagactactttggagtatttaaagaaatgcatagggtttatgggaatccaagtttgcctgtttaatacataccaacctgcaagaaaaattccttcatggatgtgcatctcttaattttggggggtgcatgtaaagctattctacgtatttggtaagatatgcagaatcaggacatgttccaaaagattacctaacccagtcttgtaaagtacaagaacacactgaggtttcaatcagtttttcagataagctgaagaatgtctcactaggcacaggattttttttaaaaaactttcgcttttccccatgctatttatttctactttttttttttttaatcttcatctcttattcctgcactcttgggcatctttcagaatccttctctattcagtgctctaagtagcttataaattgcaatctaaccttgatatggacaatcattgagcccatttctggccacctttaagtttcagggctctcctgatcacctgttatctcttccctttccttgtccgtattattttccttctagaactgtactactgcttctctctatttgtgcaccacaacagaaagacctgctgctgatgagggcttcctgttacagatgaggttaaagtagctgaggaatagctgaacaagaccttacgtaaaggccttttctcccctagggttccatgacattgcatccatactctggtctcaccatgctcctccatcttcctttcttctttcttggaacgttgggtagtgatgaactttggaccaggaagacttctgtataaatccctgatctactaattcttgcggtgtgatcttgggcaaatcctttaatcttgtctaatccttagttttgtcatccataaaataatgataataattatccacattggaagattgttgtgagaaggaaattaagtgatttatgtaagggtcacaatgcctgactcaaagtaggtatttaagcatgttgttgccttgctccctctttactctctctttttttcccatttctctccaaaatattcgattttgtgaaacaaaaaatgttgattttttcaagctttccattatccaattacatagctaccaactgatgagctgttccaatatttatttcttttcaaagcgctttacttcttgtgggttatcgacagctagacatattttttcctctttcagttatgaaagatattctcagactcacaaagctttaaattttattcaagacattgaaacataaaagttcagggattattcaatgatgttaactattgaatgtacacaaaaatgatcttacttgcaatctagtttgtatgctgtttcaaacatgcccaggactcccaagttcaaaggttctctctacacgtaagcggtagtcaaaaatattagttgttttattgcggacagccttaatttatataaatggaaaacatctaaaactgcaaagtacaatagtccagaaagttttcattagcaatccagttcttggacatcacagggaaactcggcagaaagaaatgataagttaattgttgaaatgtttcatattcccaggttcagtttcttacaggtattcgcacctgcctcacctgcacctctgttactctctgtgacatgttccaccaccctggacaagacaaatgtatatttgaaagaataagggtgcttgttagtgggtaggtgtgattatgggaggcaattctagtgaggaaaagatgggttggcgtatggggcagcagtgaagaaaaataaataaaacagtttatttgtagtgggactgatccctcttgctcatgcattagtgcttggctacaggagagtagtaatttattgatgcagatggctatgtaaagtgcatgcaatttgtgagggggcttgacccttgactgatgggccatatgttgtaaagccctaggggcgtcatttgcctccgctctcttcctctctctgtctctgcacctatggtccttattcaatcaccacatattgaactatagacttaccaactcccccaataaatctccaactaatggctcacaaaggccataacttaaccctttctacacaacagagcacattattttgcatcatgatcacactcagtgaaataaaagataaatattatatgacctgcctagaatagaaagcaaattgttgtaaaatgctgttccctgctgggtattcactgcatttggatgtagtagggttgctttgagcttgctgaattctatcgttatattctgccatgttataattacagcttactgttataacataattcttaaacactgttaatacaccacactagagaaacatttaatgttttttaattagcttcttttgtctgagtcttcttttttccctagtaaaatatggaacatatgctcaatgaaaaaatgcatatatttttattctcatgtagaagcaagtttttataaaatatattagggcatttgtatggaataacagaaaaaaagtacagtgtacgttttaaatactcactgtgctctgaattttctataggacccattccagcagaaagacttaatgaaattattcattctccactgaagcactgggatttccttataatgtgggctgtctgagtcctaaatgccacctgaaaaagagtttaggacaccaagactagaaaaaagtcattgctgcttatctattaacttcattttttcccatccaatagtaaaactgaataaatgatactaatcagtaatgtgcacatcagtacaatttctctaatattaggaataccagtcagttgccttatgcttattcccatcacttggataagggagcagaaggtgtcttccttggaatcttgagacaacatcactgcaagcaagaagcagacatctattgctaaactaaagttgaatttttgtatctactccttttccccttttctgggcatggctcttggtagatttagcagcaatttagagagcctgggggagtgtaggaagaccacaggtttcaccagtgcatagcccatctgtagaaatagttgtcagagctgagtatctctagttatattctatgtttgtaataattagcttcccagaaaacaatttgtcttttagatagcttgctagtacagtgttcacagcttgtgtgtgatatgttttatataatatctctgagcatcttaattcagtaggaatataatgtttgatttctaccagatcaggtttcatatcctgtgttggtataaaaaataggtttcataatttttttttcctaatgcataatttccttacactatagtgaaaatccagctttctgaaccaattaaaagaaagatgaaatttcatgtacacatatgctgtgtcaaaatgttcatttatgagtcactagtcttatcaacatggataactgatgtagaaaaaatattcaaatatacagaaaagaagaagtcattgtcttctgtcctaaacccagtagacctaacacatacaatgcaggcagaaaggaaatcagcataaataaaccatgcattcccaattgaatctcaataatttaaacataaatcctttaggctttggtaccttttttccacatgggcttttcttttggatttggcgttcctagcatcatttagaattcatctgcgagccacaagtaaatagagtttccataaaccttgaataaacaatcccctttgaggttatattccataatttaaggaattccaatgaaaacatggttggtaaggagttttccaagatgtgtgtgtatcaatatatttgcctataaaaaggaaccaacatgttaaagcataaattaccaactttcccgcatataccatatgcacaagggagggacatctataatatatgtatttctgagattgacaacaagaaaggatgaattgctaatattctgcttaccatgtattcaaaaagtctccatagttttcagaaaatgtggtgagaaaaacttttctctcttctgatgtattttctctctaattataatttggcatctagaatgtgttgtttcttttaaaaataaactaaactgcatagcaaactatattgattttaaaagccctctaattaaaatagcaacttaacagcaaatgaccatgaagtatttaaaataaaaaatgatgatgtaaattgaatgtgtcaactaaagttggtacaaatgaagattaagagaatagttaccttcatttactctatgtttcatattatgccttatcccagttcttcagttagttaatatagctataatgagttcatactccttagaagcagccaacagagaagcttttctttaagaacattctaaatggttcaaatcaataccatttcctaaataaaaactttcttggctcagatttaaaacacctatggctgttggcttattctttatgctagcccaacaaaatgccacgtaatcttgtaagtaagactctgccacattctgatatcaacattgtcaatgagaaaactctgtgtatatacattcagaaacattcaattataattcgcctcttaaagtcatataactatctggtattacattgagttatcactgaacatattaattaaaatgcctcagtattgaactcagtggttcaaactgtttgtgtaacccaaaaacccttaatcattgacatttgaagattgctgttggtttttttaactaataggacaaaatttatttttagtacaaaaataagatataagaatagttacttaggattgaaatggcatgttaaatactaaaggaaaattggaatttgttttgttttttagaatggtttctggccaggtgcagtagctcacacctgtaatcccagcactttgggaggccaaggtgggcagatcatgagctcaggagttcgagaccagcctggccaacatggtgaaaccccgtctctactaaaaacacaaaaagtagctgtgcatggtggcttgcgcctgtagtcccagctactcgggaggctgaggcagcagaatcacttgaacctggaaggcggagcttgcagtgagccaagtctgtgccattgtgcttcagcctgggcgacagagcaatactctgtctttttaaaaaaaaaaaaaaacggtttctatgtcattgttgaaagtgataataatttttatgtatatgattttatgagaaataatattttaccaatgcacatatagggtacatttttatattttttattcatgaggatttccacattttttgtgcaaacactatatgttatcattattttgtatcttctatgtaatatatacaataaatcaacaaatatttattgaacacctactccgtgctaggtgttagaatgataacattgaataatattatctcctctgccttgaagaactttcagtgtaagctaccataatatttacctgaggatttttcatgtttttctaacagtttataaaattcctatatttggaggctctccagaaacagacggaaagggactagtgaaattatagttgaaaggtacagtgtattttgggggacaaatatttatgttattgtatttgttttctatgatatttttaaaacatggcactattcccctgacagaagtgaatttgccaagcattagcctagggtgtttagaagtaacagctgaaggattaaggaaacatcagcattgagtgggaggaattcagcataaagtgtgattagagcctccacagtctgctattcttagctattcattccctgcaaaatcacatcagtaattttcagtgacatttttaattgtccctgtacaaaagataataaagtagaagaaaataaaatcaaaagtgagaaaattcaagtactactaagatgtaccctggtgtttgttggttgtgggtgccctaaattacgtattaacagagaactgccttgtagtaaaatttgatgcccccatgggccctgactttacctttatcatgtagtttcatcatttcaaggatctttccttatggttaaccccttttcatcttctgaacaggttcttacagccagagggttcgcgtgctatttttagcgtgcttctttgagtggtggatagtggttgggaatttctttgcctgctgcatgaatacacttccctgcagagtgtacaaagaagcacttaatttcgagcttttcattttggttagtgacactgcaaacatagcacaggtggctataattttacaccatgtgagtaaaaatactatttttctttccccgtcaaccttcttgtctgatcgtcttaaacccataagatggggaattacagaaactgatattttaaattgatgaactagtttaagatactctttgaaaaggaatccaaacttgctatgtaatctgtattagtctgttctcacactgctataaagaaatacctgagattgggtaattcataaagaaaagaggtttaactgtctcacagttccacaagctgtagaggcagcatggctgaggaggcctcaggaaacttacagtcgtggcagaaggtgaaggggaagcagacatgtcttacatggcaggagcaggaggaagagaagggcgggggggaggtgtcacacccttttaaccaaccagatttcatgaggactcactatcacaagaacagcaagggggaaatacgcccccatgttgcaatcacctcccaccaggccccacctcaaacacaaacactggggattacaatttatcatgagatttgagtgggaacacaaatccaaaccatatcataagcaaaatgtaaaattgttaaggatggggaaagatttataaatgtagggttcaagttagtgtaaaagcgatagcattgtccaccagtgactgttactgggcctgtatctttatcatagtggatcatagttccattattgtaattatgccatagttttgtaaaaacctttatctgttatttgagatataaaatgttgctatctggcaatttttaggttgtagtctcatcttttaggttagaaagtatccttattttataaaaaatctctctctatatatatttagattaatcttctattaaggactagatattcatgttcaaacattaggttttcctgataatccactttttagataatctcagtttttattttagatttaggggcacacattacaggtttgttacaggggtttactgcatgacaatgaagtttgggtatgaatgatcccattactcaggtagtgagcatagtacccaatacgtagtttttcagaccgtttcccttcctttttcccccgtctagtagcccccactgtccattgttcttatttttgtttccatgtgtgcacaatatttactttccacgtataagaaaatgtggcacatatacactatgggatatgtgcagctgtagaaaaagaacaaaatgcatatatgcagcaacatagatgtgctgcaggccattaccctaagcaaattgaggcaggaacagaaaactaaatgccacatgttctcacttagaaggtatctttgaatggcgttgtcagacaaactcaagcatggatccttgctgaagtaccagaatcttgactggttatggttcaaaaacaactgaatagtattcacggatctgagtcttagatacaaaaaatgaaagtaatctagccgttttatttagctggtactgaagtgtagatgatgtattgcataaaattatagcaagtcatacaatttcccttggctagttggtcattccctttctctttatggtttctattcttgtacagatttctaactagtgatacagaacaataacttggatgacttaaaaacattatgctaaataaaagaagacagactcaaatgactatatgcttaatggtttgcttcatataaactttttgaagaggtaaaactggattgttggaaagttgatcagtgctttgcaggggccagggttggggagggaattaactgcaaagaccagagggaactttttggtgtggtgacgatggtctgcatcaccatcgtgtcatgaatgtcaagactcatccaatcttttctaaactttattaattttttgcctgaaaattatatccaacaaaagatgttagaattccactttggtgtgaatctaacctagacaagttgatactttttcctgtttttttttcccataagttaaagctatactgagtttattaatgaagttattaataaaattatttataaccctaatatattcctggttctagctgactttacctgtagttactaggtatttgaatagagtcaattgaagtataaattttaaaccaaaactaaacacttttttcccaagaaacattcgtcacacaggtgcatataaaatacatgcttacatctgaatttgcatataaagtgttgtaggaaaattagaaagcatatggtcttttcttctttttcattgtctaagaagcactaaagccaaataacttggcatgattcttccagttttactctttttaaatagctttattgtcaggcagatggggagtgctagccacttattaaaattacacttgtacatatcgtaagaatgttttatatttattcatgaatataaaatttttagaattggcatttaaaaccaaaaaaaacctgtcatagagttgagtaacaactttatttgtcactttgaaaccactttgaaatatcttgcagcatggacggttgcctaattaatattccaagattcaggttctctttaatgatgtttttaaaagctctccatcttaggaagccaaagataatcatagagtagagattgaattacatggaaagaatgaactttaagatgtggcatctcttccaagttgtattaggaaaatatatatgggaaaacattatcgtatactttgtaataggtactttcccgccctctgtgaagagtttaaaaatcagtacttacactggatagttttcaagcatcattttgtgagtgaataatctgagccaaagagatgtaacatagtccatgaacaccagacagttaaaagattcttctactttagaggttttttaaagactgatttaaaattaaaaaacagatatctatttattcatcacaattttgtgctacaaatttgaagaagtagaggataacattcttttgggtacttaatgaatatttttcaaataaatatctgaattactaatacatctcttagattcatattgcagctagagaaataactgcatcatttgctgaagaacatttgaaaatgtagaatttcttatttgacacatgaaaatatattacataatttaatatatcaatgaagacaggtaaatacatagataactacatatatagatacaaaccagaatatgcaggtaattgactttgaaaatttgtcctgaagacaaaacttttagacagttttgaggagatactatgtgataaggcaaattttataaaactgaagtcaaaactaaaccttctgtcattcaaaactatcatatgtcaaaacgtttttaggtagaactttaatagaactttagcatcttataatgtcatatccctgataaacttgagtgtatgcagagaatctgccaaaatttaatgagcacatgtctgaacaaccattactttgtggctaaagatatttctttccaatttctctccccagtatggttactctgcctctttaatttatccttttaatatgtgcagcaagtgaagaaatagaaagcttgggggaaaatgaactgctataaaaatgcaagtatctccagggtttttctacattctcttttctttatccctctttatttctgttttatcaaataaaatctttttctcctcatagttgcagtatccaaattgtgttttttaacacgtgtatcaaatggataaagtttaatagtataaattgccaaacaaaattggcataagagtttctccaggaccacagtttggtgtacaatatgataccaaatatatcctaaaaattattttctcttaatttagttatagatgaaatgccaggtgttgtattgcaagggtgattaaaatcaacttagctccttggaatctttacctttgtctacataaagctgttaaaggaaactggaacccgctttttctcagtgatgacatccaattgttttcccttatatatagggctatgaaagtatgctatgagtttagcaaacctatctttgcaatgtgtatgtgttatgtagcttggatttgtttcaaaatctgtagagaggctgcaaaatttgtaaccaccttatagaaaagtcaggtgtactcccttccactgcccttcacattttcattgtatccatgctttcctttgcatgttcctctaagataagagttaataagttgtaaaaacaaacaaacaaaaaaaaaaaacaaaagaaaaaatgtctctgataccttagcatagtgtttctgaaccactttccattactgccccttaaaggagtcttttcaacaatttttcctaattgctattcccttgaaatgttactactacagataaactgtacatctgtttatatactgtatttgtgttttaatacataaaatacttgatttttggctcactcccctgaatctatttttgcccccttaaggttagcattgcctcccttgagaatgcaggctgtggcagtattagattgtccactctagtcaggtaggacacattgtcatgtgctgttctgtatgttccctcttttgacttccccttagaaatgctttaataattacattattcaaaggcatagccagccatggtggcactcacctttggttccagctactcgggaggcttaggcagggggatcacttgggctcaggagttcaagaccagcctgggcaactggagtctgttctcacgtggctaataaaaacatacccaagattgggtaatgtataaaggaaagaggtttaatggacccacagttccacatggctggggagacctcacaatcatggcagaagtcgaatgaggagcaaagtcacatattacatggtggcaggcaagagatcttgtgcaggggaacttgtatttataaaaccatcagatctcataagacgcatttactaccaccagaatagtatggggaaaactgccctcgtgattgaattatcttcacctggccctgcccttgactcatggggattattgcaattcaaggtgagatatgggtgcggacacagtcaaaccatatcagcaacatagtgaaaaccttgtattttaaaaagaaaaagagagagagagagaaataaaaatgcacccttccttccttcctttcttccttctttccttctttccttctttctttctttctttctttctttctttctttctttctttctttctttctttcttctttctttctttcttgtctttctttctttctttctttcttgtctttctgtctttcttttagagttcattgcattttttgtcttcaactattattttaagttcaggtgtacatgtgcaggatgtgcaggtttgttccataggtaaatgtgtgccatggtggtttgctgcacagatccacccatcacctaggtattaagcccagcagtcattagctattcttccagatgatgtcactcccaccaccctcccaactacaggccccagtgtgtgttgtttccccactatgtgtccatgtgttctcatcgttcatctctcacttataagtgagaacgtgtagtgtttggttttctgttcctgtgttagtttgctgaggataacaacttccagctccatttatgtccctgcaaaggacatgatcttgttcctttttatggctgcatagtattccatggtgtatatgtaccacattttctttatccggtctgtcactgtggacatttgggttgattccatgtctctgctgttgtgaatagtgctgcaatgagcatacatgtacatatatctttttgctagaatgatttatattcctttgggtatatacccagtaatgggattgccgggtcaaacaggattgtctttctggttctagatccctgaggaattgccacaccatcttccacaatgctggaaataatttacgttaccaccaacagtgtaaaaacatttctttttctctgcaaactcaccagcatctgttgtttcttaactttttaataatcaccattctgactggcatgagatagtatctcattgtggttttgatttgcaaggaaatgcagttttctttgtctatttcagaaagagcacaggggatgggaaaagatgagaataagctagccccctcctctctaaagagagaatttatattttggttcttatagatgacattcttagaattaatatatattccatgaatgagaagccatgtaaatctacttaaacagccatgctaaaggattaaggttgtttgccattatcatctccagtagctcccatagacttccactatgttaatgacaaataatatgtgtatcctccattcaatctctactctggccttcctgataacactgtaactcatatctttccaaaccctataaatagatgcatatttaggggttatgtcctggactgaggtacagtgttgctagaaaataaatataacacaaaacacataaaccaattttatgaattaggctaatttatgcaagatgatgatatgtgaatgatgagaaattatgaattattattacatatattaaatgcttattagaatccaggtacagtgttaaaaactttccatagattttctaatttttatcctcacaataaacctatagatacttttgttatttttactttatagataagaaaaataatatccaaagtgcattttaaatactggtttaaatagctaattttattgatggttataatgcgagaagagattataaaaatcagagttgactaatttttgcttcacttttttatggtggctttctgtcttgccagttgtggagatagtagcaataagtacaaaaataaaatagccaccaggaggaaaaaagacaaacaaaaatatgacttaaattcaaactcagactctaaaattggctgttttgaaactaacaattgttctaatcgtaatcatggtaacagctggcattagttaaccgcttactaaatcatcatcaccttcacagcagcattttcattttactgaagaggagacaaagggttagagatgctaatcatattccttagattctagacctcgatattttattagtgatggtctggattatttgttgttgtgagatgtgttaagggtaattaaatagccttctaagaaaactgaaaacgtctctttttttcacgtaaacaattatcacaatataaaatgagtagaatgtgccatttttttaaacgcctaaatttttagaatcgtatatattttctgaatataattgcccatgaccataaatttttttaactcttttgagtttaatacagtgtaccttttcttttgaaaattttcagtaacttaatgacggcattgcttatacgggaaacattatgcaaatgactcacaatgaagtctgtgagtttagttaagcttgagaaaaagtttgtaattaacaaattagcatttgaaaaagacatttgaatatgcatagtagaaaattccacttaacttgtggggtgtgttcataatgattatttcagaattcatgcatatgcatcttttaacatgcaaatattttaaaccttagtggactagtccagatctggctcatttctgttgtggttgttgttttagttaaatgttgaaaattgtaaataaggcatcatgaatacacatactaacatgtggagtcctctttacttctctttgatatagtctttttaattattaaagacacaatattaaatactttctatttattattacttcactgtggataaaaataacattaagaaaaaaaaatcttggtatctgacttttcctaccaaagtgtataatgtgtactagaatgctatagtcaggacttcatttacctttatgttcaattgtgctgttagaaattagagtttgatgtctcacatacacacacagacattacattattcataaaaagtggcaagaataccttgtgattacttttaaacctctcttatataatatattggcttcattgtaaagtatattttcttaacaattttttaggtaggtcataaccctcctctgtttaaaaaactctaccagttcttgattaattatcagatatgatctcagacctttagttcagcattgaggactgttctccaatacaaagcacctctctcacctacatctcttcacatgttccattctaatctggcctcgattctaattcttatgctttctataaatgcatgatcgctaacccatctaaatgtttagacaaaccgcttttctgccgttataccttactcaccttacttaggctacatgatattttcccttgatgaattcctacagtatttatagttcaactattatgttccctgcaaaatggttatgtggaaagttatagctaatttaaatctagggttgataaatatgtgaattctttgcctttctagatagagaaattatgtcttgttttggtttggccaacctcctaaaatccaataggcaactgaggacagaagattgggcttgacttggcttacacagaggatgggcatctgtttctaatgaactcgtaatttatgccccatcttgtagccaaaaggaattaatagacctacagacataaaaaatgaataaactattttttccacactagtttgtccataacacgacactagaaaataaggtcattacatggtctcatgaaacccctgccaatcctatgacttgatgtattttaggttctttcactttgctttatgtatttgttgtgactctttgacaatatctgatgtttaactttgccttcagaaatttgccatggttcaacttcctttcagtgctcctgccttccttttcagtttattgatagtttcccttgccctagacactcatgtggacactgattacacaaaaccaatcaaaatcgacattggaaaagcaaaataattaagaattaaaatcagccagttcctgacactagctccaaggactagacaggtgacacctgaacagagtggaaaatagttgttgggaagtattccaggcacaaggaacagaatatgcaagggcattcaataatcaatgtctctgaggacatcaagtggaatataaaactagctgtattatcagatatcagaaaggccttatgagccacgcttacactttgcaacatactagaaaaaaagtcattcaaaggttgtataatcaatcctagctgaagatgcttgcaattgttcattttcctataaacatgtatggacagtggataaatcccaaatttttactctgaagcttgtgttgtccagattagatttgctgtttaccttagttttatttcctgaccaattttcaatccttctttcgttacctcccagacacttgctttttaaaaaactatatttttacaaaaacaaaaggacaaaaggtttttctagacagtgttagtgcattcaatacagaaagtttccagttagacaagaattttactgtctctatatgaagacttcactttgcactaaatataagaaaaaatataaggaagaagaaatgtaagaaaaaaaaaaaccaccagaaatagtcttagaaatgcgtatgtttgtacattcatccctcagtatctgtgaggaatttgttccaggacctcccatggatgctcaagtctctgatataaaataacatattatttgcctatcacctatgtgcatccttctatatactttaaatcagatgtccccaacattttaggcaccagggactggttgtgtggaagatgatatttccatggatggtgcaggggaaggaaggatggtttcaggatgaaactgtttcacctcggtcatcaggtgttcaagcagtagattctcataaggagcaggcaacctagattcctcacatacgcagttcacaatagggtaagcacttctatgagaatctaatgccgctgctgatctgacaggaggcggagctcaggcggtaatgctcgctccctcctgctgtgcagcccgtttcctaccaggccacagaccagtatgagtccctggccccggggctgtggacccctgcttgaaatcatctctggattacttttaatatttactacaatgtaaatgctatgtaaatagttaatactgtattgcttagggaatcatgacaaggaaaaaatgtctctacatgttcagtgcagacataatcaaccatttttttctaaatacttttgatgcagtttgcagatatggagggttaatttaattttgcaagctcttataatcaactattgggattcatcattattttcagggtttttctcctccttttatgactgaatttatttttttaaataactgaattactgcataaaatataattattttcataacttataaggatgtatagactgtaattaggctgttgtatggtagctgacaggtactgctgatgaaattttactaagtgaccagaataataaaatttattacacaggttacttcctttagaggttctactttttggtcttcaatatctaacatgctttctttattattaatataaatataaaatagatcttaatggtagggacagatttctctctgtaaatagaagtacaaattttgtatgaaaagttgaagagaaataaatataatattcccaaatctatccacaaccattcatacttgataaaatgtaagtttactgtaaaatgaatgaattattgatgtacttagcaaaacattatatctgcacaaagtcataaattaaacaaactctaatacattttatgataagcataatttgacctgagtccttgttagcctcaaagcataatataatgatcagaaaaattgggggtctaatcaattaatttgaaaatctgcaatgagattattatttatctagagtgaacgctttactagcatacaaataaagtttttataaatgaaatagaataaatatctaattattggaacttttccattaaataactgatggcataaagaggcttctgcttttaaaaaaaaaaaaaatatttgctgatataaacctgagaatttaaatgtcaattatggcaaaaatattttctgtacaactttgttgttttttaaaacattattaatgtaacagctactacatcttattattttcatccattctgcaaatctggtgaatctatttagtctacatctagaacaactagaaaaatatgtataatatatgtatctaaaagggaaatgaagatgcatgaaaatatctaattgtgtaaatactgttaagctagagaattaaagatgataaccccttttcaccattcagccaagcgtgaaggagcaaaagagattcaaaacttcattaattgctctcacacaacgttacaggccacctgcacttcaaagaatttacattggagcagatggattgctgaatgcgatatcaaagaatttcagaatgtttgttttaaaaataacctggattctaaggcaagcaccagcaaagcatacaatttacaaagatgacaaagcttttcttattaaaacttctaaaacgtataagtgaaggcacatttttatctctaaaataagagtatacataccaactactctttaaaatgatcaaagttacatatttaaatatataaatgaaatatattcatgcattatttgaggcttttgaacatacctaactggtttcctttagtaactcctagatcagtgaaatctagctttttcccagtataagttttcacatctctctgattattcaatcttttgaataaagatggtccatatggaaaatgagatttttaaaaaagtttaagagtaactttttttgcagaaactcctttcacttgtcatttgattctgacttgagctcggtactttgattgataggtcctactcgcaatgcactgacagaatccacattggaatagctagttaagatgaatcagagctaatctaaatgcatcttggatcagattatgctttacttttggaacatattgtaatttttgtattttacagaagtttctatagctttacccacaaattaagttttacttggaatttgcatcacaatattttcattctttaaatattgatgtatcaggggtcagaaaacaacaacagctagagggctgaatctgaccttgtacctgtttttgggaaataagattttattttagcacagtcatacccattcaattacttattgtctgtggctgcttttgtgctacaacaatagagctgagtagtcacaatagacagtatggcttaccaagccctaagtgagatatttactatttgcctcttcacaggagaaatttactaaccctgatgtgctagcacatgttataaccttgggtaagttttcttaagctctctgagcattaggttcctcatctgtaatataaagacaccgatggtgtctacccagatgtccctgcgtgtggtaataataatggtacctagccgtgatgattaaatgggataatataagctgttaggaaaaggcctcgttcacaataggtctgatacaaatgtcacccaacatcaacatcactgtcattttctcaggaataatgctaggtcatggagactgagaagagggtttcaaactacattactgtagtctgttcatcttcactagtcaaacaataaagtgggtagcatggttttgtattatgatcatagaatttgaaggtggaagccctgggtatgatgacaatttgccttcttctttgctgtttaataagacctgcagtgagtaatgtaaacactctaatcctctctttcttacctgtaaaattataataatattattaataataatatcatcccccaataggctgtatattgtaaagggccaattaaattagaaatatgaagtagggtaacttgtaaggttgcaatacaaatcaaaggtttcactgcctcattaaccgtacctcacttccatgctttgaactttggggtaatgaatatgtgtaattatttagctaagagggctcaagattaacgcttttgtgtcgagtgttgccacacacatcaacatggatgatcttacaggctaatgagggaaagaagccagaagccgaaggccacagacagtattatcccctttatataaagttctacacctagaaaattaatctttggtgatagaaaagagaatcagttacctttcagggtgtgtggaaggggcatagggtattaatggtagagattgtaggaggcaggtgatgttaccggtcttcttgtgggtataggttacagggctatgttcactttctacgacttcattggccagaacacttatgatttgtacatttcactgtaggtgtaaaatgcttacaagaagaacgaaatattaaaacaaaaaaagagaaaatgaaagaaaacaacaaaagtgttaagtccatccactgatcctgctttcagagccataaaaaaaccgtctgctatacaatctatttacctcgtcctctcacttacaccaatctttctttccacagcaccataaaatctacctacatacatgtaagaaaatgggactctcctttagccagccttgtctcctataccaccttgaatacgtgatgtttgacagaaatgacgttttatttttctctttatataaatcctatgatctccacttttacccaaagccttttttaaactaaagcattatgaccttaatgagactcatagatcacgttcactctctatcttacatgtatcattgcgctattctccaaagttctgtttgaattttattttatatcactccttttcctaaactatgcacatgctcatgaagacaaggcaaaacaaaaagaaaaaataaacaaatgaacaaacaaaaaatccacaggtcttaatagagagataggtttgagtagcaagaaaatatagtttagaaaataaatgttatttatttttgaaaagataatgccctatataataccaaatgccctatataaataccaatgccctatataaaaccaaaaagtataaaagctatgaagagaaaatcaagtctctattttaccctaacctttaggaaacccattcccttctcagaggtaacacatgttgctgttattttgtgcaaactttcattatatctgtgaataatctgcgcatatgcatatagcagtgtgttttacaaaaatggaagcttgttgtagacattaccttatactctatttccataagtgaatcatgtatcttgaacatcttccatgttaataaatattgagtttaaaatacccccaaaagtaatggaagcctagaaacacaaaattatggagctttttttttttttttttttgagcttgagtctcgctctatcaccaggctggagtatattggcgtgatctctgctcactgcaacctccacctcccaagttcgaacgattcttttgcctcagccttccgagtagctgggactacaggcacatgccaccatgcccagctaatttttgtatttttagtaggatggggtttcaccatgttggccaggctggtctcgaattcctgacctcaagtgatccgaccgccttggcctcccaaactgctgggattacaggcgtgagtcactgcaccaggcctatggagcagttttttaaaagaactttgcaaatattataaaattgccttctttacatcatccatgtagaatattccttataaccacttttgtcagtctgagagcgctttttgttttatctatgtctgttaaaccatatgctgaaactgttttctgctttcttcatgaggctttcccttatccttcacagaactatattgaataaatatttagtctattactcttgaagtctacactgaaaaatacttgaaacattactacttttccttatttgtttgtggcattctggccacgagtttgtataaattatgtttcagaactttgggctttgccagatgttgagtaatacgctgctaagatgtaagtacaaatggtttcactcctgactcctttgtacaagtgaaagacaacttggaattctaaacagattagaaatggaggttgccattcgtttgagctctcttagaaaagaaggctctctttgacaaatccctctgcttattagacaaagtgcaaaaagcattacatctggagttcataagccattgttttatggaattgatccatcatacaatcccttacgctcttgaaataaacccatgagaatttaagatgctatatgcacacttactaacacattcactcatacatacacacccctctatgcacacatgctaccattagagacttgtgcccttgcaaaaaaatcttatagcgtagaattgcaacatgctttttaaattgatagttatttttttttaacatcgtttatctttcaaaagacttctgaattcagctacaggaattattcttattcctcgaaacttataaccccctattctttgtactcaaaatgttttgtaatacaacattttttttccattaaaaagagcaaaagtaaagctacaattatttttgaaacacaccatccccagatacttctgaatttattttccttcctcaaatcttgaagcacgtattatttctttcacatctttagaccgttaaaactcaattgttcattctgtgagaagaaaacttaaggaaacattcagcaagtagctttatatgtgggagatggatttttagaggattttaggtgtttgagaagagtttctcatagattctgttgctttcagaattcctcaggatgccattctaaaggatgactgcaattcagatcagcgaagtgctttgatgtcttattttttcttttgcagattgtactccacatgttcagaaagcctttccctagagtataatttaatgtaattgacagtcattgttcctcgaaagtttgaattaaattaacctgagcctgaatgaaactggtaaaataaccacgtacagatttcattttattttcctttaggatcagtgacaatattatgtataaaattggcagttggctattagatcttcattgaatcaccctagatttgattaaaagtagatatttcagtgtacagtaatttaggttcatgaaaaactcttaggtttctcatttagttattgggtttattgaggaacagggtattttatgtgtgtaatgatgaattttgttctttctctttttccactgagatcaaatacagactgcaaaattgaccgagcatgaaattgtttttagaaattgtgggagctagtttcgatggcaagaatcagaggaaccgttgttagtgaaaatgtgtttggaaaggatgatggtagtgggtaggagagaatagaggtagagaggtgttaacataaggcaaaaacattaaactgacaaacacttctctgtagagtagttgatgtgttaagccagcacacttaaaagcatacaagtttttggatagaaaagtcttcattgttctgactgtttttctggacatgtagctggaaaggagactcaaatcttcatatggattttgtgtcttatggtcactgacactgcaaagcaattagccttcatgatggctgtgcttatgcaatactaattaacatgcctgttgtgctgttttccctgtttgaccatgtgacagcccacaggtctgacactctctgtgaaccaacagctgaggaaatttccaacatggcagattttttttacaaaacacacccaaacaaaaatggaatcacacttttcctgaacaactgcattaacagaatgtgttacaacggatctacaattagaggattgcattcatatgtactggggaaaaaaaaggagacgagaccctactcaagcatacggatacaaattgattatacctgggtccagaatttcaaagtgtgataacactgtattatagtatcatggagaatataatttaccagtacaatcacatctagtaaaattatcattgaaagttagaagtaaagttgtcaatatatttacggcaccatgtgagacctctatattgaagggctaatttagtaaatttgtatgtgttatgactttaagagtttgggcattggtgagttttgtttctgtgtgtttgttcctgttgtgagtgggactggaatactatgattaacaaaatcatatacaggcacttgatatgtggattgtacagtctagtgggtgaagttggttgaagtttatttataggctctacaaataaatataaaattagcactgatgtgaggggaggtgcttgatactctgagattgttaatagcagtttttagccagattgtaaattgaggtaagttcctttggaagtgacaattgagaaagacataaagtaaaattgacggttaaatgggtaagctgaggctagagcaccaaagacataaagtaaaattgacggttaaacgggtaagctgagactagatcaccccagacataaagtaaaattgacgtttaaacggggacactgaggctagatcaccccagaaattaagtaaaattgatggttaaatgggaagttgaggctagagcactaaagatataaagtaaaattgacggttcaatgggtaagctgaggctagatcaccccagacataaagtaaaattgacagttaaacgggtaagctgaggctagatcaccaaagacataaagtaaaattgacggttaaacgggtaagctgaggctagatcaccaaagacataaagtaaaattaatggttaaatgggaagttgaggctagaacactaaagacataaagtaaaattgacggttaaacgggtaagctgaggctagatcactgaagacataaagtaaaattgatggttaaatgggtaagctgaggctagatcaccaaagacataaagtaaaattgacagttaaacaggtaagctgaggctaggtcaccaaagacataaagtaaaattaatggtaaaacgggaagttgagcctagatccctaaagacataaagtaaaattgatggttaaacgggtaagctgaggctagatcaccccagacattaagtaaaattgatggttaaacgggtaaactgaggctagatccctaaagacataaagtaaaattgacgattaaatgggtaagctgaggctagatcaccaaagacataaagtaaaattgacggttaaacggataagctgaggctagatcaccaaagacataaagtaaaattgatggttaaacgggtaagctgaggctagatcacccaagacacaaagtaaaattgatggttaaacgggtaatctgaggctagatcaccccagacataaagtaaaattgatggttaaacgggaagttgaggctagaacagtaaagacataaagtaaaattgatggttaaatgggtaagctgaggctagatcaccccagacataaagtaaaattgatggttaaacgggtaagctgaggctagatcactaaagacataaagtaaaattgacggttaaacgggtaagctgaggctagatcaccccagacataaagtagaattgatgtttaaatgggtaagctgaggctagagcactaaagacataaagtaaaattgacggttaaacgggtaatctgaggctagatcaccccagacatgaagtaaaattgatggttaaacgagtaagctgaggctagatcaccccagacgtaaagtaaaattgacgggtaaacgggtaagctgaggctagatcacccaagacacaaagtaaaattgatggttaaacgggtaatctgaggctagatcaccccagacataaagtaaaattgatggttaaacgggaagttgaggctagaacagtaaagacataaagtaaaattgatggttaaatgggtaagctgaggctagatcaccccagacataaagtaaaattgatggttaaacgggtaagctgaggctagatcactaaagacataaagtaaaattgacggttaaacgggtaagctgaggctagatcaccccagacataaagtagaattgatgtttaaatgggtaagctgaggctagagcactaaagacataaagtaaaattgacggttaaacgggtaagctgaggctagatcaccccagacatgaagtaaaattgatggttaaacgagtaagctgaggctagatcaccccagacgtaaagtaaaattgacgggtaaacgggtaagctgaggctagatcaccccagacataaagtaaaactgatggttaaacgggaagttgaggctagaacagtaaagacataaagtaaaattgatggttaaatgggtaagctgaggctagagcactaaagacataaagtaaaattgacggttaaacgggtaagctgaggctagatcaccccagacataaagcaaaattgacggttaaccgggaaggctgaggctagatcaccccagacgtaaagtaaaattgacggttaaatgggtaagctgaggctacatcaccccagacataaagtaaaattgatagttaaacgggtaagctgaggctagatcaccccagacatgaagtaaaattgatggttaaacgggtaggctgaggctagatcaccccagacataaagtaaaattgatggttaaaagggtaggctgaggctagatcaccccagacataaagtaaaattgatggttaaacgggaaggtgaggctagagcagtaaagacataaagtaaaattgacggttaaatgggtaagctgaggctagatcaccccagacataaagtaaaattgatggttaaatgggtaagctgaggctagatcactaaagacataaagtaaaattgacagttaaacgggtaagctgaggctagatcacccagacataaagtaaaattgaagattaaacgggaagttgaggctagaacagtaaaggcataaagtaaaattgatggttaaacgggtaagctgaggctagatcaccccagacataaagtaaaattgatggataaacgggtaagctgaggctagatcaccccagacgtgaagtaaaattgacggctaaaagtgtaagctgagactagatcaccccagacataaagtaaaattgatggttaaacgggtaagctgaggctagatcaccccagaaataaagtaaaattgacggcttaacgggtaagctgagactagttcaccccagacataaagtaaaattgacggttaaacgggtaagctgaggctagatcaccccagacataaagtaaaattgatggttaaacgggtaagctgaggctagatcacgccagacataaagtaaaattgatggttaaacgggtaagctgaggctagatcaccccagatgtaaagcaaaattgacggccaaacgggtaagctgaggctagatcacccagacataaagtaaaattgatggttaaataggaagttgaggctggaacagtaaagacataaagtaaaattgacggttaaatgggtaagctgaggctagatcaccaaagacataaagtaaaattgacggttaaacggataagctgaggctagatcaccaaagacataaagaaaaattgatgcttaaacgggtaaactgaggctagagcactaaagacataaagtaaaattgatggttaaatgggtaagctgaggctagatcacccaagacataaagtaaaattgatggttaaatgggtaagctgaggccagatcaccccagacataaagtaaaattgatggttaaacaggaagttgaggctagaacagtaaagacataaagtaaaattgacggttaaacgggtaagctgaggctagatcaccccagacataaagtaaaattgatggttaaacgggaagttgaggctagagcactaaagacataaagtaaatttgacggttaaacaggtaagctgaggctagatcaccccagatataaagtaaaactgacggttaaacgggtaagctgaggctagatcactaaagacataaagtaaaattgacgattaaacggtaagctgaggctagatcaccaaagacataaagtaaaattgacgattaaacggtaagctgaggctagatcaccaaagacattaagtaaaattgacggttaaacgggtaagctgaggctagatcaccaaagacataaagtaaaattgatggttaaatgggtaagctgaggctagagcactaaagacataaagtaaaattggcggttaaacgggtaagctgaggctagatcaccccagacataaagtaaaattgatggttaaatgggaagttgaggctagaacagtaaagacataaagtaaaattgacggttaaacgggtaagctgaggctagatcaccccagacataaagtaaaattgacggttatacaggtaagctgaggctagatcaccaaagacataaagtaaaattgatggttaaacgggaagttgaggctagaacagtaaagacataaagtaaaattgacgattaaacgggtaagctgaggctagatcaccccagacataaagtaaaattgatggttaaacgggtaagctgaggctagatcactaaagacataaagtaaaattgacggttaaatgggtaagctgaggctagatcaccccagacataaagtagaattgatgtttaaatgggtaagctgaggctagagcactaaagacataaagtaaaattgacgggtaaacgggtaagctgaggctagatcaccccagacacaaagtaaaattgacggttaaacgggtaagctgaggctagatcacccagacataaagtaaaattgatggttaaatgggaagttgaggctagaacagtaaagacataaagtaaaattgatggttaaacgggtaagctgaggctagatcaccccagacataaagtaaaattgatggttaaacgggaagttgaggctagaacagtaaagacataaagtagaattgatggttaaacgggtaggctgaggctagatcaccccagatgtaaagtaaaattgacggctaaacgagtaagctgcagctagatcaccccagacataaagtaaaattgatggttaaacgggtaagctgaggctagatcaccccagacataaagtaaaattgacggttaaacgggtacactgaggctagatcacccagacataaagtaaaattgaagattaaatgggaagttgaggctagaacagtaaagacataaagtaaaattgatggttaaacgggtaagctgaggctagatcaccccagacataaagtaaaattgatggttaaacgggtaagctgaggctagatcaccccagatgtgaagtaaaattgacggctaaaagggtaagctgagactagatcaccccggacataaagtaaaattgatggttaaacgggaagttgaggctagagcactaaagacataaagtaaaattgacggttaaacgggtaagctgaggctagatcaccaaagacataaagtaaaattgatggttaaacgggtaagctgaggctaggtcaccaaagacataaagtaaaattaatggtaaaacgggaagttgagcctagatccctaaagacataaagtaaaattgacgggtaaacgggtaagctgaggctagatcaccccagacattaagtaaaattgatggttaaacgggtaaactgaggctagatccctaaagacataaagtaaaattgacggttaaacaggtaagctgaggctagatcatcaaagacataaagtaaaattgacggttaaacgggtaagctgaggctagatcaccccagacataaagtaaaattgatggttaaacgggtaagctgaggctagatcaccaaagacatgaagtaaaattgatggttaaacgggtaagctgaggctagatcaccccagacacaaagtaaaattgacggttaaacgggtaagctgaggctagatcaccccagacataaagtaaaattaatggttaaacgggaagttgaggctagaacagtaaagacataaagtaaaattgacagttaaacaggtaagctgaggctagatcaccccagacataaagtaaaattgatggttaaacgagtaagctgaggctagatcaccaaagacataaagtaaaattgacggttaaacggataagctgaggctagatcaccaaagacttaaagaaaaattgatgcttaaacgggtaaactgaggctagagcactaaagacataaagtaaatttgacggttaaaaaggtaagctgaggctaggtcaccccagatataaagtaaaattgacggttaaacgggtaagctgaggctagatcactaaagacataaagtaaaattgacgattaaacggtaagctgaggctagatcaccaaagacataaagtaaaattgacgattaaacggtaagctgaggctagatcaccaaagacattaagtaaaattgacggctaaacgggtaagctgaggctagatcaccaaagacataaagtaaaattgatggttaaatgggtaagctgaggctagagcactaaagacataaagtaaaattgatggttaaatgggaagttgaggctagaacagtaaagacataaagtaaaattgacggttaaatgggtaagctgaggctagatcaccccagacataaagtaaattgacggttaaatgggtaagctgaggctagatcaccaaagtcataaagtaaaattgactgttaaacgggtaagctgaggctagatcaccccacacataaagtaaaattgacggttaaacgggtaagctgaggctagatcaccccagacataaagtaaaattgatggttaaacgggaagttgaggctagatcactaaagacataaagtgaaattgacggttaaacgggtaagctgaggctagatcaccccagacataaagtaaaattgatgtttaaatgggtaagctgaggctagagcactaaagacataaagtaaaattgacgggtaaacgggtaagctgaggctagatcaccccagacacaaagtaaaattgacggttaaacgggtaagctgaggctagatcacccaggcataaagtaaaattgatggttaaacgggtaagctgaggctagatcactccaggcataaagtaaaattgatggttaaacgggaagttgaggctagaacagtaaagacataaagtagaattgatggttaaacgggtaagctgaggctagatcaccccagatatgaagtaaaattgatggttaaacgggtaggctgagtctagatcaccccagatgtaaagtaaaattgacggctaaacgagtaagctgaggctagatcaccccagacataaagtaaaattgatggttaaacgggaagttgaggctagaacagtaaagacataaagtagaattgatggttaaacgggtaagctgaggctagatcaccccagacataaagtaaaattgatggttaaacgggcaagctgaggctagatcaccccagacataaagtaaaattgacggttaaacgggtacactgaggctagatcaccaaagacataaagtaaaattgacggctaaaccgtcaaactgaggctagggcacgaagtcacacactgctgcacattggacttgcctcagatgttggttttttgtttgtcttgttttcttttgttttgcttctgttctctttttttcctaaattactgatacccgagtcccatgtctagagtctaatttaattgttcagtgtattccctggacattgagacctttagagtatccccaggtgattgtgatgcatagcaatgtttgagaacaattgctcagaatattctaggccgatggaaaaggccttgtggtaagatgaatcatggcaaaatcttaagaaggctgaaaggttacttgctgctcctgcaggacaaaagaggagggacctgggagagaggcgtgtgcaacatgagactgaatagctggccaagaagaagcttctaggccattataccggtttggtgctttgctgattagcagcaagaagccattcaagtctttcagtggacatgtctttccaccacctcgtgtgaaaaatatggaagtgttgactgcttttctcgcatactttgacttattcgtctgtatgtacctttaaatggacaggattttttgaaattaagttgttcatggagaaactaaaaattttttttttttagtctggagttatcacaaagttggaaaatgtattttaaaaatctacgatggtccatagtcattagatcagtcttcaattctgggtcttccagccaccacaggtggatctgagatgagttgtactgcagtgggctttcaacttgggctacatgtgacagtgacctagggacatttttacaactactgatgttcaggctcaagttagtcaatttacgagtgatagttaagcataatttttgaggttccttaggtggttctaacatttagccagagttaataacaactcacctgctggataaatctttttggatttaattaaatttgggcatattgatcttagacatgaactagagtctcttgatttttgaaaacgaggggaagttaaaatgaacaccttgaggtatttgcttaagtgcactcccttcacagaatagagatgagtcctttacaggcagatctggttaaaggaaactccctccggaatgctgggtgatggacgaaatgagggaaaccttgcctcctctggaagcttgccattggctacatcagattttacatgttgcgttttcaaaagtcagtctctcggatctaactttaaagatatgtacttctaacagttggttctgattatttccccacagttgtgtcaagtccacacagttgtatcaatgcttctgcttttctagacgctagttaacactcagaggttttacatttaacggaagaagaaattgacaaacaaaggaagtaaaggaagtttatgtggaatagaaagggaaggaaacagaccttgaacatgtgtagaaaggaggaaacagactttgtccgggatagaaggcccattgacatgaggaggcatgctaacagaggtcagaaagagtagaaagagtcgttggacatgggccaagaaggttcaacaccaggtagcagctgaatgagtccatcagtggatgggctacctaagcgggtagggcattgtgcttgtgggttattctgcaaatcctcctcagccaacaatgagtgtcattggatccatcaaaggattcagtgaaaatgaagcttttttgggtgaagaattccaaggaaattctgaaggttgtgacttagatgaagaaaaattctcagcatgaattgaataatattcacacgaagtctgaaagttaaaacttagaataagtactgaaaccacaccaactaacaccaggaaacgcagagggccatttactaataactcttaggagttcaagcatggaaaatgattttctaaaggtcaaacttagaagattatgcctttcacctccatgaagtttcatagctggaaaggaactccaatcccaacccctcatttaacaaatgagaaaattgaagtgaaatgatttgccaaactaaggaattcttgagagcaatgcctagagtccagactctctcactcatgagtcttttgtattcttagtctgtcatgctgccttcagaccagggcaaaatatgagactgaactgaagtgggagaaggtttacttcagtcatgggaaaccaccattaagggttatttgttgctgggaaagtacactgttgtaatagctgcactgtaacaatcacagctgactaacagcaagttatcctcagcagagccgtgaacagaaaactttggttgggcttcaggagatgagtttaaattattctctgttacagacaaatttgttattcattccttcattcatctgtgcctcctgtgtgcatgggagtgtgcttggcactgtagaatagataaagcaatagaccctgccctgaaagttcttatagtcagtatggaagataagatatacgtgtacagaattataataaaacactgactgacaaaagtgtcgtgagatctggaacaaatcagtagccaggacatttcagaagatagaggggctatttttatcttctagggcaaacagaattgccagagtcaagattatttcatgaaaaaggtagaatttaaattagacattgaatgataagtaagatgtgcatgatgaggaacaggaagaaagcattttagaaagagggaaaaagagaagcatgaatgaaaaaaattagtgctttttaacaggatgtgaaacattttttaaaatataagttgagatggcaagttggaattagattctaaaatattagtctacatatgtttaaactgacatttaaattgaggacagaagaatggaatagataggtgtggtatcaggatgtgttttggtaaaagcaacttaagagagagcgaagactagtctggagataagaaggactgaaagcctagagatatattagtttgttctcacgctgctatgaagaaatacctgagactgggtaacttataaaggaaagaggtttaattgactcacagttgaacggggctggagaggcttcaggaaacttacaatcgtgatggaaggagaagcaaacacgtccttcttcacgtggcagcaggaaggaaaagtgctgagcaaaggggaaaaagccccttataaaaccatcagattccctgagaactcactcactatcatgagaacagcataggagtaactgcccccatgattccattacctcccactggttctcttccatgatacgtggggattatgggaactataattcaacatgagatttgggtgggggacacatcaggagacttcttagattatgattgcaaaatctcaggtcagactaattgaaaataggaatcagaggaacaacgataataatacagattacaacagagagggacgatagagtggtgagtggcaggcaatgtctgccaactggataaaagtaagagaatggaaatggagaccccaagttggtttcaaagattctaagcctgggtaacaggagggaagacagagtcatgaaaatcaatatgggattcaaatgtttccgtgtcactcatcatattctcatagtttggaaaaaaatacctcactctttctcccaaaaatatttaaatctgccatacatattatatattgtatatgtacaacaggtccataaatgcaaattttgtaactttaatcacttttgcaggttagcatagatttacagcaaaagggaaattgacatagaattaaataaattgtgcagtagggaaatgaatttttttttttttttttttactgctctttctcaaactctagactctgcctagagttttaccatttgctatgctgcctcacatattccaaaaattattctaagaaagagttatttggagagttgatttagtttatagagcagctactcagaattgaaaataatcaatagtaccttaagattcaggctctaactggatatttaggcaagaacccaaacagacagttactcctataacgacattgagtaaaatgtagagagcatgaatgtagcagcccaacccatctgttctttttttctaattttgaagaggttatttttatatcagtctttggaatttttagttctgtctctgctatgctacataaatactgatgctaacagactaaatttaaaaaaaaaataaattgttgataagaggaagaggaaattgcgagatataaacctagccattttcccatttaggtggtatttccttactttttaaataaactctatgacttttactttctcactatctcctctctgcatcagttttcttattaaagtctcaacatttctgataatgaatgtctctagaatttctttacaggagacatttaggggcagctacctaaaacaggagagttggggggcttattttaaacctaaactgaaataatagactatttatttatttatttatttatttatttatttatttatttatttggcagagtctcactctgtcacccaggctggagtgcagtggcatgatcttggccactaacatccacctcttgggttcaagcaattctcctgcctcagcctcccgagtagctgggattacaggcatacaccactatgtccagctaacttttgtatttttagtagagacagggtttcaccatgttggccaggctggtctcgaactcccgacctcagttgatccacccaccttggtctctcgaagtgctgggattacaggcatgaaccactgtgtccggcctaatagacatatttttaaattgaaaatatatattactgattttaaaaaataaagatttctaagatgattttattcaggctttacataagatttttaaagagtccaatttcctaatattattactaatattattatcagaataattattctgggggagactggtgttaaaacagttcccaccatagctgataatataataaattgcattggctaagtgtaatttatgaaacaatgtacagtggaggctcctaactacttatatgaagactccaatcacttctgaaattgcatatgcatgtattacaccaaaattatagaataatataaatatacagcagtctatatatttattcaattatcaattcattcacttatcaaatatttaaaatgttcctatcatacatataggtgtggatatctaaattcgcacatgagcaaagcaaaattaaatggcctatgccattcatctgaaaagttaggcataaacactccactgaaaaatccctttttctaagccctctttgttctcatcatagttaaaatgataccttctttttactttagaaactaacgttcaaatattgtaactcttttactaaattcacggtgtagtggttaaatgtatcactctggggttaagctccccaattttgttacatacttgctgtgtgtcctcagagaaattacttgaccttgctgagcttcaatttcctttttttttttcttttttaagttatttctttcttttttaagaaacagggtcttactctgtcacccagagtggagtgcagtggcacagtcatggctcactgcagccttgacctcctgggctcaagcaatcctcctgcctcagcctcccaagtagctgggactactggtgtgcatcaccacacctgactaactaaagaactttttttttccatagaaactaagtaaagacatttttttttttccatagaaatagcatctagccatgttgcccaggctggtctcaaactactggccttaaatgatcctcctgccttggcctcccaaagtgctgggattacaggtttgagccaccaaacctgacctgagtctgttttctcaataataaaaaaaaagatattaatcgtacctatctcatagggtggttgtaaagattgaactaatgaatacatataaactacttagaacagtgtcttgtttgtggtgcgcccttaatgcaagtttagtattcttctgactgaagccttatttgtcttcattaggtcttccacaggcttactttccttgtctcccataatcacccctaaacaattatgggccatactagctcagcaaataagatcattaaaccaataattgtacctgtgtgtatttctgtataattaatatgcgttcttggctagaaattcttaaaggttatactgatgtggacaccaaatctaagtgataatgccaaatttccagatttcttatttaacatgttccagctcactcgattattataagaggttttaaagtcaactgtaatttcaggtatctattggaaaatacaataaatatcctctaaatgataaaaagatagaataatgcattaatatagctgaaatatagacttggaaggcaacaacagcagctggctatgacctttttattgagaaagtgacccagaaaatggccgaggaaatttcatcatttatttcccacttctgaaccaaagtctcagatgcctttaaatccccataggataaagttggctttaggttgtatataaaatacaaattgagtaagggaatattttttctttactgctcagatgttttatcagctttgaatagaaaaacacactaatatttatttccttaatatgtgcacatcagctttaattataatcaatccttccatagacggatttcatgggatttaatgtgctaccaaatgcaaagatagaacttgctaattctctacaattacacatttatttctgggcatgtgggtataaccgcacctccatgccatgttctttctatattgctacaaagcactatggattaaattgtaggtatggagtaccatattaatttggaagtttgaatgtctagaatattttatatttaagtacagatcacacagagtggacactccctagttaagttgttgaatggttgaaacaggtcaagataaatgaagccgtacgataaactatggaagacaaaaataacctgtctgtaaatttgattttggggctaaggtaggtttcttttgatatcacatttattcctgtgtgaaatataagtattctgtgttcataacagagtgaaaatgtatacatttattcaaatgactaatattaagagcatctactgtgtggacttatgaaataatatatatttattgcattcacaatgcttatatttgagtagagaataaagacaaggcaattaaaatataggggtatcttataactgagtttgtacactttgaccatattttgtacataatgggtggtggtggttgtgttaattaatccaattgtattcatcattacacaatgtgtgtgtatatatatacataaaaataaaatcatcatgttgtacatcttgaatatattcaatctttatttgacaatgaaatattttatatacatatatatacatatatatatgcaagtgctagggataagcagaaatgtatctggggacatggaaggtggctctgtaggattactaaacattttgagaaaaatcacatttcaacttcacctttgtaagaggttgtgctgggcttcctttccaaatgaaatgcggtgtgacagaaaatagactcatgtagctctctttagtgggatagctttctttctcaacatcaactaacacatctcctaggtgtccttaaagtttcaacctataaatattctacctcattaagcataaggaccagccatggacatatgccgctagtgtccactttccttcagagatttagggtgatgagaagataaagggtctgcttaccagatggagcttgtcagattagcaattggagcagagtaaatatcgctgtcatattgttgttttgaagcacaaagaaccccttttgtataacgcatgtgcatatttaatagtttaaaacaaaaaaagctcagcagaaggttggctggtcgttgtacctctagcagagtggccattgcctgaaggcacggtgctgttttcctcataatagggaacattagcaaccagtggcttgagaaaggcagagtcaaatatgtctcttggggcccagtcggccacatgaagtgagagccgttagacgcagcaatgagattactgctccagaaagggtttgccacatatattactgcagaggcttttcagggctgccagcgcactcaacttacaaatgtcaaacatgatttaaaaggttattatactatcaagagggaaggagaatgattttccatcactgaaatttctatttcattctgtggcacataccgcatctcacgaaggccaatattgctaaataacctgcttttatctttaataagtgttttatggaccttaaattggaagaaccatttccactttatttgtattagaaaatttgatcttttctggttgaataacagcatgagagatacagtgtgtgtatctgtgtattgtgcttagcagattgttctttgaggggagtaaatttgtctgtgacgtgtcagttagggagagcgtacatacgtaagctgtagttttgataaatgcatttgtaagtctgcagtattttaagctaaaaatgaccaggtgcagttctctgtactgcattacttatttctctttgggctttattgtgactggtatttaaaacaacctgctttcaacctctctgacccctttgggaatatttatttgctcaataaggactctatttgttggcctcaatgagttaatttaagtacaattgtatttgaaaagttgctcaataaaagcagaagacgatttttcttttattttagggagattttcactcttgttttgtaacatttgaaaaataaataatcttcaagtgtggctgttaaaatgtgcaataaacaccttattgtcaatgtggaatttttaaacattgcctttgcagtcataaaagaggccaaaacaagggatttcaactgcccttttggtagcattcttcactctatttcctagcaaatcactgatggctttttctgagggtgagactgtaaaactgaaggttgcctacatttccaggtcccagaatgtgccatgcacagcaatacatcagcaatctaagctgacacatttgaggatggtgttctcaggtgggatgtaaaaaggacagaaggatacagtctatggtgttgagatattgtctgttccccctttatctgagactctgaagcattaaattaaaatctgtgaattcgcccatgttcacatgggcattgtcaaaattaaattaaagcttatggaaggaaaccttctcagcctgaagagtagcacctttcctccaagttctgcaccgattttgtcatttgccaaagtgcaagtcacaacaaaaggaaaagaaaacaaaccaaaaaaatctttgaattttgaaaaataatcagacttctttcatgggacaatagcactaaaaatttaaatttattcgacgttctccagatggagtatgaaattagctttctaacatttgaacaagagtgaacctgaatatctacataaggattaatatgtatgtctgtctgtgcccttttattcttttgaagactttctgtaatatatactgatttcaggtagcttctttattgttatataaacaaaaataacaaatctagagacacaaaaatatttccagtttaggaaataattagaacattctatttttcccccttcttttaaaaagtaacaatagaaagaaaaatcacttaaatattgaatgataataaatatgttttatcttagttttgaaatttgatgaaatagtaaattcattataataatgtattcatatattcagtaaccaatgacatatttatgtaagtcttgaatgttttaataatcctatttaaaaattttgaaacattattttttctaattggattaaaaactcccttttacaaatctctcacatggtttcttgtaattgaaaactcttatagtacatatgaaatacaattctattaataaaatatgcattcatatacacctttttaaagcattcaattatttgggcaaagcaacgcaaatgtataaactcaaagatataaactatgatggttaatttgatgaaatatatctcacattaaactgtaaaatgaaacaaaagtgtttcttctatagtaaaatcttagcttctcttaaaataaacacacatttttaaaaatcctgtgtgaccctgtcttaaagaggtaagttcactaatagaccagtgaactattttctagaaaccaaattcaattttgaattaaaatcatggtctaaaaagatggagacatataccacatagcataagtttctaaaacttatgtcagtccatatatgggagaaagttatctttctactatgattctacaataaaaatattcatttatatctcacaacttagtaaataaatcagaggaatgtttaatcttagaatggctgcagtgaactggacaatcattcaccccaacatttttttctagaattcttaaattgaaaattaaatgtcatgctaatagtgtttcgcttcctttagaaacaaaatcattgtttacaaaaggcactctctttgcatctgacaatacgcaatttcatttttcattctagttatccttaaaaaatttaataatgcattcttgccacctctttcccaatgccaaaatagataccttgtcaccttaaaatatttcacagaacaattacagcctttaacatgcagaacatagctgtctgagaaatagggcactttctggtgcttgtgatatataaacttcattggataagaaatcaagtgcctcctacatgcatcctggcctcgttaatttatgttgatggctggtatgaaaaagatagggaggtggcaaactggtgagttgtctctgaccaaaaagaattatttattttgttggaacaatgtaacctaacactaatattactttttatttaatattggaaaattatacattagataatgttttctagaaattaagctagctattttaaagtagagtttaccatcttggctaagggattgcaaacataaaagcatacaggggtgaagtgaatcaagtcaaagtgaatggctgcagtgaactggacaatctaagctatcaccaaggacatgtttctttcaacagtctactgacagccttccccagggctcccattgctggcttcttcacgaaggcctgccattctttatactacttatcaggctttttgaaaaagcaggggtgggggcaaggtgcggtagctcacacctgtaatcccagcactttgggaggctgaggctggtggatcaattgaggtcaggagttcaataccagcctggccaacatagcaaaacaccatctctactgaaaatagaaaaattagctgagcatggtggcgggcgcctgtaatcccagctactcgggaggctaaggcgggagaatcacttgaacccctgaggtggtggttgcagtgagctaagatcacaccagctactcaggaggccaaggcaggagaatcgctggaacccataaagcggtggttgcagtgggctgagatcgcaccactgcactccagcctgagcaacagaatgaaacttgtctcaaaaaaagaaaaaaaaagtaggagtagggatgtttttgtcaaatctaggaaatgtgaaatttcttctagaaaccacctgaattatattaaaaatattgacaatatatgagtttttaccttgatgaaaggagatatttctttttttttttttttactaaattgcttttatacaaagtctacaaattaaatctgcatataaggagagttaaatttaaatattaattttaagatttttggaaaatgcggcaatcgttcttttcatgtgagagataacaagtctaagccagatatttagtcatgttctatgtaggcaggaagatctcatctggattccctggccttcttggcattctgactcacaatgtcttcatcagttttctagtgatagatgaataaaagcataataaaagataaaccaagggcatcgtcaggtgttcaggggagcctaggcattagtctaggtgggagaaagaacctagacttcctaagtggcctgggactcccaacgttgtgtcagtgacgctggatatatccaaatagactgataggagagccctggcaggagaaacagaggagcatggatgctggatactagacatcaatactaaaatatatgttgaaaaatttaaatagtaccagttctgaacattcttgtggtttcataactttatagagctatgatatatactaaagataatcgccacttatcatcttcagtgaaacgagtggggccagggattttcatagctttccaaaatctaaaatgcctctattgtgcacagaatttgtaggttacttggacatactgtatttctctcagattctaactaattcttagagaattgtatttctctcagattctaacttgtacttagagaagttaaataactgactatatagatacatgtatagaaaatggttgatctgggatttaatccaaggtcaagattaagacttaaccaagattcagtcttgatccaaaacttttagtccaatattttctcgaccataaatcaagaggttaaatgaacattggattctaattctgactctactaatgatgggcataggtacccatattatagggctgagattcggctatttattgtttttttttttttttgctttattttgttttgttttaatcccaagtaatttcaatttatagctaggattgagaaccactggcttaaaatctaagaaaacttaatttattttccttttcctttactttcatatatattctaataaatgccagttgttactaagctttacatatatatactcacaatacataaatacgtaaatacataattcacagaaataagtttatgtgcttaattatccatctcaaaagcagatttagaggatttaggagaaatgcagcatgtgataccaattacaagaagaaatgggaaatattcttttgtagttggttgttcctaaattctggtgttttcatctggagggactgaagagaacttctatccattgattatctatgatgtgccttcatgcttatggagagatttattcattcagattctcctggaagaagccactgtgtgataatgaaagtctcataattagggttgccaagtttagtacataaaaatacttgtattaaatgtgtttatctggtaacactactactaagagcttggctctcaaattcatctctggtccaggtttttagctctcttcccagatgagtcatggcaactgccctgtctgcaaaggcaaaacatcatccttctcttctttagagacactgacctagctgaaatgtttctctggacaatccaagaggaatcaaacatttacatcagcaagaaccacatttgtgtctgtgatactgttgaagggtccatagagagataactgatttttaaagcagtggtacttgtaaaacagcaacagtaaggcttaaaataaattaatgccaaaagtgatttccttcattccttaatgtaaaatcttcctgcatgtaattcatagtaactgaaaatggaaagtaagtggtagttagacagtagctcttttttccattaaaaaagtttaaaagcttcaagtttgttttctatgtacggtctaacatggccatgcagatattcttcattcaaagttagatcccctcctagggtttcagtgactgaaagaggaaaatttcctcttattttacgtttcctttaatggatcacgtatcaaattttatgtacacataaactcaaattaagagcccgtttattgcgaaattgtccttaaaaagctaaatctaacattggtaaaatttagtccctatttgtagcctgatggtatctaaaaaaaagttttgggtaaaagtaaatctctacaccttcaaattgaatgttgcagccaattgagaacctatgagaaattaaattgagaaagatgtttttgaagacccatttcgggagaaatgaattcctgtgtcttgagaactctaaagcagataagaaagcaaggcaatggatctaattctgtttggagcataaaattcctgaaattgaggatatataagaaaagattgatcttgtgtctatttgtcttgaagttcagttcaaatctggttctggagaaaaagaaagatattaatttccagacagagcaattgtgtctttcagaaaaattgtgcatttcttcccaattgagatgtctcaaaattaaatggtatggtgcaaagcttcattatcttgtttctcttaagattcaagccttttttttcagaacagttatccaatatcctaatagatgaaacataatttagaacaaccctgtattataagacccagatttaccaatacaatatctatttaaatatagaattactatttaatatagaattcagtgtggatagtagttttgagctttaagtgaaaaaaaaaaaataaaagaacagaaactccataatggattaggtctaatacagccttttggtcatgagtgaagaggctaatgtaatatgagcactcatgagtaatcagatgtcttctgatgagtgaattgaaatgtcatagcagaagtaatccactatacattttattatgaatttttgtgggtaggtttaaatttattttctggctcatttaatttatttaatcaaaacaaaatctaagatgcatggaaaaatcaattttggtaataagagatttaccccaatatatttattcatttctaatgttttctttttctcattagttgactgggttataatttttgcttgtcattctttatagctttgtttctggtttttgctaaaggccacaaaactacatacatcaggtatttccaataatattgtactattgtatgtgcaccggaaatatcccggtgctttcggtagctccaatcaaatatgtcttatacatgatttgtcagattccacagataaactgtatatttgcaaaactggattttagaagatttagtcaattagaaatatatgtggctatgtaattggcttctattgttttgctcttaactcatctaagatctaatgctaagttcatcatatcatcatgatctttggtgagaatgtaattgctgaaaatgttttgaaaccactgggtcagtgattaagaacgaaagggattcagcgttaaatcaaagttcccatacgacagtcatcttgattcacaggaaatggggattgaactgggttcacttgaaaagtactgaacctcttaacttctcagggttcttgttgtatgttagtaggatatgctttaatgtggatcactaatctctttttcataatcatttgtttctaataaacaactgtctcattctttcgtcttttcatacatcactcaaaacaaatgactcagggccgggcgcagtgggtcacgcctgtaatcccaacactttgagaggccgaggtgggcagatcacttgaggtcaggagttggagactagacagaccaacaagatgaaaccccgtctctactaaaaatataaagatagctggatgtgacggtgcatacctgtaatcccagctactggggaggctgaggcaggagaactgcttgaacctgggaggcggaggttgcagtgagctgagatcaccccattgcactccagcctcggcgacacagcgagattacatctcaaaaaagaaaaaaaaatgattcagaaaattttaaaattttttaagtttttatccttcttgagcatatatatgtgacagccaggggaattccagatgtttttcagcttatttttatgtctgacaccagatactacataaataaaaacagttagaagttttgtttattgagtatttttgtgattacatatctagacaactttcaaaacaaccagtcagtggtttcaagtatgctttcatctccatcttgtatcatatcattcatatattgttggcaaatgatgagttttacctgtattatttggaagcattttatgaagccagttttagaagttcatttaaagaaacagaaaagctcatatgcctgtctctaaccaaggacacaagagcaagtgaatgagggtgttttaatttttattttttgtcttacttttcaattcacacataaaccaatatggaagtagtactatctaatgtggaagatagaaacctatatatttttaaatatttttgagtgagtgtgactagacaagtcagatagtttatcattttcattcttaggccataaagatccctctggcaaactgaagagtttaatgactacatattttcttaaactttaactgtcttgagtgaagggtacacatagtttgcactattggtgagtgaaaatgtctaccttaagcaaagagaaaacagtcctcctctgccatgagagtgaatagagacatacatgtcagaattcaatatggcagctactcatggaaattattcagcacacacattttaaaaactcagaaatcttaattatcaccaaatctaaaaaatctgtgtcctttatttaccttttctgttggcttttagactcatgcttaatttcatagctgacagtgcaaagcttatcttcatttcttaaaatttctaattggaacccagcagttgcatccataaaagaaaatatttcttatgtggaaatggtgtagcctactccactttccatcagataaagattaggttaaacattaaaggaacaagataaagcataggtgtgcatttgctatttcaagtaccaatttctattttatcactcaggatgggttagagattctgtgttaataaacagtcccaaaagttcagtggtttttccatttaattttttaattgatacataacaattgtacatatttgtgaggtatataatgatgttttgatacatataatatgcagtaatcatatcagggtaattagcatatctatcatttcaaacattaatcatttctttgtgttgggaatattccgtatggtccttctaactatctgaaattatatattatattattgttaactatagtcatcttgtagtggtatagaatactagaacttattcctcatgtctagctgtaattctgtattctttcacaaatctcttcctatccctgctttccccaaccattcccagtctctagatcagtattttttttgttttgctttgttttgtgttttttggtttgtttgtttttaagatggagtttcgctcttgttgcccaggctggagtgcatggcgtgatctcggctcactgcaacctccgcctcttcgtttcaagcaattctcctacctcaacctcccgagtagttaggattacaggcatgcgccaccacgcccagctaattttgtatttttagtagagatggggtttctccacattgatcacgctggtctcgaactcccgacctcaggtgatctgcctacctcggcctcccaaagtgctgggattacaggtgtgagccaccgcccctggccaggatcagtgtttttaaaagcaatttatttttaaaaaaggtctaaggtctaccagtccttgggctacatgcctatttcatgttggctggggccttgctctggcataagtattgactttccttcagtatccagggtgaaggaatgttgacactctggtgatagtggctgagggaaaggagagttctggaagcttttgtatcaacataaatccctcagcccgtagtaatgcatgccatattctgttacaactcataggccacaacaagtcacatgccacacataaccacaaagaagtcagaaggcaatctagctatgtttctggaaggaggggaccaccacaaacattcggcaagcaccaataatgattatccatatactacctgcaaatctaaaaccccaatttaggttccattgctaccaatcttacttagtctacatgctgacttaactccatattttaagtattgactttttaaagaattgcatccagcatttggccttattctttaagcagagttatcttttatgtgttattgatgtgtttttcttttaaggtgttttgtcttaagtcaaaacaaactctagtgaatatgtcattagttactaagcctaataattataacattgattcaacaggattaaaatttatgcatgagattctgctatcaggtttttcagggagatgttctgtgactccaagacttacagtttctgtgttttgcatgtcattttacaaatataccagagaatagactgtgagtcatagaattctaacatcatagggttgacagggaagtgttaaaaaatatatcatctatttcttatattttgacaagattgtacacaaggcattatatatcaagccattgaggatgggagggcagacagagaaaattatttcccaaaattgtttcattcaattcatcatagagcaaggttgtcccatataactgctgtagggaatgtgggtagggtttgtcttgtgaaaaataaacttatttttggccttctttttgcttaaatttcagtagcatgttttctctttacaacaattttcaaatgaatctacttggaagtttcgtatttatctcattagcaaaattagtattgtgtaagttcataaatattctgaataataataaaaatgaaaataaaacaatgtggtatagggagaagaaagctggatcacattactgtgatccctgaagtgccttaatgtcttcaaagcctcagtttccttctccgtacaatggaggaaacaaaataaaccttttgcaaattaataatatgaacttggaactacacaaaggtcttatttgcagaacagtcttagaataactacataaatagaagcatggtaagtgtaactgtacataaacaagcacacaattttaaatggaaattaaattttattattcagaccacattgattttatctgatcaatctactctcacatatttgagttacaaggtctgagggtgaatggtattgtgtgatgaattccaacaagtctgggctttacttaatcaaattttacagcattggaccaaacagtaaatgctggtgaagttgattcctttgtctctccttaactttgagacacttaatcaaataaaatcataaaatttaaaagctagaagtgactttgaattcatatcctctaatcctttcactcacattttttaaaactgggctgttatcagttaggaattttattcaactgctagtgaaagatttttgaaagttaatgctgtatacaaattataaatatatacctccaatgtttttgcaagtttcttggccttccctacgtaattggctacatggatggcaaggtttgcacagcgtcttatttttagaataataagagtgacattcaacaaagaaagctgatttaaaaaagaaagaaaagaatgataaaaggcaaaagggtaagtggctgataagtttgtctcgtcttaaaaagagccagggttttttgcttgtaacttattgcccagcattttttttttgaggtttcaatattttattcaagtttctgtaagtgatgttaattacagcatttgaaggggaggatataattccacacaaaatggaagactttaaaatgtacccattaaactgctaaaaaacaaattgagtgatgagaatacaaaagaagtccaatttagattctgagtgttgtcaccatgtgattacaatcacgcagactcttccaagcttatagctggagctcctggaagctatttcttactctggtgcaaggacaaaaaaacacaatacaggaaggaataagtcctgaattattggcttcatcacatccaccttctccaccccaaaatggcacggaagaaacagtgaccacaccctgcagaccatttggtgtaaaagaggtgacgacgatgaactgcggtgggaacaggtcatgaagatctgtataaaaaagtctcattcagatgagtttgtaacactgtcaagcagtgagcctctcatcagttagggttaggaaaccaaggttcgattctcaggaaatcacagtttcattaatttactcaatatgaatttacaaagtgcctacatattaccagctaccacttgaaggcatttctagataaaaaagaaacttggcatctcacaggggctaccgagttccccccaagtctactactgaaaggatcttttttggaaatgggtttcttctgtacctctgaaagggtaacatcttaaagcagaatcatctttaaccttgaggtctaacatatttagcaatacttgcatcccagtcatacaatattaaaaggtacactaaattctgaaggtagctatgctgcaaaatagtttaaattaaacaattgtatggtattcattcatgcttgaaatttcagtcctagaccaagcttgtggccaccagccttgacgttcttgccatccaggagagctgacagtgtcagtttgatacctggctgcagggtctgagtgtatcctaaacctatcaggctggagttgttcactttagtggagaagcaggcatgagggtcagtctgatacttggctgctgttccgaagcgcgtgttactgtttcctgctgtccagacgagattgacagcggtctccaacttcttgttcaccttctggtaaatggagccgccaaactctgtcccgtcattcacagtagtgtgaagctggaattcatcagtcctgtagccaactgcaaagttgctctgggtcactcaggaaggactttgcagtctcaaaacgcatctggtacccagccagccagccctgtaacccggcactagagcaccccggatggaaggcccagcagtgtggaaatccacgtcacagcccaggttaatgtgctcccacttgcaccctgtcttgattttagcattttttttttcccagtgttaggtgacgaggatgaatgcaaggtcagcctcaggccacgtgcaagctgaccgtccacgctcatctcggtgcctagtgtattgtcggggttccatttctccgtagacctcgagccatagtcagtccatcggtacctggtttccagactgcccgtcactttggtggtctcagtgttggctgagcctgagcttgtaaactccgatccatcctcagatttcgttttcaaatcaagctttattaagccaatccatagcccttggtgaagacatccctagcagatttgccaagatcggcatacgtgggtggcacagccgtcttctgctcaaaggtggcggcgggctctgcgggggctgctggttgctgctggggggctgctgggggggctgctggggggctactagggggctgctaggggtgctgctggggggctgctaggggggctgctgggggggctgctggggggctgctggggggctgctaggggcgctgctggggggctgctaggggggctgctgggggggctgctggggggctgctggggggctgctagggggctgctggggggctgctgggggggctgctggggggctgctggggggctgctaggggcgctgctggggggctgctaggggggctgcggcgccaaggcagggagttgcccaacattttaatataaggctccacattgcgaagaaggtggggtgatttattttattttatgttatttatttattttattttatttcattttattttaattttattatttttttgagacagggtcttgctctgtcgcccaggctggagtatagtggcatagtctcggctcactgcaacctccgcctcccgagttcaagcgattatcgtgtctcagtctcctgagtagctagaatcacaggcacctgctatttttgtatttttagtagagatggggtttcgccatgttggcccggctggtcttgaactgctgacctcgggcgatccgcccacctcagtctcccaaagtactgggattacaggcgtgagccaccacgcccagctagtaatgtagttttatgactgatcaccttatgtactcttccaattctcaacttctattaataaaaaataaaagaatatagataatgcattagaaacatctgctgcagggaactgttttaccattacagataacgttatgaatacaagtatttctgttatttatatttgccattatgtctgttctggaatattatcaaaccagaattataactagcaagagactatataaattaaaatcacacattttaaagtaaaactgaagttggttcaaactaggactccaccacttgagcaaactacttagcacaaattacttaaacctcgatgttctcatctataaaataaggggtttacaaggtcaactactaaattagataatacatgtaaagtgaaatgcctaaatacaatgcctaggatacagtaattgccctgtaagttgtaagtgctaccatgaaccagccaatgatctctactacatactatgattgagaaattaaagatggttgaaattttatataaatcgatgtcaaggtaatattatttatgaagttattgtacttcaggtcatcatgattgctttagtgcatttgagactcttttcttagatgacaatggttctaatccatcttctatcaaagtctctatttctccatttaaatctggcagatccgtcttctagagacatgaccaagtcaatgattttgattagtctgtgctccttacccaatattacaatacctggaaagtaattatgtttctatttttcattttaatctgctcttaccatattgacaatatgggcaatggctaagtccattatgagtttaattgctttatgtgccaggtgttcggaagttcattctttgaatctaatgaaagtaaaagataaagtcacagaactctggttcattttatgcatacattattctaactttggataaagaattaatcattcttttacatcctgtattgtttaatgtctcccttgcccagaaataaggatttttatcacagtgacttcagtcactgatgaggcatacatacagaaatctcctgttaagtaagattagaatttgtctttgggcctttttaaagtttctgcaaactgataacccaattgctcatgctgattgacagaacaacattgaatatctaagtagtctaggcctttgtctggtcattagaatttgtccttttgaggaccattggctggaaactttatactacaattgagtgtgctatgagtaagacagcttcaattgaagcctctgaagaggaaaggaaaataacaaagaagacgcttttgtatctttttccattatcaataacgtcaatatagaacatgccttttttcatatgaaacttcaatatgaacttattcaaatgacactctggctatgtcataatgtctgcattctccaggtatatatgaaacagattttaatggatgttgggtggcttccattcaccctttcatatttgaaaatgcacttagaaactctgttgagaaagttgcttatgctattggtcctccttttctgttgttgttcagtctgcccccaagtggtagagagcctaaaaacccaaaaagataacaacgtggtcaatccatgacttatcagctgcaattgtatgcctgattgatttttgttgctatacaacagctgaacaattcgaaatttatcacatggaatatgaattcacctgttcaaatcatggtagtataataattcttgaaattgcagctgcatattttaattcattacaccaagtaaataaacttcaagacattcagccaccattcatgaaatagatttctaaaggcttatgtggggatcattttctttctcttaccctctaccctcttgttttaaaactcctctccccaccatggccttatactggaagacatttttactcttgatttctagcaattgctggctggtattgttgagttttaatatttcagtgtgattcagagctctgaccattttcaagttcttaggagccctctcttgtctcatttttaaacatggcctttggggaatgacagtgattgtgacagatggtaaaggaataagattgcactttggcgctgcttctgtctttgcctcttgatcttttcccactttctcaaggcaaattatagatttccttttgcctctagagggacgcaaattgcagttgccagttatatggttctttgtttctctttctagctcttaaaaaaaaaaagaagggctcttatttaattaaacattgtcattacatttattgttgatgaaaggtactgatttgtatgttggccaaatatctgaccagacaagggagaggacttgttgaactacaggcaaaaaaagaaaaagaaaaaagaaaaaaaacttttgttgcgtttgaaggtagcttccctctagtggcaaaaactggtacttcacttgtagactacaagcgatttaaaaaaatatattttttgttatctctttttaaaacattatctgatatgtgtaatgtacatatcacacattttaatgaatgtggcttgcaactaaaatcgagtttcctaaaaagtttagaaatcttttcagttaccaaattcataatcttaggtatgcaaagtaggcaaggtactttactgtccattttgttcttcagtaatcccacacatacaacacacaattccagatgaaaggattctagttgactaagaagatagttaataaaggggttttagatttttttcataatttattgggtcggagttaactcaagcggttacctcctcatgccggactttctatctgtccataatttatcaaaggagtgtgaaggaattataaagtatcgcataaatttgggtggtgggcatattgctgtacttctctgtgtattagaaatattttaggctgggcacagtggctcatgcctttaaacccagcactttaagaggtcaaggtgggaggattacttgagcctgggagttcaagatccgcctgggcaacacagggagaccccatctccacaaaatattaagaaattagccgagcatgatggcacacacctgtggttccagctgcttgggcggttgagataggaagatcacttgagcccaggagttcgaagctgcagtgagctgtgattatgccacttcactctccagcctgagtgacagagagagagaccctgtctcaaaagaagaaaaaaagaaaaaagaaaagtttgatactggaaaaattttagagagaggcgatagaatcactagatagttaaaatttaagtattagaatttaaagggcactagagattagttgagtgttacagttttaacttgaacttattcgttcacattcatgtaaccactacaaaaggatttaagcaatgccaagaatgagctataatttagacaatgtgcaggaaatacaaggacaactaagacgggcaagcggcaagtgaaccgagaactgtgcaaagagatgagtactaatggaaatatgtacaacaaactaagagagtacaccaaggacaaagtggccctttgtttgagacggatgaaaggacagttaagtacagaagataagtgtaaatgatcaagagtttgggcacagtgcacgggtattttccatgcacatagcaccatgggaagtggttctgagcaatcaggagataacagggcttcaagtatggaaggcttaaatggagagagctgagggagacttgttgttaataactttgctagagcaagtcctaagcaggcactgttttataccataataaataatcaaatgagagaatatgaggtttggttccccaggctccacacgtgactatgaataatcttataaataatagacttattcacaaaacacaagatagtctagaataaccgaatgaaatgatgtttttgtgcttctttgacttcctaccaaacatagtgttccttggaaggaattatgtttgacactgtattgtatgactggaaaaaaatctataatgaagaggtgctcacatatgaagtagcactgagaaagttcgcttcaacagaggtctggtgatgggagaattaagcataatcaaaagttctagttgcattctgaagtcaatttcaagttgtcagtcctaattgggagtggggtttgtctaacataatgcttaagacattttttggtggcaaaatttctcaatttaaaggaacatgatacaagctcagaaaaaatgcagcaaattgatgactaagacctaggtaatctgtaagtaaggaaatgggatgtcaggagagaaattgacatttgtttagataatatccacacttggttggatggactatattttatagatattttcattcttgaatattttagtttctaagatctttattatgaaacaagaacataggtctaatatatatgttatatgtttatttatatataatatattatattatacatatgtattataatatattatgtaatatattatattatacatatgtattataatatattatgtaatatattatattatacatatgtattataatatattatgtaatatattatattatacatatattatgtattataatatattatatattatggataatataatatattatattatattatggataatataatatattatattatattatggataatataatatattatattatattatggataatataatatattatattatattatggataatataatatattatattatattatggataatataatatattatgtatgttaatactatgtaacatatatattacaattataaaaaaagtgtatgtaattacttgtatcaaatagtgttttatctgactccctccatgtccataaacatatttcccacactgactatcacccatgttccctcctacctttacatactcaaggatttccaactgcccaggactatgaccttcatgtcccaagcacattaaccctcctttggcaatactcacctgctgttgacttttcatacttgctctcctgagttgagacttaattgtatctctcaagaccctgatatcaggtataagatgagatcaagtttataatctaagaagctcctccatgctaatagaataacacatttgcattttgacctgttctttcttccaaaattaatcaagaaaaagagcttttctgtagaacatgggctatttgagaaaatgtgtatcaaatgagtttgtcatcatttaatcacaccaagtgcatgcctttggactctatttgtgtatagagctaaaccaatatttgataaatgtttgcaatactgataacaaatttcttagataaatgggcaatgttattcttgtcttttaaagatgaaactcctgaaaatgattacaaagcccattgcttcatcacacacagacacatccacacaaacacaccatacacacacacacaattttcaagctttgaaaggctcatgtgtaagacaaagggtattttcagtaggcttggaaatcacttggcatttttgagatttgccaaacagcttgagatatttaaaaatatttttgttcaaccaaattccaaacatgtttttctgagtactttttttaggtcaatttttataaccatgtgtaatttcaagaaaatttaacccatatgtttgtttctgttagtgtatattcagattgatttataacacagatgtaagtatttctcttaacactggtatatgaagagggtgagagggtctcccaatttgctgcttgggacagtccacagtgagactttagattaatggtcacagactataacccagttctaatctcaacacagtctccatgataaaagtcacaggggactggctataagtgtcagcaaaagatcagatccagttactgcagtatgttgatgaatatgtgtgttcctagcatggactcaaaagatggaactctgactgatgactgtacagcactgtgagaatgaagcccttaagtgctactaaaaggtctttaccaactgtgatgaaaaactgcatctgtgagtaatgctacttactggcaaaataggactgtgacctgccaacatattccattattttttgtggcatcgagtataaaagtagacccgttgtccagttgtagggaaagtagaaacacaagtcaaaatactaccatacttcataggccgggcgccgtggctcacgcctgtaatcccagcactttgggaggccgaggcgggcggatcacgaggtcaggagatcgagactatcctggctaacacggtgaaaccccatctctactaaaaatacaaaaaaattagccgggtgcagtggtgagcgcctgtagtcccccagctactcgggaggctgaggcaggagaatggcgtgaacctgggaggcggagcttgcagtgagccgagatcgcgccactgcactccagcctaggcgacagagagagactccgtctcaaaaagaaaaaaaaaaaaaaaaagctaccatactttacagggatagcaaaaatgaatttttaaactagcgcgtgtttcctgtaattcttaaaattaaacagaaatagaaaaactctaacaagaacctcagattcagccaatgtgccaccttagaagtgatattctctccatagccaagatgctgtaggtaggaatgaataataacaggatgtcagagtaagtgccaagtggaaggaaattaaagtatagttatgatgtaagggggcagacataggtaattttaaaaacaacaatattttagaaataagaaatgattcataagtattgcttgtgaatgcaaaccaaaagtcagataccacatgcataatgaagtgtgactctatccaaatacttacaacattttcagggaaaaaaatatattctctgatcctgaatgttgtgcctacagaggaaagaaaatgaacctgtttactagagggagaaatctcagtgactgaagaagtcaaacaactttttgaactctgagagccaccttagctgttctgcttcagggttttgggcaacataacatctttatgaatgttaccttatagaacgttagttataccagagcagacgcaactggggatttgacaactctgccacactttgactggactgacatttccttagcagtaacaagctgctgctgtctggtgccatgggggccctgggcttgatttagtagcactgacattgactgcttgttatttcatatcttagagctgtcaggaggcaactgatgtcagcataaaattatttgatagctctgcatcttgggcaaaatgtgaatctattgatgttataaaatggccatcaaattcttggaattagggggtggagataatggagaaagaaaactcacctggtttattgttaagtaatcttttgtttaaaatttggttcacataaatatgaactgtaactatctattaggcacatactggttgtactcattaaactacatgctcatccaattctaacagtttcagaggataaatagtattattttgatcctcatttgacagtacagattatactcctggaagatggaaaagctgggacgcaaatgcaaacaatctggttccaagatccgtgctttcaccttgagttacatggtttttcccatggaattgaagatcctagattcatagaattctttccttgagctgccattgatttttttctttagttttaattttagaaaacatttgctcattttattgagggaaaatagcaattagcaccttgtgtgatctgataaatactcactgaatgaaaaatggaactttttatcatcctcatagcttttctggagtaaccgtgtatccaatggaatgattccagtcgtaaatggagttggtcaaagactaattctctcattacaatacttactttaacacagtatttgagaacactttgaaaatgtgaggagtagtgagtaaatgtggggaattttgtgattaataatctcagtagtaaagactattagaagctcagaagctctcacaaaatatgcaagaaatacttatcaaatttatgaattgtatctcagtttaccactctgttgatcaaatcacttatttttaaacatagtgatcttcaaatatagccatttctaaggaatgcatttgcttctttctgaaaatcacctgacaaccccaaatcatttccatttatattttgtatatccattgatcttgttttgtgttgtttaaaagtataatcttttatgttttttgattaacttgaacaatgacagatcacaatttaatttctagaatgtgtctttgtatgtgaatgcgtttctttttttcaaacaaatcacaaaggtctgggggaattgtgattctctaattcgagctcagtatataccagttgaaagcatttagttgtgattaaaacagattgaaggagataatccctctgagaaagcagcttcaaatagcttagcagcgcttcttcagggataagaactaacacaacacaagctaattcctccaaagtctccctggtggagctgtggacgtacctttcatttgttgtttttcttccttactgcgttctatttgaattcctcttaaatatgaattctgctttaataacactttactcattttgttttccaagaaccaacatttaaccttttgtgttaactgatacagggagatacacttcatataatattaataaatgaagagtgtgcaggcagttctcaatttacaattgaatgatattataaaagttcataggtaagtcatagacaatttagaactcgggatagaatttatcatagaaatgttgttctatataaaatttggtttcttggttaacccttcaaagcctattgaactctcaatgtagccgaatataccttatgtaactagtacaagttctgcatagcggcagttctatgagaatacttctaaccaatgttctggattcaatatcgggaagaaaaaacgccttttccttgggagtgccttcaaatttatttcgttcacagtgtatgtcatttcgagggtcggagaaactgacaggtctgtatcttctgggagtagtgtgctggagatgggagaaagagaaagaactagataaataacaaattgtagggtgagattttcttcattttcctattcgcttggatatgctgtaactccattttacaatttaagaccatgcccttgaaaaccggacccattattggagaagggatgagtaaagtgcatatatggaccccaactattaaaggctaagaaaagaaaaatggaagcaaatgcccaatgacaataggcaaagaagttatgactccttcagccaagcccaactgaagatagaagtggtacagatctcatgttcctggatattagacacatatggagcaatgaaatttcaaaaactatgttgacccttaactatctgtattaaaaaacattgaagatttaatggccaggtgtcgtggctcatgcctgtaatcccagcactttgggaggccgaggtgggtcgatcacctgaggtcaggagtttgagactagcctggacaacaatggcgaaaccccgtctctactaaaaatacaaaaaatagccaggcatggtgatatgcacctgtaattccagctacttgggaggctgaggcatgagaatcgcttgaacctgggagacggagacagaggcagaggttgcagtgagtggagatcgcaccactgccttccagcctgggtgacagtgtgagaccgtatctcaaaaaaaaaaaaaaaaaagaaaagaaaaaaaaaggaacattagaaatgttcctgtttactcacccgcttttccttccccacttcccccacacccctctgcccccatcacttcctcttccctcccaaaattgctttaaggattttcctttctgctgcgcccatgatgcagtgatggtgagccacacagtacattactgtaagtccctgttgagttgaggaattaaccaaatgctaccacagagtttattaataaagtttaggccaaattgtgaacggaattatattttaagacacagaacacagtttgctatgtaaagttttgtaagctggagcaacaatgcagaaactaatattctgtgaagagttcctagcaagccagaattaattgactaccagcgtctaaccaaacctaaagttctaatctagcttttatatacagatcacctgccagcacttcatcattttgtatatgctgtttgctatgctattatttggtgattgatctgctgtttaacttatagtaatgatgatggcctggcgttaacaataatggcatatgttaaaaatgtaagagagcatctcagcaataaaagagatagatatagttcagaaccttttcacattgcattgcccctgttaatgtttcacaacactttatactctgaaaaaataaaaataaaaaaaggaagtggcataaaaatagcatgtaaagtgttattcccacatgctgttcttggtctttggcatgcctgttatccccacattctccaaaaatgacaagaatgcatcccatctgatacatcctgtgaaaaatttaagagcatatttgaaaacacaaaatactgttttcataaactgctgaaatctgtgatagtttggcagtaatcacaggaacaatgctggaacacaacttttaattttttcttttccttgcgttctcttgtcaaactcagtgaacttccctgttctgtattgctttctgatgtgttgatccaagtctccctaaaacccacatgctaattcctgaacagagtttaacacttgacttttccccattaattaatagtccagtgttgatatcgatgtagtctttcttttgtggataaaaagaagcaatctgaagctaatttagcattgggaaaagtagtaacacagcttttaagaaaaagaggaatgaagcaatgggcaaaaccagctgtaagatcttctagacggatacgtgtggctacagttctatcaaggcaagaattggcagaactttggaaacttctgtttctatttttattcttttatactccttcagaatttaagagtcactccttgtctccatgacaaaacataacaaatgctgtttgttctagtgtttaggctaatgacataacgtgttaacccttggttacacagaataaccttcacattaagagtaatcctgcaccatttatgaaacataagcatcacacctggcagctttttgtcaataagcatatttaaaagaaattccaaaacaaagagttcagtgtagtgacagtgatactatagtgacttcttcagccatgttttgctggataattaattctccttaattctgattctctcctgccctgtgcctcacattgggtctatacttcccacagtgcttaggagatgtgcattcatccaatttgtacagtcagtctaaggattcaggcagactacataattcgttagaatacactgactgtgttgaccagattataacctgtctctgcttttggtgttatgtgagggcggcacaatgacagaaacaatggtagctaatacctatgtatgcttactgtatttggcacagattatctcatttagttctcacagtcccaagcttggagttataaaggaagaattcttggagatgatggaagctcaataaagccaaaaaacatgaacttcaccattagacagactcaaactaagttagtaatatttctacttttcctttttttcttttttaatataaattaaaccatttactcctctcctctaccctaaagtccaaatgtaatatatattaagggatatgatttgtcctgatttggtgtccatacaaattctctgtgtcagagaataacctagaacttggtatgctttatgattaataatctttcaatatgttgttaaagattttatttatacttgtggctgggcacagtagctcatgcctgtaatcccagcactttgggaggctgaagcaggtggatcacttgaggccaggaatttgagaccagtctggccaacatggcaaaaccttgtttctactaaaaatacaaaaattagtctggtgtggtggcacatgccggtaatcttagctactcaggaggctgacgcaggaggattgcttgaatctgggaggtggaggttgctttcagctaagatcacaccactgcactccagcctgggcaacagagtgatttatttaatctttattttctccaaaaagaaaataaagattatacttatacttgagtagcagtcagttataaatgagctgagagggtgaagtaaagaagcctgtatagacaaatgaacagagacagacttttgtgatgcgtctttaagggattattagaagatcattttggagtggacaactcaagaaagaaaactttggtgggaggttttacaaggtcttcaaggcaggcaaagaaatgtgggttttgatctgaccacattatatgcactttgcttatttatcgttgaggtatattactgaacactgtcttatcctatttcagtaataatctttgtttatttggtaaagtattatttttttaagggttagcaattctaagttccaccatgaagcagtcaagtgaaattgtttctcagtatttgattgacttgattcatccattttcaaagaaaaggtaaatcatatagtattctgtatgatgtagactgtgtcactcagagtgaaaaagttacctttgtcttctaccatttgagaatgtgctgttgaatttgcgaagaaaagagccctgaggcattaatcatacacattctccaatctagatttcaaaatgttcagtagatgtttagggtatgacagaagaatattaagcccgttaatacggtaattacagtgtttcttgcttccttgtaccctgaactgattaatacataaacaggactcaaaatataaactttatgtttagtgaaagtgccaatatctatgtctgaattcatcaatgccatcttaggaaccaggcaatatctgttcactgcctagtgccttagggagactgtttaatgaggagatgtgaagccttttacagtttattgttgatgacattttgaggacacttgcagtggggtagactgaaaaacaataaagctgggtattttcttggatatggtttatgtgccccagagtgttgtatcagattttatcagtaatcaaatttctacttgatagcaaaaacaaaaacaaaacctttttagaaacttaatttcatatattgaaggcaaagaaaaaaatacttgcaaatctgatatctgaattttcttaagattcaaagaatttcaatttttctacttattcagttgaattaaaggttactaccactgtttttacaagcttgaaaggcctatttatttacttatttatttatttatttatatattttgagatggagtctccctctgtcacctaggctggagtgcagtggcgcgatatgtcggctcactgcaacctccatcatccaggttcaagcgattctcctgcctcagcctcccgagtagctgggattacaggcacgtgccaccacgcccagctaatttttgtatttttagtagagacggggtttcaccatgttggtcaggctggtctcaaactcctgacctcaggtgacccacctgcctcggcctcccaaagtgctgggattacaggcgtgagccaacgcccccggcctgaaatgcctattttttaggttagatatggtagtgttataactgttgatatcctttgtagtctgtacttaaaaactctgaaatggcttgaggcagttccacagcaaaaattccatatgaatgtctattcagataacgattcttatattgtgtactatattaatatacgtaatgtatttttatgtctattgcctaatactttcaaaatgaaaagaaatggaacaatatatttttctcttgcctttgttttcattggaaccttttgtgaccaccttgtacttattaacatctgagactatggcacaacgctgtggtgaaatgtgagccatcagtccaggtgggctggtgttcgtgtgtcttcatgatcgggtctggtcctcagctctgtaggtacattttacagaggtagtattatggggtgtgtggttaaaagctctggaaatgcactttgtagacttgaatccgaccccatcaatttcttagtgtgtatagttatgtaactcatagttatgtatgtaatctcagtatgttgcataacttagtgtgacgcagttatataagttatgcacataacatagcataaataactacataacatacatacttgatataacatacataactgttatgtacataatgtatatttagtacataaaagttacataatagacatatttgtgtaattaggcattaattccaaaagatgtagtacatgtttgtacctgcttgggttatcattataataaaaacagataatgtttgtaaatactttagctctaatgtataacacaaaattaatagccagtattagttgctgctgttaatattaatgttagtactgtgtaatcatctgaaaagtgcttgctcaataccaggttaaaaacagagagcgctagagcgacttattacaaatttacccaggtaatagaaaacccggatgcgcttcctcactctaagcagaaaatgtgtctgtgatgatttgcccttctggaaccatttccagttggtattaagtgaaatctactaaattttgtatcctgggtttctcttctctatactttgtgcagatacctctgtctccctaaaaagaattatttgaccagatacaatgcatatgattatggttattctagcttaagccagtttattataatagatttagttgaagcttggttatattctggcgtcagtagttttattaaccatgaagaggttatagctttagatttgttgattcaaccatgcattcttaagatgatgtcgcagacaccttaattaaacctgggtgttcctaaatttcctcagacattactttcaccatatttctaacattacacttagaagggaagctttctgcttctatgtagtcgaaatggtaaagaatcctagattttcgttttattagattgattagaacagaatgcaagtatagaagcttttaagtgaaaagatctatgtgaataaaaatatatgcctatatttttgttacaaaccagtgatttaaattttaatgcatatgtttatgtagagaagtatgtttgctattataataaacaataaaaagccattgctcatgtgactcatgaaagcaaacctggcaatgactttttctcatatgtctgcagcctaccatcacatatgcctaaatttttacgaatgtgtgtccagtatattgttataaccatctgcaatcaaatgtgttatgcaaaacaaatacttaattggtataactaattctttgattcaataatgaagatcatcacattatgttatttagagtaattacttatagcttaggttgggatggacacttttcaggaagaaaatgtatactttgtttctcttttttctgaaatagggatggaaagggtattaactagcattaaaaagggcgaagcaacaagcttccctgattggagtgtaggtcccaagcattttactgataaattcattcagattgagtaagctctttaagctctttctttctttcttttttaagttaaagtcatactctaacacctattctcctgcccacaactatacctttgagtaaatgttcttaaaactaacaggtacttctctcctaatgcctaaatgaactcaaccaccatggagaagtgatagttttgattggtagatacaaagtgatcatttcagcattgtattaagctgtacgtggattaggtagtagccaaagaaacagggtggccagagattttgagggaacaaaggcagaacagaaagtgagaagaggccaaaacaatacatcagtcgtgtaaatctgccttgggcactgctgacctatataaagctgaatatcatcttcagtgacatcttcggtgtacctgtcctggattgcctgtgcttggcttcgggcactaattttctttcctcatacaatccaatccattaaacgtctgctatagtttttctggcctgaagagaaattttgtttgtttgcttgtttgtttcggcctagttccaggcccaggataagatgaagcaaacactgctttcattcattcatacatcacatatatgcttctcttcaaccttctcttccttgctctctgacatacacaggtacttctaaagctctgggatatcccttaccatatagcaaacttcctggcaggagcagaggcaatagctctctagtagtgcttggggtagtgacagatactttcaagactgacagaaaaaagaaaacacaagctctttttcaggaactgtatatatatatatagtgggtcttagtgagatacaaatctgccactaaggtaccacttattaggccttataattgagatttacttgtggacctgaaaactctgcacagtccataagagaatttcctgtattccctgcatagtaggagcaagacgattatctattgtaaggttatctatattattccatttgacatttttaagtctattgaagtaagtgagaaatgtggacctttgcaaagatactgattgcccaaactaaaagaagttaaaacttgaagtggtaatttagtgttctcttcaaaggttgtttaagtacacacattattaatatacacttagtttatgcttttgacatagcagatcagactttacacctggaaaaattgtaaagacaaaggttaagtttgggcatggtggctcacccctgtaatcccggcacttagggagattctttgaggacaggagtccgagaccagcctgatcaacatggtgaaaccttgtctctactaaaaatacagaaattagccgggcacgctgatgcatacttgtaatcccagctactccggaggctgaggcacgagaatcgcttgaacccgggaggtggaggttgcagtgaaccaatatcacatcaccgcactccagcctgggtgacagagggaaactccgtctcaaaacacgaacaaacaaaaaaagcagagatcaaaaaatatctgtatgttcatctatagccatagctgtacctatgttctttaacttaattatacaacaaacatgatagtatttagtttgccaaaatgtaaatattttccacttctattcactcacctaggctggcttctttacaatagaccccaagcccattcataattgacctatcccctacttgggtctgcatatgatcataaataacagctctcgctacgagtcattattaaacaggaagcattccaagtgttaggttattctctgattcggagtagccatcaagaaaaaggaagaaacatagaaaataatttatagtgatttatggaatggcaactgagcctaactgtatgttagataaggcaactttgattttaaagagctgacactacgatagaagagagagatatccaccaaagataagcaatgcaaccttgttaactgctaactgagtcagttaatgatgtcctaatggtttgatggggagaaaaacctcagaaattaaatgttgaaattgtcataatggaggtatatgcaaggtactgtaagaacaaaagagaagccttatgaacagccttttaaaagtagaatggactataaagttccagtaactctgtctgagaaagtcaagaatggcctcatagtgctggctttggagataggataatcaatgggcagaaatatgcctggtgaagaaaaaaggagataaaccaagggttctacttgcacaaatgcagtttttggagggcccctttggactttgtaggtgaataaagagccaggcttttgggtgcatggtgtacagagtatcacatcatggaaggtgagactgaatagtcagacagaaggcagagtgaaaaggacctctcaggttcagcaaaagattgtaacatttatccaacaagcaacacgaagtcaagaggggcctgtttgtctactagccttctttgtacctccctctccttccctttggaacttccttatttcatttttctgttcatcttccttttttctcctcctccttctgctcctcctcttcttccttttaacccatctctttctcctcttcctctttctttttttttttcttttgcttataaatgaaggatgatcctttcaatagtagtgtggtggatggactaggattgggaaagatgattagtgtattgaataattagaaattttagtaatacattatgagggaactaatgagggccttccataagaaagtagctgataaaagcagatacaaccttgtatggcaaagacaggcaaaatctctggttccctgcctaagcctggtgtaccacaccaacgcctgacaccaaacaggcagactgtgaagttttattatttgcaaacaaacacttgtgaataatgcgtagcttctattttgtgatgctgaatgaattggtgatgcctttcccaaggccaaaaacaaagcttgtgtaaaatagtagtgaggaaaaaaggaagacaagttccacttttgttttgctaaattcggtatatgtctccaggataaaataatgtctgtattcaacaaatatctggaaataaatacgagttctagaataagggaaagaaggaaaaaccatctacaagagatgaagtttcattgcaatttttataggacagatgatgtaaagggttggttttctgttaggaagaaattaattgttcactttctgaatgaacatcggcaatttctagctgttagaaagtgaagtcatatttctaaagaggcactgtcacagagatacatttggaagccttcaaatatctttttgttcttttaaaattagcattttggcttttccattcataaggcagccagtgatcagaaagtaatttctttcttctttggaaagaaaacctttgccctaagaaaaatggcatctcttcctcaagattagcccccaaaatattaaacttggggtaaagcagccaattctgttcatggttatgaccaaaaaagaaaatggagagtttattttcttaaaggctgctcaagttcaaaaatttgtgtttgatccctcaaaattcatttcatgttgaatatgttacctgaacttaagttgagtttacaatatttttcaaaaaatactataacaacaaaacatttattttgatataaaattatgtttcttatattgttactttattttatttgaacctaatagttaactcgcaaattgcatatcttgctcaaaaataagctatttctttaggcctacataaaacattaaatgagaacacgacaaaactaactgattctgggattacataaacatcccctaatcttaatattaaattcatttcttttaggaatacattgcaaaaattagggaagaaaggttttgaattactttccagtatgaaatagtaaggtcttttaaatgtatggataatcagtaaaatcattttattagtcatgtttctgcttccttggcagaaaacattccagcttgactccacaaaccagcataaccaagtttgttatagtaaataattaatctgtacgtattggttgatgtttcatttcagcatccttgaaacattccatggaactttcatatttccaataaacaacttcaatcagtaataatatgcttgggtaaaacaaagaaaatgtggttatttctttccaattataaagctaagttttagaaaacagacatcagagaaggggtaccacagatctatttttaatattcaatacaagttagagctcatattttattttggtccaggattaagaaaaaaatttgtttggagatagtattttacttcagcatttccacattgagtcttttctatttctcattgtttgtgatgcttttaaatcaagggcactttgttttttagctcacatctgctccccccttgttctggtcagactttcaacacgtagttgctctgagattgttcaggagatctcagacaggatcaccacgaccttacctgagagtggtcaaaaaaggagcagatgcgtgttgtgaagattaagcttatgtttatctgacaaatgaccttaaagataaaacgcagaaagcaaaactcacaaatgtggttgatgcagagcaacgagacaatgttgtggcaattatttttaaataacttattaaactttataaaatgaaaagatttttttaatggcaaacataggtctttaaggaaccacagagtgcagttattgaattaaaatattgacgtgaacatatttttcaaatatgcttcaaatggtaagtatctgccatcacaaatattcaatgtttttaaaaatgctaatatatttaggtataggtcaagaaaattactaggattaggtatttgctactagcaaagcaatgccatttttcctagctattgctttttctattgagtaaattattgaaataattgtttgagtttatattttactcatagttgaggctagaatagtaacgccagtgtattgatagagttgatttgtttttgaattatagatctgataatagaaacagccctagaggtgagtccctgatgacatctcaaaatggttgtttaattttccatattagaggagtattatgatagaacaacaaacagagctgctttcagacaagaaacatttcatttaaattattttctttttagttaatttctaatatatttctaatatacttaccttattttacaggagatgcggacattaagaaagcttttctttattttttgccaaatgataaaaaaattaacactctttttttaatcatagatatatatattccgtatggttgaagtagacacattgaggattagagttagaagttatttgcacttagccaggcaaatattgactgtaattaaatgagcaaagataatttgaatgtacagataatttcaaccaaagaagatgccaaactggtcaggtgataaagaaaagtgtggtgagcttgaaagttccaaatatttttcaccatcttcttcatataagaacacattttcagacttgaagttcagctttctcaaaaatatttgaaatactgttgatgtgctgaacaggaaatttcgatgcaacttgcatctgtggacaacatcagtgtccctaaaaatgcaagaaatgatcttggtcagtatagccttaaataatccatttaatgaaagaaaagttgttttgtttggttttctcaatctttgggtagccttttaaaatcatatcattttcagatctccaaaaagccattattatcatgtccctttcatagaactaaaacatacatctacagggaatgatgaccttctcatgaattagtggctttaggcattataatatatattttaaaaaaaaagagttggagtggctagcaaaaaacatgcagacatttcataggatttttttcccctttccacttcaatgcatttatttgaaaactgcttatttgcctgaatttgccctgctggcaaaatttttctaccagatagctactttttattgttgatgcacatcatgaatagcagctttatttgatggcaaatgagatgccccaagttgcaagctttccataaacatatctgaattgttcaatttccttctcattgtataatttccaccctggccctttgcctgctgatattccgataaagatttcattcaagtaattttcaaaactgtcctatgttctttgctatcataagtggtaagattgctcaattcgtattagctataacacaagtgctgcacaggttttttatcagatatttctaaaatcatttctttgtcatgaatggtaacgagaataataaaataatgcctccagttgggtttgcaaacactggtggtttactagcaatagaattagtagtaatatgaacgtgaaaagtcacttttctaaagaacatatcttaatgaattattttgtttctttttctttcatgtctcctaacatggatttgaaaattatgattgctgaatgattccaaatgacttgggcctttgtttctcaaataggtaagtgattcttgttctttggtgttcttaggagtccgtggttgtattttaaaataaatattcattgccagtttgcactgttgaattttctggcaaaatagggtaaaaattgaacataagacaaatcatcattttcagaaatataattcagatctttttcattagttggcacaggaaacagactaacaagaagacccagtttgagttgtacgtattcataggagccatatgttcaaaatcatttaagtcctttttgctggctagcttttgtattttaaagcagcttggtcatattttgcccatgaagttctaggtcacactagactagttactaatcataatactgtatgaattacccaggtataagaaagcatttcatatggcagccagtaatggcttgatacagaataattagctaacaattttcctgatctcaaagatactaggctgaaaaaaagtttagctttaggttctgtagtatcgtcacttgtagagctgggatcaacaagctagtctatgggccaaatctgaccaactatgagttaagaatattctttacatttttaatggctgacaaaaaatcaaaagaaaaataatatttcataatgtgtgaaaataatgtgaaattcaaattttggtgttcaaaagtattgttggaacgtagccatgcttatcactttacatattctctattgctgttttcataccacaattctatggcccatgaatcctaaaacatttacattctggcccttaacagaacaagtttgccgattccattgtttgagtactagcatataagaggttaattccccgaacctcttactttggagattctattagagcagaggtgaaatcattatatatctgaccttttcttagtcacaagggaatccaccatatctaaaatgaccaggtcagaacaaatggaagagcaaatcttgactgtagatttaagttttcctgaaatagtcttttacatagttatatttctcatacattttaagccctacaacattcaacccattaagtctaatgtattttactgccagcaagtctttgagcttgcccacagatattcagagtcccatagttgatgggaactggggaagtggcattttgtggctagtgaagcagcaacatgttgtataatgaaaagaaatatcctcaaacttttcaatagttctcaaggctctgtttcaccaaagagaatactaacattctatagagactgcctgttctgaattacatttgacagtgttggaaaagtgtaatactcatcactgtaatccagcttagcatctaaaacaacacaagtaagtacagttgtgctttgtggaatagattttgcagaatttttcagaggccatgtggaacatgagtggttatatgcatattctaattaaaaaaaaaactttaaaaataattataaatatattgtagttcttttcatgttggcatttatcagaaatagatgcatttgtagtttgagaaagaaagaaataaaagagaacaaagaaagcatattcttggaatattgcaagagagagcaatgtagaaattgctggatattaagaatatgcattaacttctaggtttaggccactgggaaataaagcttccgtgcgtgtatttgatgtataatgacaggcacaaagaaaaaggcaaacatactatagatattctagtatggtacaattatacagtatgtgttctaacccttttcatgaaaatttgacattactgcacctcagatagaagcagcaggaatcaccagggaaagaacagctggatgctttattaggttttatgttgtacataaggagaccatgttttccattgtcagtgtgtaaaagaaaatgaaagctctgggcatcattaaagtctcgaaagcgtaagatgtgtcagctccattctctcaacacctggattgaaagtgcagtgtggggtcaccgtaaaacaaaaacagaccgtcttctctggttggaattgcaagagttgatttttagaaataaaataattcataattgttgtagagagaattcttcctttataactagagagttgcatgtatgaacataaacttatatgtctacctgaagacattttctataaactgcgtctgaatatctttttcctgcaccttaaggggtgctaggaggcttcttggagtcagagagctagaagactccccatttgctgccactgtggtattgtccttttgatgaacatttctccctggcttttcatttgcctccttttgtggaaccatttttgttggcatcccccacccaacacacacattatattctcattgtgtcccttgttgcaagtacctttatgttggagaccgttttaccttatacctttatgtaatccacaaagcttagcactgtgttcctcttattgtggtttaaagtgctgtattagttggctcaggctagtgtaacagaataccacaggctggatggcgtaagccatggaaatctatttcctcaccgtcctggaggccgcaagcctgagattgaggtacaggcacggtcaggttctggtagggtctgtcttcctggcttgcagatagctccttttctctctgtcttcacatgacaaaggggataggtagatggagagagagagagagagagagagagagagaactttcttataagaccacaatcttattggataaggatgctgctcttatgacctcatttagccttaattattgcctaaagatcctatacagtcacattgggggttagggctttaacatataaattttgagagaatatagttcagtccagagcaagtacctttgacacaaattgagttacataagcagaagagaggactgaatttttctcttcatgaaaatttaagagctctttgcctataggctttggccacttctgttttctccaagagttgctcatattaaatctagtaaataataaaaatgcgtttcaaatattaaaagatgttctatgttctggcgctaatctctactcttaattatcttaaaaaacgtacaagaaatttactattgattttattaatcgctcatgaacccacttatttacgtatttaacattgataggttgcccaaccatatgcagggggatacagactaaggggcttaggatctaaagaatgtcctgacaacattgtaccctttaggaactcctagctggcaagaaagacagtctcagagcaatgtgtcaagtgcttaatataatttgctcttgacatacaaatgaagcagtgcccacaatctttagtaaattagagacttctcaataatgatagcatctgatcatgagattgagtttgacagttgaagaaataaagggagtaaacaaacaccaggcaaaaagaatggcaagtacaaaccaaacacatgggtgaatgagagagctttactgcagtctgcaaaccatttatgctgaacaaaatgaagaaaatacaatgctcttaaattttgtttgtttgtttgttgagctcctactatgtgtcaggttccaggttatatgagtcagcatagaatggaaaacaacaataagctccctgttcttgagccaattttcaaaggtgaggagataattaataaatgattagtaaataagtgatcaagaactgtaaatgcaaagaagaatataaacatgaccttgatatagcaggatgggctaccgtgagcctccttttatggtcagagaggtcctcctgagaagatggtgagaaggagatgtttgatgtaaaattggaatgacaaaaaagagtcagccatgtgaagatccaggtatacagaacagcttctttcatatatcaaaaatatttttttcttaaaatatatgacatattaaccttactttaaaatatgcaagaggaaaagtgggaggatgcaatggactgaacatttgtgtcccacaaaattcatgtgttgaaatcctaatccccaaggtgatggtgttaggaggtagagcctttggcaagtgattaggccatgagggcagagccctcatgaatgggattagtgtccttataaaagaggcccaagaaagctctctagtcccttctaccaggtgaggacacagcagaaacatgccatctgtgggccagacagtgggctcttgccatactccaaatttgccagtgacttgatttggatttcccagccaccagaaggtataagagatgaatttctgttgtttataatctacccagtatagggtgtttttttgttatagcagcccaaatggactgaaacagaagataaaaaatagtaagatcagcagtggtagagcagtaagacattgaatggttgttaaagataggtgatgagtacttaggaatctgtgagaattttctctcattttatgtacctttgaaaataataatattaaaagtttttttggtctcaaatgttttctccatgaacatactgtttcttcttgatatattccttatttattacactaatataaagaacattatgataaataattcttgaagggaattgcattccttatctacttcagcatgacaaattaccccaaagcttagaggctcaaaacaacaataagcatgtattagcccttacagtttatgtgggtcaataatttgtggttttagcttgggaaacacccttaaaaaaaaccgtaaaaactcttatgagatttgagttaagatgtcagccaaaactacagttatcgaaactggcttgactaggtgaaggatttgcatcaaaggtggttgactcagaattgactagttgatgatgttggttggtggcaggaggccttagctcctccctgctgggtgtccccacagggttgcttgtatgtccttaaaatatggtgtctggctttttctgaagcaatccaagagaaggtagaaacatggcagacttggaaatcacacacccttaccacacatgattgtattggtcatagatgtcagccccattcaaggtgagaggggtctacatgaggacatgaataccaggagatggagataattggtggacatattgaaggctagctgccacagggagaaacagtatatttggtattaaacaaataatcttgacatcatgctcactgaattgatgccccctccccaaaataaatccctcattaatttgttgttttcaactcataactcacacaactatctttaaacctctgtatctatatttagtttgtagggtacacacttatataatgatgtctttcttctgattaggcacttaaattagctgtatttaatggaataatgatattaaataactttgtaaatcaaaaggtgaaaatatatgcctagaataaattatcaagactttgtccagtataatgagtggtgattattttccagtatactcttcaatttattactgtaataatcttttaaacccattaacagtcaatttgctctgtgatattaaaatgttagccacattatttgcctgttaatgtaggttaaatgttaattatgctgttgtatggcggctaagatggtacatccagaaattacacataatattggttggttctttggccgtcatacactaatgtgcttcattattattgtgctaattttagtaattttagtacaaactacataatactctgtgttactaaaacagaactacccatgatatattgcttgcaaccaaacattaggcaattttggccccatcatttaggagtagtttacatgactaaacaagtaatgattctgtaactctcaaacttgcatttagtgtatttagaatgaattgcttagtatattttaaatatttgtagatcaaaatgtaatcccttttaaaacaaatgtaagtcatgctttttaagctaaatgtacatttaaacttcattagtgtagtgattataaatacagctatgattattcctccagttgtactaataatagaatggcatatcaaccttctccctgggtccagttttattactcctcattctactcttacaactattttaaaataatacttagcagtattttgagaaatagggtttgttttagtaaactatcactgtgtaacttgctgtcacaaacttagtggcttaaaaccacactcatttattattttacatttctgtaggtaagaagtttaggctcagctacctttctgcagtaggttcacattcccggaatcaaggtgttggcctttctagaaattctacggatgaatctgctttttagctcatccaggttgttgcaggaattcagtgttctacagttgcaggactgagattcccatcttcttggtagctgtgggctggggttagttctcaccttctagtggctgcctgcattcctcatcggatacccacttcctccattttcaaagccggcaaaacgatcaagtccttttcaatcttcgaatctctcttaatccctttctcctttgtcctttctcccttctggcagagaagtttctctcttcttaagggcccatgttattagattgggcctacctgtataattcaaggaaatcttcttattttaaggtcagctggtaagtaaccttaattccaactgcagagtcccttcacagtagtacctgagggagtaaatgtgggaaagaaatctcccagcgatatctttggaattctgctttccacagtgttgttgtttgattagaaatttagagtaatgtaacctgagagagcccactcaggagaagttccatttaagtttagttctcagtgacacaaggaatcatggaaagatctggagaaaaccagaaaaagaccatgctaattgcaagtacaccataaagctgtaaggttcatatttgatttattcaaaggttcataaagcaaaatagataccactactaaccaaaacaatacgaattaaatacctcgcgttccagacctgaaatattataatatatataaataaataagcagacatcataatttgcgcttccatgttcttaaaacatttttgtagcaattttccctctttccttccctcttaccgtataattcccatcagcataggactataatgtttatttctgccagaaaaaaatagaagaatctatagtgtgtcatatctccccttatctctccctatctatattttctgctcataatttgtatttttttcttaagccacgtctaaaattcagctccttttcccccaaatattctatgcaaactgcccttacgacccacggtgactttcacattactaattatgatggccttgttagagtattgatctaaatagaccccaaattaggatttgacacagatggtcacactgtcatcattgatatactttcttcactaggcttccagaacaatcagccttgcattgtttttctcctgtctgcctggaagctccttctctcatgtatgtgttaatttcaccttcttgcccaaatccttttctttagagtgctccagctcagggtttttagacctcattttctatcttaaagtactttctaggtgatctcatcatttctcatggatttcactaccgtctctagctttactcctaagagttctacttttcttcctaaaaactgctccacccacacttttctgctcaactaagcccaggatttttgattttatacacctttttttcctctaatccctttcctgtggtgagaaaagcttttaccagacaggggtcctgatccagatcccaagagagggttcttggatcttgagcaagaacgaattcagggagagtccatacagtgaagtgaaaacaagtttattaagaaagtaaaggcttttaaagaacggctactccacagacagggcagccccaaggtcagctggttgcccatttttatggttatttcttgattatatgctaaacaaggggtggattattcatcctcccctttttagaccatgtagggtaacttcctgatgttgccacagcatctgtaaactttcatggcgctggtgcgagtataacagtgagaaccaccagaggtcactctcatcaccatcttggttttgatgggttgggactgccttctttaccacaagctgttttatcagcaaggtccttctgaccttgggtcgacctcctatctcatcctgtgacttagaatgactaactgtatgggaatacagcccggtaagtttcagccttattttgcccagctcctattcaagatggagttgctcttgttcacacgcctctgacaaagctatttgttctattttcagaatatgtccagattgcgttcatttcctttgccactgcctaaagtcaagcaagcactatctgtcacctgaattatggcaaacccctcctaacaagtctccctaatcctgcccttgccttcaggtatcagtgcccaccacagctctgacctctctcctgttagtctctccccagggctaagtcctcattatcttccttgctttttcttacagatgcatcacctgttggctctgcttcattatcttttccaacagatattcatttgtctggctctctcactttcttcacttcttctcccgaaaagcttcttctcggagaggcctttctttacattgcaatccccgcctgcacctgaggttttgtattcctgtttcctgccttgcttcttcttctcacttacctaacatcagcctagcctctaaattctgtgtgagaaggtatttttgtctgcttttttctcactgccagtgctagatgagagccttgaatataataggtggtcaataaataatactgagaaaaaaagaataaaacatgaaagtacattgatagatggtatgttttggtgctggctataacattttgaggtagatagtacaggtattattttctttattttccaaatgaaggcaattatacatcttgcccagggtcacaaaactagttaagtatcaaagattaaaccaaaactcaattctcttgactcctaacccggtttccattccactacaataggtgctaaaaatacaatgttgtctgttcttgggagctacagtacagcatccctcaagaacctggaaataaagaaataagattgccttctgagagtcacactatgaaatcgacgtgtaatgagtcacttaccttaaagagctagaaatgcttttaagccaaagggaccattactgattaaatggtttaacatttccaaagaaagaacattttaataagaaaaggcagacatagaggcacttcaagaggatactccaaagcgaaagttgggcacgtgaatcctaggggctggagtctaagccagtgaattatgagaattccagaacttcctgggttcacagatacatcagactctgttagttaatgacaataaacattggattcatctgaccaactcactttttttcagagaggcctttctttgtcaccccactttatattgcaatcgtgatcacaaaacagccttatgattaataattaattttccatgcagctctgcctgtctatagaagaaaaatcccttctaatatgtacttccagcagtctggtcccgatgttagttatttcttattgaaagttagttgaccttctgattgcagtatggcttttgtaaagcttacttttggaagaaaagacatcctgatttcactgacacctgtacgtccctgcgattggtacattaaaaaaaaatatatatatgtacacacacacattcatatatatataatatatatatatacatatgccgtgtgcagtggctcatgcctgtaatctcagcactttgggagactgaggcaggaggatcgcttgagcccaggagttcaagaccagcctgggcaacatagctattaacccaggtaattttgggaggctgaggtgggaggattgcttgagcccaggaggttgaggctgcagtgagccgtgatagtgtctctgcactccagcttgggtgacaatgtgggaccctgtcttgaagtaaatatacactgaattgtgattttatgtatcaatctcccttacttggttaattgaatgtgagtctcttctgcacctccctcacttccactgaatatggagatgctcttaacatttcagtgtgaaacaaaatcaaccactccagaacttcctagtatcattctgtactcgaagtgctgcacaaaagcaggctctgaaggaggctcctaaattagagacgaaggacagacttttttttcttgtatagagtcttaacagaaggtgtcaggtgaaattcagcattttagggaatagtgggtcaaggataattctgggttttcatagaaggaaggaatcctcttgcagagtagctgccattgttttggcaacttagatttttatcaagaggcaatgggaggggcacttgtcgttaaggtcacttgcaagaggaagcccagaggaacagctacacggaactggacacaagagaggcccagaagaggagtctcagtctttggttgtctctcaacagaagcaaattaggtttctaaatcagccagccagagaactaaacacacacttggtggctttctgatttatcaagcacagctggtcacaaattatttttaatgcttgcatgtatgcatttctatatgtgtcaataagttatgctttggtggtttctcccttttaaagtcttgaataatagttaacaaagcactcagggaaaatattttatttctagcaagaaagcttccttccttcctatttgtttgttttactcctgacttgtctttttaaattatttcaccttggaagataaatcttagggaagtttattgtgacaacctcaaaattctgttgtactatagtcagatctcgaataaataattaattttagggaaaaaaaagagcgacataaacatatcaaaacatactggcattgtgatggcataagaacacctgaatttaagtctgagagttaacaattcctctttaacatcaagatatcactcagttaccacagaaatgaaaaatgagccattgaaggtgaatagacaatgagtggcatgacttttatgttgggcaggaaacaaattatgatggcaggtgaagatattgatcatgagaatgagaaagggtagctccaagcccaggaactgggatcggcaaaaatgaaggaaaaaactgagataaagggttccttggttgagaatcgtaaggtgcctcactacagtcaccaggtatattttcccttaacaaagtggcagagtcatctacgttgaaatacaaggaggtacctccttagacatcaagaaggtctcatttatcagcaagtagaatggaggatcattgtcataattaaccaggttctctaatcagcctaaagctgttgagagtgaattaggaagcacttgttatattaacattctaagtggaaagagcacaacaatataatctggggtctccaacaataagagtcgcaggtttttttgtccttgcgataggacaaaaaaccaaacacctcatgttctcactcataggtgagaagtgaacaatgagaacacatggacacaggaaggggaacatcatactctggggactgttgtggagtgggggcaggggggagggtgagcattaggagatatacctaatgctaaatgacgagttaatgggtgcagcacatcaacatggaacatgcatacatatgtaacaaacctgcacattgtgcacatgtaccctagaacttaaagtataataataataaaattaaaaaaaaaaagagtcgcaggtatcagcattttactctagcattctagaggaccttattttaaactcggtgcaaaccactacagaaacacataatgaatgatttatgctctctctttttttttctgaaaaaaaaataaaaataaaaaaaggcctaggatttgaacatgtaggcaggagtgactatagaagtgttgtcaaaactcttgactccaggagtaatgacaagggcttctttacaattcgtgcatcattctatttcgtggaagatattctcatgcaggtggtctgacatcctgtgtctatacacagcagcatcagcccagagagagacatcagtttttacacaaaacagcgatatttttttttcccagagtctaaagtcaatgacatcctgatgggagaattgcaaggctacgacatgcttttcttgttcatttggtaagccatgaagaaattagaacatgattttttttttccaatagaagaaaactatgacacagaatgaatagtctcaaaaaagttcaaaacttttgttttgtaaaaaatggtcatattattgtcttcatcttagttttttgccttcaccttatttttcggagtgttcaaccttagcaacatcaaagtcatcaactgaaaagtcaccagtgggaatgaagtctttctattgagttgatcttctgttagttcactgtagaccccagatgtgggaagttacttctctctgtgacaagacggctagagagagcattcaggaaaatgcagatggcgagtatttcttgatttaaacagctcatttcacatggtccatcacataatccttttaaataaagtagtttgtctcaatagacttattaatcttattggtcatgtgctacctgtgtttgattgaatctcagtgtttacaacttatccacagaattatttttagaattgttcttttaaattctatgatgaaggaataaattcttaatggcttaaactttttcatagtttaaaaatttatttttaaaaatgttactcttacaaccaaccccctttatgaacctggtgctcaaatgaatattgtaactttgtagtctctctaagaagttttcaaagctgtacattgaaccagatgatatatttctgcgatgtgggccacccaaacatttggggtgctgtcaatagtgtaaaagatttgagcaattactgctacttctaaaaaggtgaattatatcaccgttccttgttttagataaagcatagttggaatttcttgacatgattgaggaccaaggagagctttggtcaaatctattttatttgaatcaagatagggagttctgaaacaaaaatgttcaaaggataaacgtacttggtatctaattagtcagtatgcctcaaaatagttcttgcatacctagggaacctttttttttgagatggagtctctctctgttgcccaggttggagcacagtggcatgaccttggctcactgcaacctccgcctcctgggttcaggcaattctcctgcctcagcctcccgagtagctgggactataggcatgcaccaccatgcccggctaatttttgtacttttagtagagatggggtttcaccatgttggccaggctggtctcaaactcctggcctcaagtgatctgcctgccttggcctcccaaagtgctgggattataggtgtgagccacagcacctggccgggaacctttagaaaaaaaattagtaattattaatactgctcagaacatgcaatggaaaatattgatgtagatcttctgaaatctcttcttggattaaactctaagaatagaaaatgtgtaaatgaattacattaattaccgcttcttcccaccactgctccttcaactccataccctgaattgtttttactgaattgcactttgaaattatgcccttgggccacattgaggatctttagaaaaaaacagccctgagaaactcattactttatttactgtaagatgttgtttgaggatgttgttctctgccttgccatttggacaccttttgagaacccccagaagagatagatctcaaagggcaataccaggaatagtcttctatttcctgaacaagtagttgttggtctcatggacactgacaattacaatttttttttcttttccagtttacactggagtccagataatacagatcaacctagagcacatctctacccttagtacagaatattgcagaattttttctcctggtctcactgcagtttcatttcattgttcctttgttaattttcctttgccttgatgcacttgttgacttaattttatttcgcggcatgaatttgcatcatgaatttgcatctaaagtctggaaaaagagtgtaaacaaccaaattgcctttataatgtgagtgagaccaaggcacctctgggaaaccaaaggcctagtcttagatgaagaatttggggaaagattgtcaactgaaatgtccatattttcatgaagtctctcagtgtggaagttcagtagaattaaggtgttatctgaatcagaatccctggaaacaacacctgagcataggtatttttttgaattataacatgtaaaattaaaagatggcatttctggcatggaaaagagcaagttcaaatgacctgaaaagggaaaaagcttggcatggtttggaaagagtgaaaagtcacacatggctgggacagaacgagtgaaagggaaaggtttgggagataaagttgagaagtagacaggccagatgtcaggcagagccttacaaaccataataagacgttgcatcccatttcaaacacgctagaaataccgaaggtttctttgttaagtcaagtttgttgaagtagaattgatatacagtaaaatttacttttttagcataaagttctgtgggttttgataagcacatggagtcaggtaagcatctctacaaccaaaacacaaaacatttctctcactccaaagagttctatcacatacctttatgatcaacccttcctcccatccccataccctaggagctctatcacatacctttatgatcaacccttcctcccatccccttaccccaggagctctatcacatacctttatgatcaacccttcttcccatctgcataccctaggagtttggctctgctttctcttgtatagttttgccttttccagaatatcttataaattagatcatacaatctgtagccctctgagtctggcttcttgcacttagcaaaatgcatttgctattcattcatgctagtgtgtgtacaccaagagttttgagtgggggaatgatacaaactgctttgagttttatagaaataactcctttgctgtggtaattgtgggagtggggttgtgaagaggtgattgtagcaggtgaaattaagggagaggataggtcacagcaggaaggtgctgagatgcggattcaggaaatatggtgaaggcttatctatcatgagtgctagtgatgcagatatgagtaggacagataattttctacttaggaaaaataatttcaaaacatttaatactaaaaaacaatgaaagtactaaaaggattcataggaaagtttaatataattttagattgaagaaaaacttattcatcaaaacaaaacataacaaaacgtggagaaaaattacaatatgaaaaagttaaatttgcataaggtgaaggacaccataatcaaaactgtaaaagtagtgtcagccagggagaaacattaatagcatatataaccaagtattgatgtacacactgtataatgagcagctatcaatctctgagacagataatccaaaaaaaaaaaaatgggtaaagtggagaagacaattaactgaagaaatatagatgtccaatatacatataaaaatatgcttattctcgttactttttgattcagcaattccacatctggcaatccattctatggtaatacttatgtatgtgggcatagattgttttgcatcaatagggaaataaatatgtaaatgttggtttattggcataataaaatattatgcaaccattaagaagaatgagctagatctgtattaaaagaatgagctagatctcagttaaaagagtgagctagatcatggaaagttctatgttaaatgaaaaagttacaaaacaatttgttcagcatgattctactgatagctaaataaaaagaaaagcacattagtgactatgtgtgcatgagagagagagagggagaatgaaagagagagacagaaagaaagaagggaaggagagacagagagagagtaagagagactaaattcagagaaaaacaactgtatgcacatcaaatggccaacaggttaatagcagttcatattcacagaggatcttagaattgggttgggtatgtagacgaaaagaaatacatttttcttacccatccctgggttcatgactgaggcctctataacaaaaggcagattaatagaaaaacttgcaaattgatttagcataagttttacatgatatgagaacttttgaaatgaaaacgcaatttatatattgttttggggaaatacccattagtaaacggttaaaatatgcaaggaatgataccatacagtctcaggaaagtggttaattcagggggagatggcaaagttgggcttcgtttctataatttttgactattaaaaaatataaagtatatatgacacgatatttaatgtttggtgatctagatgattgaaatatgtggacatattattttctgtttcctgatggtttgaagtttttgttattaaaaatacagagaatattttgcttagatgatgactaaagaagacattatggagtaacatgaggaaatatattaaatattgcctaaaataggggaaggaagaagtgtttagtttggaacagggtgctaccgttgtgacctttcttggattattataatacaaacagtaacttgcatctgttgagaagttattgtgtaccagatactttgcaagggcctttcgtgtattttatcatttaatcctcacaacagctgttaggtgatgctatggcttgagtgtgtcacccaaagttcatgtgatggaaacttaatccccaatgcaacagtgttgagaggtaggacctttatgagatgcttctcatttctctagcaaaagactctgccctctgaatggattaatacagttattgcaggagtgggttccttatctcatgggagttaagttcctgatgaaaggatgagttcggctggcccctttccctctctccctctgtcctgagtattctctctccctgtcatgccttccaccgtgttatgatgcagcaagaaggtccacaacagacgcagcccttctatcctggactttccagctaccagaagtgtaagaaataaatttctgatttttatacattacccagtctcaggtattctatcatagcaacacaaagcagactaagacagcctgtatcatagatgtagaaaatggacatagattggttttgaatcttattcatggtcacccagcagttaagtgacagaatcaagattttaaccaaagccttctgactcccttaaaagcttgtaactccaaacttccatgttctgtaataaatagcatttttctgttgagaaaggaaatgtggaagagactggtcctagccttaaatcagttgggttattaggaaataaagtagggaaatggaaagtaaagtttaagggatagaagaaaaaaggtttgggctaaaaactacctttccctatggaaataaaatgactagagaattaaaccttgaaagatccataaggattggtgtaaaattcttgtcttttcacttttgaactggtagttcaagcataagaaagaaacagtgtcttctcaggaagatcctgtttaaaatgtgttcctcgttggaaatgctaaagggtacacaggtttattggtttgcaagggctgttgtaaccaaatgctacaacctgggtatttggttacaaccaacacagagtttttgttgcaaactgtcataaattgtcagaataattctggagtctagaagtttgaaatcaaaatgtcagcagggccatgttctcttggagactctaggtagactctttccatgccttttcctagcttctggtggtggctgtcaatccttgtccctcaacttgccggggttagaactccagttccttcctctgttctctcattctttctttgtttctttccattgactttttataacaacactgcttagattagattgagtgcaccttactccgatgtgacatcatcataactaattttatctgcgacaaacttatttccaaataaagtcacattctgagctactgagaattaggacttcaacatgtctttctgtgggacacaattcaacccataacaacaggaaaaacacaataaggcaatcattataagttttatgtttcattcttgaacttggtagatattgagcatttaaaataaattaaaatatgttaaatgtataaataactatgagtatatatccacgtgcatctacgcaggccatgttttatttctaaatagtacatcatttaagtgtttagcaatttgtattatgtactgagattttatatctagataacaatgtatttagaaagagatttttaaatatcaccccaataaagaaaccagtggaagaaaactgtattaagtttcctccaattccttatttagaagagcatatagtattcaagtcaaataagttgttgaataaatgaccttttggtaaggtaaattattatagtaggtctgcaagatgagcacagtcattgtaggaaaatctgttgctgagtatgctttgtgttctttttcatttagttgttctgtttggttttgctttattttcttctctgactgaaagccttaacagaaacaaaagtgtttctctcatgtgaaatgattagctctctttctcaccctgacttcctgtcccgacttgaatagaaagcaatgcatgagtatctaaataggaatcaaatgttctttgacaaagatgcaaaagaaacaagaaaacaactggattttattcgtttctcagggacacgttcactgaactgcaaaagccaaaacacctgggaaaatctgcctaggcaggcagggctgtgaccagtaatggaaaatgcatctctgtgtgggcttagagggctgggaactatcatagactgtggctggagtgtgatcaagtaagattcaaaagagagagattatttcagaaccatatagcataaaactgaaacgcagagaacagataaatgtatgtgtctgtccttttaggcagaaagcatccgttttgaaaaaacatttacctgtgctgatttgaagatttcaatatgtgcctttccagagtacttgcaatcatcattgtgtagtgagccttcaaaaatgaaggcttgctgaagaacaccattacctgtgagtctgagtgtgttgtgggttgggtcatccaccagagcagatagggtagagagggcatctgtagaccactaagtaaaagaaaacatctgaaataccaccttctttattcagccctttggtttgtttgtttgaaatgaggtctcgccctttcactcaggttggagtgcagtggcttgataacagctcagtgcagcctcaaactcctgggctcaagtgatcctctcacctcagcctcccaagtagctgggactgcagacacatgccaccacactcaccaaatatttttatcgtttattttctgtagagactgggtttgactctcttgcccagagtgatgttgaactcctgggctcaagtgatctaccaaagtgatccagcctttcagtgccaggatttcaggcatgagccactgtgcccaacctcagccctctaatcaaagaaatagtaagctgcatagatgccaagtgtagaagttgaagtactaaatctctgctgtgttccagcattgctagggatgaaatcccctaagtttatttagcacttaaaataatactctctagtatccaagggcctgaccacttctttatcagtcaccacatgcaggaagcagtgtcagggccggcggggagtgcttaaatattctatttgcaaatgctctaagttgcaacagttagaatgtaatgcaaccccccccccaaatttagaagcccaggagggatttattctacccataagtagcaatgaatttgacacttgaagaaagttattgtgtataaatcaaaaattcagtgattataaattttgaatttttgtttgagatgaagggtggagaggaaaggtgggagtaggtaaaaataaatccatcgaggtaattgaagtcaatgaactttgtcagtcagtatctattatcataaaatgctataactgtcaccttgggcttatacagataatgaggactatctgtgttttaccaataaatttctttgtgttggtttagcacaagccttatacaagcactgaaaatgctaggagtaattttttttcttttccagttgacttttttttttttaacaaaactgtaacatgtggtttgcaattagctttaatttcaaactaaacatattttaagaagccaagtagtttttatgcatacaaagtttcaggattcctctcctctctgactttttaagcaaattgctgtgtctgggccccatctccacattttcacaacttaattcttagcactttcatctgaccacattctatattttgggaagcatccaaaggttttcttagggacttgaggtgggtgctaaaatatttttgtttgcattttttttttctggctacattagtttcttgttggtagtgagtgatttttcttaatttggtgattttcttatattaagattatgactttttaaattgcataggcaaaaattattagtttaaaattccagatctcttcatttctatcaggcatatctattggtaattttatcaatgtttatgctcatgcctagttagtacttcaattagcaaattaattgtacttttcataaaatacctttttaaagtaaggttgccagattaaatgcagtttgcccagttaaatttgaagttcagataaacaacaaatagttttgttccagttaaatttgaatttcagataagagcaaatcgttttgttttgttttcagacatactttttcacatagtaagtacctatacaaaaaagtatttgttattcatctgaaatccaaatttcactatttttttctttgttatttatttgtatatttattttatttttgtctggaaatcctactataaagaaagaagtataggaaaatttattggttaaaaacatgttatatatcaagctatctgtcttagttggttcaggttgctataagaaagaccttaggctgagtaatttagacagaatctatttctcacagttctgggtgctgggacctccaagatcaaggtgccagcagattcagtgtctggtgagggtctctccttcaaagttggcaccttctatatttcctcacatagtggaaaggagggtcaagctgccctgggcctcttttataaggacacccattccatttatgaggatggagctcttatgacgtaaacacccttggccccgacctcttagtactatagcagtggggattaagtttccaactggaattttggagggacatgaacattcagactgtagtattatctctaaaaatgtgtgtaattgactcagttacatttcaatgattagagagggaagggtaaatccaaatttaagatcttgttaactttgattcattaattcattttacaaatgttcaccgaatgcctaaaatgtcaggtcctaagggatgagcaaaacaaacttaattcttgccttaatgatatttataacttaacggagaagaacattaaccaaataatctcacaaatacatggtaaactgtaataaatacaataatggggaaggatgacattcatacatataggggaatgtgttggaaagggaaagtcaggcaagatttccctgaagaagtgaaatttgaattgttaaagaaaacaatcagtcaatgatacttgttaaagcacagtgaggctgactttagtcaggtctattgcaatagacatagggaccatgaaaatgggattttgcaatgggggagagaaattgaacgaaactccaaatatagcatgcacaagtgggaatttatagccaagaagtagagtgggggtcagtggatggaaaattgctaagaggaagcatctggagtaagaaagattcaaactaaaccaaccaaacatgaatcttgctgaagacagaacagagtgattaggtatcatctgggggatggtggaggatgaagaacctgctcatatattgagagtgatcaggtatctgtggtggaggattcttgctaaactgacttagcagggttcttgctaaaactggattttacaaggaagcacacaggagagcttaggagaaggaggctgactgaattttggttaagcaaaggataattgtcagaactaaaactaaagccccagtgggactaaattaggcaaagaagagtgtatcagtctgttctcacactgctaattaagacatacccaagactgggtaatttataaaggaaagaggattaattgactcccagttcacatggctagggaggcctcacaatcatggtggaaggcaaataaggagcaaagtcacatcttacatggtggcaggcaaggcggtgcgttgagaggaactcctttttataaaaccatcagatcttgtgagacttattcattatcaggagaacagcacaggaaaaagatgcccccaagattcaattacctcccaccgggtccctcccacaacatgtgggaattgcaggagctacaattcaagatgagatttgggtggggacacagtcaaaccatatcaaacaggtagaggaaaggaagtgaatttatacatagatgaggcatcaagaacaaaagaattgaaagtatgtgtcaggttgaacccagtgagcatagaaagtgttactaaaaattctgcaaaggaagtctaaccagatcaagcatgactcagcaagctatttcaattttgatactaaaactcaatggaaagatctaccaaggttttaaaagactagtaagatttgcatttgaaaagatgaatctagctgctcaaaagcaagaagattattgttgaaggcaccatttataaaccatttcctggtggcctgtatattcttgtagcaaaaagaaaatgatagctcaatgtatatcagatattggcaaactttttccataaggggtcagatagtaaatgtttcaggatttgcaggccatacgatctctgttgcaagttaataacagaaaggtataacaaattaatcaaagatttatgtgacccaagagccttcaaaaatgaagacccaaagatgtagggaaagctatctgtttttctgctaagtttagcgtagaatggacagccgtctagaaatgcgactggacaaaaggatatgatttgctgacaatagactgagagtgtggcaaaccgagccaggctgtccagacacttcttggtctctctgtgtaacatttcttcctccctggtatagggcacagccccactggaatgagggtcttcaaggaagaagggagaagggagagagtaacctttcagaagttttatgacttgctgtgggaagagagggattcaagtgtctatgacctgccttggagaagacgaattttatttcctatgaactcactatgggggagaaaggggagcagaagacagggggctgggagaagggcagacagaggctttgctttgagggcttctaatttcctttagttcaaagtccttgggatgccaaagcattatattttggagtattctcttctaagccacaacaaactaaaaaaatgaaaatcattttatcttaatacaaggtatatgaggcaattgaagccagcaggggctgacatcttctataatgcttaattgctaaagtctttccagtgcttctccattctgggtagatcttaaattatcttcacttttcttccctgctatatgtcttattttctgatatatttgtttatctactggtgattatcagctctgctccctatcaccacttgttgaactatattctccatgatttttaatattatctagtgtggtgcctcccaggcaatgttcatgacctcacaaatgggtcacttgttagccttggggcaccagggcagagtttgatgaggctttggatgggctggccacagtgatcatatatagctaaaagtggcctctttcattattcttgacagtatgagtgtattactattttctctctatgccttgacttggaaaaatttggaaaaccctgatcaactgtaacggaaagagtcagtaacaggcatatcagaggttctctggttaaggaagtagatattgaaaagagaaccattttggggtcagaacactggttctcatataccagctgatataaccttgggcaaatagtttctctaagctcaactgactaatttgtaaaaagagaataatagtagttgaacataagaagtaactgttatgctttttttgagagtatttaattagataatacttttaacttctagcatggtgttgagaggaaaactttctctgtcccaacttaggtgtgtgtgatgggagaggagaatgtgaatcaattgacaacagatagattaataggagaaaagttttaattcatatgcatgcaggaggcaggagcagtgagtaaccttgctgaatagccaaggataagcagtatacctagttaatgtcaggagttcgagaccagcctggccaacatggtgaaaacctgtctccactaaaaatacaaaaattagcaaggcatggtggtgcatgcctgtaatcctagctactcaggaggctgaggcaggagaattgcttgaacccaggaggaggaggttgcagtgagctgagattgcaccactgcactccagcctgctgggtgacagagtgagactccatctcaggaaaaaaaaaaaaaaaaagaaagaaaaagaagaggttctaagacttcagtgggaaagtatggaaggttctactgttttttgtttgtttgttttcatcctgatgctaatggagttttcttcttgactgaaagctccactgaaggagggtttatggcagctgaatttgtacatccttgtgttaaggatctgtcttctctcaagcaggaaacaccctcagaggggagttactgacagctatttttttgggaggctctgcttgaatttagataagaattttttttcttgttgctgcagttagttcagatgttttcagtttaaagtaacatttacaccagtctggtagattattggtcccttcagaagcgatagtatacccttgtctaagtcactgttctattcctacaactagactcaaaagaattgtcttaccttagaaagattcatcactttgtgtaacactcactttgtgtaccaccagttaagttcagcagaagacttaggtgtagaaaggtatttcagatttcttggcaaaccgttcacatagctggtaacaaagtgcatcatgaattgtgaatcactttcacatttttgtgctgataagaggacctctcatggtatagcccagagtaaactaacatgcatgacgtgatttattctaaccaacccgatgaaatgcagatgtgaatggaagctctaggcaaaatattacatggtgtatttcactgaagaggagaaaaatgtattgactagcaaaattttaaatatctgaaacccaaggtggtggtaaggactagaaaaattattttgattgcagaaaaatgtttttttctccatttctttttaaagaaaaattcagcatcaaaagcagatatcgcaggaatcagtcctaatgattatattctcctattgttataacaactgaaatgagaacacaacctaaatgaatttttctgttgagtttgtaaaaagaagtacatgttacattaaattcactcatccatgcatggatctttagaaagaaatagtttgaaaaaatttcaagtcttttagagaatgtgactaatctggtctgggtatttctggtcagggtgcatcttctctgctacagacaattcttgtgtctactcaaaatccatgtgttgaaacctattcctcaatttgatagtattaggaggtgggactttcgggaaatgattataagagtgaggctctcatgaagggaattagtgcccttagaaaggagggcccagagagattctctgtgccatcagccatatgaggactctgagaagacggcctgtaggaaccagaaagcaggccctctccagacaccaaatctgcctgcacattgatcttggatttgctagcctctcaaattgtgaaaaataaatttctagggttcataagtgtctcagtctgtttatgttgctataaaggtatgcctgaggctgagtaatttataaataaaaaaatttgatttggctcatagttctgaaggctgtacaagaagcatgatgccaacatttgcctctgataagggcatcagtctgcttccacttatggcagaaggcaatggggaaccagtgtagaggtcacatggccagagaggaagtgagagtgagagagagaaagagacagagagagagatacagagagatacagagagagaaagagaggagggaggtgccaggctctttttaactactagttctttcaggaattaatagtgagaactctcacagcacccccccgacactcacagtcccctggaattaatctgtgcatgaagggaccacctccattaggccccacttcaaacactggggatcagatttcaacaggaaatttgaagaggataaacattcaaattgtagcaatacattgcactgtaagttgtattgtgttatgacagctcaaacagatttagacactcactttgaaaccctttgcctgaaccttttgtgtcataatcctgctgctactgttgatgttgtacacataccactcattggaactgcaagaccaccaggttaccgtatgatcatatttttatgtgaatatatatattaaaaacctttaagccagagatatgcacataactcttattgaaattatgattaagcaaagtgaaaaggtgatagtcctaagtatcctttttctaaggaaatgattagagtattgctttacagctgttgactttgcaagtgtccttggagtacggcattccttccactctccccttcccaacccccgacccagtagttaatggtgggcttctagtacacacgctgagaatcatctcccactttggaaatgatgataactcagaatggatcataaccggactcgcgatagttttcatagacaggtaataaaaagaagacattcaacatgaaaaattaaaggtgttacgaagatgccaagagatatattcttcattttattgtagaattatcagaaggagatgaagagttccaacctttaagagcaggcaacagtaattttccgtggttctgtgggacaccttatgcttagcaatgaaagtgtgtaataaactctctggatgaaatattaccgctagcttccagaactttattctgtttatcctctccatgggattctgctataatgttaactcttagaatgctaagatttgccaatgtctgacacttccagttcatcagttgtggttctttatgtgaatatttgactagagagcttcagaatgttataacattctttaatggaaagggaaaattagttttcggatgtgagtttcgttttatggaaaactaaattttcttccatctaagaattttaacttatgaaattataggagacaagaagtatgttttttataaatagtggagtgtttctagtgtcatctgccttgtctgaattttcacatcaagtaaacattttcttagagcatttatgaatcatgaaacagtgtttgtctattaaacagattctggtcataagtttttcaagggcttaatttataattctctccagcaccttgattctttatgctttgtctgtattaaatttccatcatctttttccttttttcttattgaaattatttgggggtcaaatacattcatttttttgttattttaataaagaaaaccgaagctatgcatccaagagcacataagaaatttattattcatgaatatacatttatatgtgcaaatgtatgtataatagacttaatacgtgcttgtatcattgaaaaactttgttactaacaggctttgggaatcatgtctgtgacatgaagttgaaacaagacaaaaaaacttgagcaccaaatttgctcattggtggtttagcaactgtgtagaatttcaaggattatgtcctcattagctgatactgctctagatgtactatatttaatgttatacttttctgaatatactaatgttcaaaaaagaatacaattaaaatattagttaatatgcccacttcaggtgcaaacacattttacatgtgtctccgcacaattccttgtttatgtgtgcattttaatggtttatttagatcttatgttctgtatcttttgtgatattctcagtacatttagctacttaaatttgaaatgtgaaaattattctttccttcctaaattgatctctaatatgatagaaaatttttagtgcttactataaacgtcaaagttgggtatttatcttttatttgacaaaattcatatatatgaatacatgcatagtataacctttagtcagtgaacacccataaagtcaccttacttgagttaattaattcgaaaattatgcattcactacttacgggggtgttaaaattttatcttgcggtggggttgcaaactctcactgcaaatcccttaaacattggcaaattacagtttcacatataagagatagaactagtatcctgttcattcaagaaaagccagttagagcaatgttgtctaaggtggcctcttgatcgtggccaaagctgtcctgggactagagtgaagcaggtgaagtgcccggggtgtgcttcacactcttcagtctcccaagtgcccatcctgttcttgaacaaccctgaaagttgttcaagtgaggtgccttgggggcaaaatttaatgaagtcctcactctcaggatcatgcatctgtcccctgaattttgtacttgctacacaattgtctaggtcctggactgtagcaggtttcacaaaaatgtgtacagggtgcccctcctgtgtcactgagctgcagccagaggcagtgtatgcatgcagaaatgaatgacagtctcttggaaaccaagcgataatcttgtataatgttgagtgatgctagcaggtatgtggatgtaggccataactgagcacttctgaggcaagttgcatacttacctgaaagtgcggacccttttttggtagctgcatttttgtaattattggatcccatagaaccatgctcacttgtgagaaataaggggataatttgtgctcccaattaaagttttttggactcttgatgttgattccctgcaagaggatactggaacttgcattggagaggctgagttagggttttatggatagacttaagccaaaggcaatatgaaattgtccaaatggtgtagggttctctttgtcccaagagttatattcttgcaaggagttattcactggcctatgtgtgaatgaaaatatggccatctatagttaatgtattgggctttagtgttaggagacagtgatatttgaaaagtcatccacacatagtgaaaccattaataatcaagatctaatgaataaactcagccatctgcagagcctcctaaaacactgtgtttaaatacattgtagatgcaacaagagtgatgcaagtcagatttagaagaccaggctgttttccagaaagctgtaatgctctgaaatgtattgtaatgtttctgaaataatggttggattgttataacaaaagtgtgatggtttgaaaaaggcacaaaaaggggaacgaaaatttaaaattgctagtgcatatccaggaactggtatgggttgtggttcttgatctagataagtgctttgctctccttagatagttctagcctttgtatatcaaaggtaatagtcatactacattgcttgaaacggaattcacattttgatacatctcaccttacattggagtctccttagtagcgtaaatgaacctgatcatctctcagtatattgatgaatacaattcctgtacatgctaaaatgagggctccgattttgacttggtgttgaagtcccttcttagttgccactctctctcattctttttctggtgctgcagctttttgctgcctccttcttccctgggcttgtggcagcaggtcgagtgtattgggttatccagtgggctgattccaatttagatcctgtggaagactgtgctttagaggagggatcagcaaaccacggccacatgccaggtctggcccactgccattttttggtatgactcgtgagctaagaatggtttttccggttttaaataactgaataaaactttaaagaagaataatattgtaggacacatgaaaacttgatgaaaggcaagtgtcagtgtccacaaagttttatcagaacacagccacactcacttattttttgtactaccacagtggaggtgagcagagacagagttgataacaagagaccgcattacccacaaatcgtaaaatatttactctctagacttttacagatctctgccctagatagtccagggaaatgagctgaaagtttccataaaagctctgacgtctttgcagttgtcgtatagttcggtcttcaaggggtggaaagttgtgttgtggaagtgcatcctggaaaaagagcggatatgagaaggaaagcaaagggaatgaaggtggtgatattatttttttctggtttatattgacaatcttgaaactgaatcaagaatcaaacttctaaattcagattcatttaacaattcttaaaaatgctttatgttccagggatcaaggttggtgatttatgagaaaacaagaacactagcccattcacaaaagtcatctcaaaacataattatgcacttttctgaatgattgcttaactgtttcaattagtatgtctcctctacaagtagtgctctttatagggtaaatttaaaatctctacattcaaagtctttatcctctttctatgtttcttctctcttctccgttctcctgcctcccttctccctttacatctctatctacactaggtgtgaaacactggacaagttacttaagttctcatttactctcattataaatgagaacttacatactagggccttacttacatacaagggctattttagaaacgttaaataagaggatctgtagtactcagcatacacataagtaacacaggcaaattttgattcttataatgtgagttttcttatgaaactaagaagaaagtgattcagaagtgctacattaataagaaaaaatagaagttcaaaatacatttactgttctatagctacataacactttattcttgtgaaagtttaagaatgacctgctaagtatttcagttatcaaacctaatatatgctgggccatttgggtcatgatttttatccgggaccaggcatgtgttaccgttaaacactttcattcatcatttactagctaacagctaaacaaaactagttgtgtaatgcgaaatcactaaattgctgcagtagtcacttgtaatgaataacagaatattacactgccaataattacaggtgattaatattttctggtcagtttccattccaggatttgagttatgtggataactggaacattccaccttttatgagtgacaaaatcttaatccacatcaagagttctgtattgtcctgtgaatatctaaagctaaagaaagaatttagagactgtaaactacattgaaggagattttaaaaagggggagaaagggaaagagaaggaaggagggagagagtgaagatgtgagagagtaaaggcaggggaaaggagggagggagcaagaaaagaaaaaggaaaagcattattaaaaagtgtccggtttaggcatagtcaattcttatatcaggaagaggatattaaacggaaaagagatgcataaatcaatatcgtctctattttgagggctattaaaataatccttaagtttctttccatttctgactttgatgctaagattgctctccaaatattatatttttcattatattctatgccatttatagtttgtaggagagaaggaaataaatgatgaggtcccatactaaagctgaaaatttttaatctctcagacaacagataatcatgtcaccgtgcataaaacataaccatcagtagtaaatgtataaaactgagttgcttaaagtcatagaataattgcttctaccaactttgtaagaaagagtatactatttttgcataaaatgtaaattaaagttgaaatattatctgtgttgaatggaagtatacaattctttctcggtacagggaatcagtagagccttacaggaggatcttccatgttgcttttagtttgggtgaaaactgttatcactggatttgcattaaatgaagttccttcctcttaagataggatgattggcagggattaaggctttattactacaagatttctaagccaagcttctctttttcatgaataatacctacccccttatttattcatggtatttttgacagctgacagttcaggaagtatatgtgcttctgtattaactattaaagctctctgtttacatatgggtggagatggctggtacatttccacttactccaccaggtatgttaaaatcataagtgaggaaaaaattatataataaaataaattttataataaaataattaaaattattataaaataattaaaatataatattttaaaattattataaaagttataaaattattataaaaattattataaaattattattaaaattatataaaatattatattttaaaattattatataataaaataattaaaatattacaataaaataaagcaagacatgtggaagtattagagggaaatatccagagattatcaagccatatttagttgcaccttttctcgtggtattccatttcagtgattttaaaaaatatatcaatgatgagtcaactagatacaaatgttattacttctggaattcactttggccttgttgaactgaaatagttctatgtaaatgtatatctgtctgtctatctaatttgcttagttttacttctataatacaagatttgacctttatttttccatttattaatatcatatttccatggtaggtcttcctagagtataaagaaatcaagtttctcaaaaataatagtgttaatatcaaaattgcgagtgagtacaaagagcatcatgccaagtgaatggcttatctccagaaaagctgcgtcctggtgaaaaggggaactgagcaaaatgcacattttgattgtgtgtatcagataaattatagctgccagcaatcctctctatagggagaaaattcacaggatgggtttatccaaaggaaggaaaaagggtcatctcccctaccttgctcttgtctgagcctgcagttgctgttttcattcactcccacaggggtgattatagagcagcctcaacaccaaagcaggcaaaaaaaaaaaaaaaaaatgttggcggggcgcgatggctcgtgcctgtaatcctagcactttgggagggagaggcggggaggatcacctgaggtcaggagttcaagaccagcctggacatggtgaaaccccatcactactaaaaataaaaaaattggccaggtgtggtggcgggtgcctgtaatcccagctactggggatgctgaggcaggagaattgctggaacctgggaggcggagcttgcagtgagctgagatcgcaccactgcactccagcccaggccgacaacagcgagactccatcaaaaaaaaaaaaaaaaaaaaaaaaaaaaaaaaaagctggactaaagaaaaaaacaaactacaacctgaatacagtctttaaaattattaggccagtcttagtttttttggtgttttcaacaaaaatatcctgaaccattaaatctgggtttgagtcaagaatgaaataataagttgaagtgactagactaagttcagtgaaggaaaggaattgagagatttttcttaggaaatagataactgttgacaagtaaatagttattaaaaatatatgtcactgcagtgtcagccacttatttatttttaattaaggatctgttgacctttttggccttaaataattgtgttaaatagaaaatattgccatttaaacttctgtgtagattactgttaactataatttaggaatatgcttccttaaagtttttgtaagtttattttctggatcatttctcaatgacttgattcttaatttggtctaagtgctattttctgatgcttttatagagtttaccatgttggtttaaaatatactttgctgccagtttactaagagagtagctgagatgtactgactgaattactcttagttgcttgtatcctaattatagaattctttactaatccaaaagtaattcagcaaaaatacttgactcagtaaattcttattttaatccttgtattttactataaaaagatattttaaaatatttctttgagacagacttttctttcagtacaataagatatatgaatggtgctgggcatgctggctcatacctgtaatcccggcgctttggaaggctgaagtgagaggattgcttgaggccaggagtttgaggtcagcctgggcaacatagcaagaccctgtctctacaaaaagtttttgaaaaatgagccaggtatggttgcaactgcctgtagccctagcaattcaggaagccaaggtgggaggatcatttgaggccaggagttcaaggttccagtgagctatgattgtgctactgtaccccagcctgggaaacagagcaagaccttgtctctaacaaagatatatgaatggaattaaaatgttttcttggagcctcttgtcattgatttagaaagtctatttaacctctgttcggttcccaatgacaatagaatgtctttcttttctcatttattttttctgtcgtatcatgcagctctcacagaaataaagacagaacattaaacaggtgtaccttttaaattctaagattgtaattttattattgaatagaacttcacttttagtgctttccaaatgatggtgcctatttgatttcctttaaattcttctctttacacatgacgatttcacttgtgttgactagtaatctttggtttaacccttccgcactttttgttaagtctaaagtttaaccctttagactttctttactatgaaactatctaaactagaaacatactagggttcaagttaagataatgaagagtcatctggtattaatgggaaacaggagtatgtaaaacccgaggttctcaactgttttcttcctttcattctaggacaaacattgatgtgtgagatatccccatgcatttgagaacctttgcatagactgtactgcagccctacccctttcccacaactgttcactgctcacactttctcacccttcagcacacacatagaaaaaatagtactgaagtgctcagtagtagttaagagtgaaattaccgatgatttcagtactgcattttagccagaaaagtctaaggtaggcctaggaagccaattcagaccaagagatccctttctcaagtaggtcatgtttgtgccttgagtttctatggctctttggcatccattgtgagcgagatggacacagtccaggaaatatccctaaggaatagctactggtagcagatcccattatcaatacagttgtactataaaaggcaaaggcaaatgaacattacaataggcatttaactttcttttttttttttttttttttgacagagtctcattctgtcacccaggctggagtgcaccagtacaatctctgctcactgcaacctccgcctcccaggttcaagcgattctcctgcctcagcctcctgagtagcaggtattacaggcctgcaccagtacacctggctaattttttttgtatttttagtagagacagggtttcaccatgttagacaatctggtctcgaactcctgacctcaagtgatccacccacctcagcctcccaaagtgctgtgattacagacgtgagccaccgcacccagcttaactttcattttttaaaaatttatgtcaacaagctaaaattcctcttgattttgcattacagttaaaatatcacaaggtatcattgaagaagtttaggtgctcagttcctaaaggcccttataaagtcactttcctagaagccgttcccttttctccctaggttggttgcatatccttcttgtatatgcttagaaagtccagcatttaacatgcctagatcttgctgaatgttaattacctgcatattttaagcatcttttacccctgcatcctccattagaccgcaagtccattgacagtatgtactcaacactagcagagggctgggctcaagttctgaaacatgtgtgactttggatatcataatatccaatgaccacccacttgccatttctaccctttctattattcaattggtataattctgactagcagaagtattttaattcaaataccatcattttctgaaaataatcatgctacatctatgacaaagtgtcacctaaaattatttcctcattctcattaagtagaaattcctaggccaggtttatttatttgtaaatctcataagtttggatttaacagttcttgtttattaaaatcaattatgtggtgatttgtgagtttgaccaaaagctgatttccctactttattttagaaatttatatcttcagtctatactgtttttatatttggatataaaataaatttacattattcaaaaacataaaattcaaaagtataaaggaataaaattcaaaattcaaatataaatgaataagcaataaaaattatcttgttcccctagcccatccattgctctttccaatggcaactgatgttgtagtttcttggttattcctcctaaaatattttgtgaaatacaccaacaaattcatatactgtgtaaaaggtacattagtttattccctttgaaaaacaaatattgatatactatacaattttttgtccttgaaatttttatataacatattacagtgatcttaatccatacaagagaacatcctcattcactttataactagataagcattctattacatcttgtatacaagttgagttttgttcgttgtgtttcatttatgggatacaaatccagcaggaatttacacacaagtcaataatgtccccaagaccatatgaaagatatgagacctcgatccttggcaggactgactgtccattgtaccatgttgttaaagtgactgaaggttattgacttactgcaataggagttagatatctgatttagttgagtatatccatttcaaaaggaaaacccaggacttttggtgtttaatcattttgtgaaccttaccttaaccctttcccattagattggacataaacaatgcttaatatcagtgactaatggtattagttcttcagcctggcggccaaacagagcagttcagaactaatcagcaagatacaatcagatagatgccagaggtgagggataatttttattttctctgttctgactctctggagtttcctctttgcagtaatttaggtcatgtctatatttactggatgaaagatttatctgttgaattctttaaatggtggcaccaactaaatctagttctttgcaacagactttagaaagattaatatgttctatgctttctaaaaaaggtagtatagataagacttgtccctttttatttgaagttagaatgaaagtaacatttttgaaaattaccattgtcttattgaaactcaataggtaagtatcgttctccctaacttgaaggttcagctaatattttgttgagaacttgcactttgccaggtactattttaagagccctacctgtattaactctttgagttcctataaggtaggtgatgatgttatccccattttatagaatgggggaactgagaagcagagaacttaaggacttgctcaagaaaacagcagaactaagatattgtaaagccagaattagaagcaaataaataacaacaaacaggacatttggctccagtgtcattactttctatggctaaatttatgcgacttctcagaggaaactctagttccagaagctcaaagtcatgtacctgcaaagtggtaaagccaggatttgaacccaaatctgacatcaaactctgtagttttattcactgtataaatagagagatatgattaaatatatgtattgatatataaatataggtaaatatatttgaaataggctatgtgattttgaagtgggtgaattttctcttgtgccgtctctgaaccggtgttagatttcttgaactgttttatgattccatgctatggttaactatgcaattacttctgcatagatgcccgaaaaaatctttacttaagatccattcaattcgtgtttcttcggtaaagtcttccctggccatgctttccccaacccggcatgcgtaacaagtcaagattatcagtcactccttgatgtcacttctgtgtcttcttttttttttttttggagatggagtttcgctcttgttgcccaggctggagtgcaatggcgtgatctcggctcgctgcaacctctgcctcccaggttcaagcgattctcctgtctcagcctctcgagtagctgggattacaggcacatgccaccacgcccagctaagttttgtatttttagtagagacgggttttcaccatgttggtcaggtttgtctcgaactcctgacctagtgatccacctgcctcggcctccccaagtgctgggattacaggcgtgagccacaacgcccagcaacttctgtatctttttacataacttagttaaggtacttaccaatacatgcatgccttttgttaatctgcaatacctttatataaaatatggtgacttaattttgtatccaaagtatgttacatgctatctgactcctggtatgcactcaattaaaaaatgtaggaagtctctgtgaatgtattctggttcgagggttgcctgattaaaaaaaaaaattaaaagtcaatgactctgacaccatcctacatttgtctaacttaatacgtcagtagctgtaatgaattagagctctataacttgaagaaatgtgatattgtttgataaagtaaatatagaataaaatctttgtacgtcgtttgttcagatgaacattttaaaaataataaatgacgtttatcctttgtccccatgtgtgaatcaagtctgtgatatctctaaactctggtactctgaaatatctcttcctgacctgctacttcacttcaatacactccttcactcccgcagagcttgctcttagcttcagcaggatctcttcctgttccatccagatgccctttcctagccttggtgctcccactcatcttctaaatgacagccagctcagactccattcacctttctagttcccccgagagagtctcaatcccatgtcaactcagttgttagctttcaccctgcacctctcagctcactgcatacaggcggagcatctgtctttttatccccagggagaagcaaaggtatttggattgccctaaaacactcagggaggacttaacggatagtcacttctaaagcactctttctgttccaaccctttcactgtgtgcctctgtgcagtagagaagtgagtctactaatattaatgtgtgaaacaaggaacacttatcaaagtagctgccatcagtgagccacctgaagtggaattttatttgtcttgtactcagcaccaaagcagaatatcttgctttttttggaagaaatcaaaataacacagattttactttggaagatgaaacacactagcatgtctcatctgttccttcttgatgatctgtcctcctggaagtatgacagtgttgacgtagatgtactgagttcatggaacacaagcctattatcgttcctctctgtcatatggaaagaggagaactgagagattgagaaaaaagttaaaacacagaggacccaagtgtaacgtcatgttaaaacatttttgaaattatgcaaagagaaataactatcaaaggagaagaatgaaaatcaatgagtaacaattaaaagacgggattttttttagaattcaaaaattaatagaattggtagtgctttattttcttatacaacatttatttagtgatatctaaacgttctttggctaaagtgcaccttctttttttctccctcttccctccctccctctctccctccttccctccctccctccttccctcccttccttccttccttccctccttccttccatcatcacaggtgtgagtgttacagagattatctcaatggttaatctgtataaagatgaatatttcctttatttctctccgctgattagcgctgtctcaaatggcaaatgttttaaaccctgatcttttgatgcacttcctgcagcctcaccccacccccaaactcaaagagagtaaaatcacagtgttcctttctctttctccccgtgaaactggcaaatccccaccactacccttgctaccccacccatcaccattcatttctaaagcagacatttagaataatcaggacagcattttggcagggcgcagtggctcacgcctgtaatcccagcactttgggaggcctaggcggggggatcacgaggtcaggagatcaagaccatcctggctaacacggtgaaaccccgtctctactaaaaatacaaaaaattagctggacgtggtggcacctgcctgttgtcccagctactccggaggctgaggcaggagaattgcttgaacccgggaggcggaggttgcaatgagccgagatcacgccactgcaccccagcctgggtgacagagggagactccatctaaaacaaacaaacaaacaaacaaagacaggattcttacacttcctgtttccatagaatctatagaaggtctaaagtacctaggatgccgtattagtccacaaagccatgatcagatttccagtctcttgagcctagcttagatcttcagaggcacaatgcaagacggtttttaacagagaaaatgtgcatgaaggaccttttaaattatagcttctaaactttcagcatcccttcaatgatttcatactctgactatttttgcatcttcctgacatttgcagttcccttgaggcatatattacagtacacacactacccatggttagataatcacaagtttagatatttgtgaatgtttcagctgtgaagaagaaaaatgacttcaggcaagggtacttgtgaacatcatcattgaaaatctcagaaaattccatttgcatatatccacatatgtgagcacttggttgattctcctcctttacttttgctactattttgttttgctttaggtcttcctttcttttcatttatttttaaaccagagtacatttatcctggacattttctgatgtttatggggggtgaggggctatgtgaaacttgatgccaattgacatgaaatctatttttctgaagagaaatttgaggtatctaggagaatgcattttcaatcccttctcaccattaacgtgtattaaatgcccaagctaagtttgtccttgatgtttgcagagaacctaaaatctctggagaaatcagatattttagggtcataccaacaaaggaacacatgaaaatgaaggttactcagaaacaagctttttaaagctgaggcataaatggcagagctgcccattgagtaaaatgttctgcaccgtaagagtgaaccggaaatggatagaaaaataaattaacatttaaaattatactttgtgtttaagaattgagaaaatttgataggccctgtaaaaaacaccattagaatgagaacattctaaattacatcgttgaaatagtagaaaacacatgtccttttttttttttttttaaaaagtctttttttaggtgttttaagtaattctctttttctttttcttcttcttttttgtaatttcaatagcttttggggtacaagttgtttttggttaaatggttgaattgtgtagcggcgaatcctgagattttagagcacctgtcatctgagtagtgtacgttgaacccagtatgtagtttttctccttcacccccttcccaacctctttcttctgagtctccaaaatccattttaccactccactctgtctgcctttgcatccccatagcttacctcccacttacaagtgagaacatacagtgtttggtttttcatttctgagttacttcacttcaaagaatggcttccgcctccatccatttgctgcaaaagacgctactttgttctttcttatggctgagtagtattccatggtgcatatataccacattttctttatccactcattagtcaataggcatttaggttgcttccatatctttggatttgtaaattgtgctgcaataaacatatgtgtgcaggtgtcaaaaaagatctatttgtaatgtttcattcctagttgccaacatgccaacaaaatacttttttttaatgacagagaacttaaaattgatgttgaatttctgtttttcttttgttactttttacaagtatctgcaagtttcttgctgctaggaagcataaaatagaaactatttgcatatgcatttaaaataacttctgacttatatcttattttcattaataaacttcagctacttcactggaaataattttattaccaccttgtatatagttgataagaaatgagactctagaacctcattagcatgtttccttagacacataatttaacctcaattttctcatctgtaaaatgaaaataataattgtgctttaactcaaaagccaaagtttagacacatactgcactgtaataggcatgatgttcaataatgaaatagctattattattattttgctatagagaaagatatataagtaacattaaaatttggaaacaagttttccatattttcctattaattaaaatatttatttttctcttttattgttttatatattttatgcttttatggtcattgcaggaatggaagtttaaggctcaaacttgcaataagtagagccagttttaattatttatgctgctgatactcaaagtttagttgaaattttaactagtttttggtttgtttaaactaattcaaagtttagttgaaatttaactattttttggtttgtttaagtccctaaaggtagatatattgattttaacctaaaagctgttaacttaggattctacactttgccatggaggaaaagaggttgactaagtgcctcctttgagaaacttaagatttaattaacatttttcctttccctctgcttcatccatacttcctttcaacaaaagagatttttcatcctttatgtactttctaatattccatagaggtttatcactttagttttcataaacttgcaaagatgatctcaaataaacggcttcaaaaataggacattaactgtatgtgtttaaggagggaagagattgtagttagaatacttaactaaatgagttctatcaaacattggagaagtactttagaaagagtttactaattgacaaatgtaaaatatgccgccctgaaaattttcagatgtagtatggtgtaaaatatgttcacaaataaacctaaaaagcatggtgagttttttcatatatactctttaaacatttggtcatgacaaatctatgtgatgtttgggtggagactagtgctcaattatttcccagaatgctaaaatctaaatgtatgccaaccgaaagtctttaaatcagatgtttattacttaaaactgaaataggttaacctttcctagatgctctgattaagcttagtcctcaatgactgatgtacactggcttacactaaagttattaacctaagaatcttcccagcaagtccatctctttcttgatattatgatctgtgaagtttgaacaaatgttgtttttcttcaatgttatttatctttaaaaaaagtccaggagtagaaagtattcctgatactcgataaaccagtcctctctgaacaaggaaataaatacctctctccaacttttagaaacaattgaatgacagccttctagtctcctattactgagaagattatgtgtggctttaagacacaaattgtaccttattagtctatatggccctctacccagtactttgcctgaaatataagtgatactcaatgaacgtcattttaacaaataagataataaattaatgagcagatatagacctttttaaaactcatatgacattttgcctgctccttatagagtcacaaagtatatataaataagatgtaattagaatttgtgttaatgagaatttaaaatattgtgatatagaaaatggctgtagactttatttacagacaagatactataaatttcccttcccccattgttacctctaaaaatttccatgatttcaaagctgttgagttcattgaactgttaattcttcctcggaggcagtgcaatctctgcaaaacaaaaacactctggctctgtggtttacaataaacttcaaatatgaagggttttttgtttgtttgttttgtttttgtttctgtttttgttttagacggagtctctctgttgcccaggctggagtgcagtggcatgatcttggctcactgcaacctccgcctccggagttcaaataattgtcctgcctcagcctcctgagtagctgggattactggtgcgcacaaccacacctggctaattgtttatatttttggtagagaggaggtttcattatgttggccaggctggtctcaaactcctgacttcttgatccgcccacctcggcttcccaaagtgctgggattacaggcgtgagccaccgcacctggcccaaatatggagtttatttgcttgttttaaaatatttattagagaataatgtgagtaattttagtcagtaatgtgcagttattttaaaattcaaaattattatcatttaaaatcttttcaatatcccattgtaatggtacccaagcgacatttttgtgtggtagtgtatagatctagaacatttatctgaagataaataactttgaaacagagtttaacaatgattcaaagcttgggaaaagcctaaacattcatcctgatatatccgaggaagtccttcctctagaaatcttttacacctattcctatggaaaacttagcttgaattatacaagtttttcattctgtgaggtctttgggatgaattcctcaagtgaaatgagacacctccattgataaccctctcagttacatgaagttcctgccgcacagtaagacattgtatgttttcctgccttaagtaaagacactttgttgcagaatttaggtaacttactcaaaaccctcagacacgtgagtgacagagcctagaacacagttatcctaacactcgatccaggaatgtttctatcacatcacttctaatcctaaatctaaaagtgaaatctaacaatagcaaccaccacaagaaagagaaataaaaacatgaaatattgtcatgtaagtcaatttgtaatgatatttatgttttactattctaataataactaatgcatattgagtatttcctaatgaaggtaaaatgcaggtaatatgcttaacagtacatccactgcgtactgtgctaagtattttacctgcattttattactttatctttatgggaaccatcagaagtgcatattaatattatctcattttacaagtgataaaaataggactttaaaaagttcaataactttcctagctattagatgtcctgactagatctgacttcagagcttgttcttataacccatctatgattccaatttacagtatcttcaggactaaagtaaattgttaatgtttaacactttaaaaaaagataccagtggaacacttgattttctaaagcacacagagaattttcttttagcacgttaggtatagaatgtaatacatttaactgtaattcagactgtgaaaattaaattatagaaaccttgtagcagcatttctttgagtgttacatcaggtacatttcagttaatatttgaggattacaagatattttattaaaatatgtttttctaactgttaaaactcagagttaattattttttcagccaggtaatttttttttttttttttgaaatagagcctcgctccgtcacccaggctgaagtgcaatggtgtgatcttgtctcactgcaacctctgcctcccaggttaaagtgattctcgtgcctcggcctccggagtagctgggattacaggcgcccaccaccacactaggctaatttttgtatttttggtagagacaaggtttcaccaggttggccaggctggtctctaacttctgacctcagatgacccacctgccttggcctcccaaagtgctgggattataggcatgaaccactgcgcccagccgataatttttttataaattagttctgcttgatcaaacaggaaaagcttgaaggtcagagtttgaagtatttctgacttatttatgaaaatgagagaaaaagaatgctcttgtcttgatgaaagccttattaagccgctcacattcccaaatttgggatgttagagtgaaatcttcagcctcggccccattcatgaaaaatcttggaagcaagtagtgatttctcaaactgtgatgccacccatttttacaccaaatatcagtgtttctgggactatcatgcccctggtgggtgtgtgatttagaatgctaatgagcgttggcagaccaccgtagctcctgctgtaatcctcacactttgggaagctgaggcaggaggattgcctcaggccaggagttcaagaacaacctggccaacatagggaaaccccgtctctcaaaaaaaaaaaaaaaatgaaaaaaagaaagaaagagaagaaaaaaagaacatctaatgaaatcctaggagaaacctaggtcgaatcaagcaccatgttgggtccagttggtcttaggtcgcttgacctacaccctggattttcagggtcttatcagtccctagcttctgcagctatttgaagtttccttttgatagtcatgtgaaactgctgcctgaaattttctgatctcctgcgatcaccctgtattatttctgtctcaaaaggaaaataaagcttgagaccccaattcactctaccaaaagaaaaaaaaaaaagctgaaagctgagtcgtacaagaatccgcctttccttttgttcctaagcagatagctacaggcagaaggttaaatatccccacaggtagctactctatgttcatcttatcttatgtaaagtgtcagtttactgagctccagaaaaatacataattgactattgccctagctgctccttttgttctgcaccttgtagattcagtaatgtggccataccattcttcattcacctccatcctgcttttccccttcaaatatcgaagccgtctaaatcatccttagagaaaggctcagacttctcttttaggcattgtccttaaccttggcaaaataaacttccaaattgatcaagaaaaaagaaaaaaaaatgagtttcgcttgtcccaccatttacccctgccgagtggtcagatatttgtagcaaatttagttatactctcttaatatctataagcaatccaaactccattctcatagattcacacatacacacacacacacacacacacacacacacaagcagtttttttgtaaaggtactattttgttaaaatgtgaaaggatgcagggttatcttttcaatgtatattcaacaaatgaaaagatttttggcaccaggcatggtggctcacacctatagtcccaattactcaggaggctggggctggacaatcacttaagcccaaggagatggaagctacagtaagccctagtcatatcattgcattctagcctaggcaacagagtgaaaccttgtctctaaaaacaaacaaacaaacaaatgaaaaactatgttgggatcttcccttttgttcttctcgctccttctcttctttccccacctctttatttctctactttcttcttttttaaagtttgtttttggcatttctcaaattattttaaaaattaaaggcatccttattgtaattttctaatgtttttaatttttattctgtgttgtatatatttaaggtgatacaacatgatatttttatgacttctctcacaattaatatcaagttccagtttgtggtgtgaaggaatgatgtgtttcaagtattttatcatggatcttcaatttgtggccttttactaccatagtaaattgactgtaaattagaaaggaaccttaatacaccaataaaatctataaaaaatttgtctgaaagagccatgtctctaaagacaatttttaaatagagacaagatgtagcattttaatacatagaatgtaaagtaaattcagagtttacgtcagaggggtttttctgatttatttatttatctattttgttgttgttgttgagacagagtttcactcttgttgcccaggctggagtgcaatagcacaatcttggctcacctcaaccttcacttactgggttcaagcgattctcctgcctcagcctcccgagtagctgggattacagccgcccgccaccatgcctggttaattttgtgtttttagtagagacagggttttaccatgttggtcatgctggtcttgaactccggacctcaggtgatccaaccaccttggcctcccaaagtgctgggattacacgtgtgagccaccacgccaggccttatttatttttttaacccactttcttcctccatagatgtatggtgatgatagagtgcccacttgctgactgtgcctatgtgtatttaaataatttaaaatttaaaaaaaaatccagttcctcatttgtactagccacattttaactgttcagtagccccatgcgggcttgtggctactttattaggcaccacagacataaaagatttccatgatcatgcagtgttctattggacagtgccacacaacatactttggtatttaaccaggaaagtcagcagtattgcagaactgtgtgggttcaagccaatgttgtttaagggtcaacagtatttatattttatatttatatatttcttacatttatatttactttatcttctttcctttttttcttcttcttccctttttccttcctcccttctttccttcatgtcttttcttcatgtctttctcccttttttatttttaatttctttgtaatttctctttttgaccgagttcattaacttttttttaaaaaaaagaactatttcagcaagaccatgacattggctcacccactttgtattcatttaggagtgtgtctgttttctcacccccacctggtatggttgctaaatccagatgaggataaagagcacagatgttctcctccactgtgtggaagcctaggctacactcttgccttatacttgatcatgtcaaacgcattcactagaaagggatacaaagaagattctaagattgtgattttacctataagtgtatttaaacagcagcaacctatgtccagaagagaggaaacagattttccaaatatcagtcttgggcctgggtcattatggggaagtgggatcaatgagatgaaggtggtaagatccatgtccttaaggccagtccttccgccccttcttccaccttaaccacgcagcttagattgcaacccagattcctattttactcgacctgtaggtaacctgtaaattggttactctcctcctggaaaatctaaagttgttatatgagaaaaagttccagtcaagtactctggtgtttttcttgatgtatggcatcttacacagtttggctgtgtccccaaccaaatctcatcttgaactgtagcttccacaattcccacgtgtcatgggaggcacctagcagaaggtaattgaatcacggggatgggtctttcccatgttgctcttgtgatagtgaataagtctgatgagatctgatgggtttatagagggaagtttccctacataatctctctcgcctgccaccatataaggtatcccttgctcttctgccataactgtgaggactccccagccatatggagctatgagtccattaaacctctttcctttctaaattacccagtctctggtaagtctttattagcagcgtgataacagataataaagcaactatgatcaaaatgtaatatgaaaaaaatgaacattatatttttaaatagcatgtgtgccacttacattttaaaaacattcagtgatcgagattatccattattcctgtaaaccctgcactcattatacacagtgtctgaagtgttaatagttcttattggaatcattgccctgctgagttcccaacatcccaacaattcagcacatctcaccagtctctttctctctttcagcttgcaggtaagcgaatgaaagttttccctcccttccctatgccttctggatgtgtttcagtccctttgaatttcagacctgccttcattttagacactcttctgagtgctgaatgccacagtttgaagttcactgcatccccctcaaaaggcattaattccactcccaggttctttctctctgttggacaccaagggtctatgattttggaggagaatattttattatattaatgtatttacaatgccaagtattgtacaagtttagaaaggaagaagaagacaaaacactttcctaaaaaattgcttataacctgcagtattcaaagtcaagttttcattagaaacctttgaaatttgcattatagtataatttataaacatcaaaacaaaaagcttttttaagaaatttttttgagacagggtctcactctgtagcccaggctggagtacagtgacacaatcacggctcactgcagcctcaacctccccacctcaagctgtcgtcccaactcaacccccaagtagcttggactacaggtgcacacctgtagtccacctgtagtccagcaagggacgtcttacatggcaacaggcaagagagagcttgtgtaggggaactctcctttataaaaccatcagacatggttttatagcatggcaaagacctgcccccatgattcaattaactcccactgagtctctctcttatgacacatggaaattatgggagctacaattcaaaataagatttgggtggggacacagccaaaccgtgtaagatgccatacctcatgaaaaacaccagataatttttttgttggaattttagtagagacgaggcctcattatgttgcccaggctggtcttgaactcctgatctcacatgatcctcccagctcggcctttccaaagtgctggcattataagcatgagccaccattcctggccgaaagcattctttttttgtaaagtgatgtactttagatggtttggatcctctcttttactgtcatctattttccacatgctttctaatcccttgagacttaatatttaaaaatcctaattttagccaggccatgcataacagatctgtggaagaaactgcattgtgaaataagacctgtcaaagcaacaatatttaagggcagctttgatgtcaaattgaaggctggcattttagtttggaagtatattcatctattctttgacttcataaattatatttagactactagtggctacaataatgaaattactgtggattgtaaacatgaggtattgctactgtggtctaccatgtatccttaatcgactcagtttttaaattgctaaaattcaacctatttgactctgtcagaagagctttaatgttcttcatttgtgcaaactttgtttctgtcacccttgacaaatcctaatagggattaatttagttacgggtgacaggataagctgcaacggcaaccctgcattctgccatggatccaaactagttgtgagctctgtttttcttgctgcaggcagaaagtttgctgaatctacaatggacaccacaatgcctgactctcgtttccatctcttacttgttcttgtttaacataacctcgttcttgtgtggcccaatttaaaattatatattgtggaggtatttgcaattgcagtaataaatatgtgttctacacttttttaatcacttgccagtctgcattagccttttaattattaataaagtgaaatccattgatttcctccagttgttcgaacatgagtctgacctaatcctgcctcaggcttgaggggttctgagatgaacagcaaatccttgagctaaacattaattttgtgggatttaaacatagtactatttttttattcctaacagaagctatttctttgtcttttttcttctgaatttgcagaagtattatgaactttggtctgttccgtgttatacatacgaaacaaatcttgaacaaaacaagtttgtgatgccactaaaatttgacctttcttattattttgtgctgatattagaagttttatcattgatgctcataaaattgtaggttcagaagactgtaatcacattttaaatttaagttgagcaccagtcattactacatcatttttgtctttctgtgttaggaagagctctgttttcctggttatattttaaaccatatttaagaataaatttgcatttattgaaaattttcttaatgaaatctcattttctattttctttgtttattgatataatatcaattaacatatttttattctgtctgcctatagaaattgaataatgtatcaatttctcttctcaatgtccttttacctgcaaaggtgtggtaagcaggatgaaaggttgcttttgaacagaaatttatatttggtctgatttacctattttcttttggaaaaacacagtttagagctttagcagctggtgaacagcattaactaaaacttccggaagacaaagcatcataagtataaatggtctatctcattgtatatgctaaaatgttgtttttcaaggacagaagaaaagttacctatgataacagtaccacaaaatgactagcacagagtaagttacttatatatgtgaatgaattaactattatattttatatatagttaatagtatagtataattataatatatagtaatatataatatatttatactgaacatcaaacaatgtttaattataacaactactttgcaaagacaacttcacatagttcaggatattcatatttatataaagtttattaaagttattacattctgcacaggctgatccccaagtcatatattattagtcaacagtcattatttgctattcatatactagctgttgaatatttaactcaatcaatgtggttgtttcttacaatgaaatctggagttcttttcttacttaaaaaagattgcagaatattatatatatggtaatttattaaaatataaactagactttatcaaacttagagttaattgtaatatttacaattggaagctgagaaatggaagattacaagtgcttatttgaccaaacagtggcaacagattttgtttttatgtgtgcggcctctccttatagagtgaaccctcataactgcttctaatcccaaatctcagggaatttgtttccaacaccataacagtctttcaaaagcaacggtgattatagtaacttcaaagcggcaagcatctgtactttaagaagggccagtggaagctagcatccatcttccataaaaaagcaatcgtgcttttccctgctgccacttagaagagcttccttggggaccttgttagatgctttcatgtgaagaccatttgacccatttctgattagtgtgcaggttttcatggcagtggcttctgggagggagatgccgttggctggtcgcctccctattcttgaagtgaaaagaaaactctcagtggaatatattaaggataataaagggaagaaaaaattccagttaaaagactggtgaagtattgaactactattaaaaaaaactaatgaaaacgtatttctatactgactgttaagaagaaagcagagccagtatcacagttccttgttttgtgctcagatgagttttgcgtcttcatttctctttcttgcaatatttcagaaatatgtagtttgagaatgcaaagaataaatgactttagctcatttcacctttattttgtcagttttcttttacctgaatcatcatgtctacatttaaaataacagtaaacaagtctttataagtaacaggaaagataaccaagaatgcctgcattgttaatgctgtaataattgtcatcatagcttttttagcctcatttaccttacctatcttcactccaccaaattcactgtttcatatgatattcatatcagcaatactgttggtatcaagatatcgacaagcttctaaccgtactacattattttttaactttaatgccaattcttcactaataactattattcaatatagaattattttaagatcctgcttgcctaaataggcccagtatttctccatttctcatattaacagagtgtttacattcacagactcaaactatgaaggaaatgattccttagtagtttctcttgctatttgaattttatttgtatagatgcataacggaagagttcagagcgtaatgcagtatttgctattttctaccctccctcctccatataggattgccacagtctaatttcctattatgatagattgattttaatgtagtagattgcaaacactgtgttcaagcattcttatttttaatttctcctgcttcatccctttaaaaaccacagctgttactaggataacaaaaataatgttgaataactgcttacttttccgctttcccggaggggtgggggaacagcaggtagcatagcctcatccccaaacagatgttactttattaaaaattgagtgttttggagggagtagaaggagatttatgctttaggagagcagtgaaattagaaggagtcagaatatgatatggaccaattcagcttttaaattcaagctttgcttgtattttattgatagcattttaattgaattgtattttagatgtgtttggattaatcgaatgcccaaggtccagcctgatattaagtaattgctatcataattagtcaactcaacaagtttttctagactcttcatataaaattgcactggataagttctgtagtagatctaaatgtaatcgtgtatgatacaattcttcttttatgagagtttaactgataataacactttactaaattatttattaccagaatttttaagggaatttaatatgcgatgcatgatacattgctctttatttaaatgtatttcactatacatttgttggattacattttgcatagcgtcttgtatacttctttaaggcatgaatgagccatagctttgaaagtccttttgttttgttagagaattcagacctgcccccctttttttttaacttaattgtggaagcattctgaaatttcaactgctaggaaatcgttctgcaataacttaatctttttgatatccaaataaccaataaaattatatattttcaaatgagtttttaaaattatatccaagaaacttaaaaaaaaaaagaaaagcactagccattctcacttgcatccatccatccctgagttaaaattctgaggattattatctcacctcctatttggacctgctttctaggttactatttgtttctatatacaagattaagataaattatggtaatatgcatatttccaatgccattgaaacaaaggatttataatttgtagaaaaactagaaaaatcagtcaaaatttcaaaactaggcagtctgtaatacacttcaaataaatttatttctttctgtatttttcagttgtttctctttgaaataatcaaattattaaaagcattctaatcaccttgcaatcacaatgtagagacaaaagagtgaatacgtgaaacactgatcttcacaattattgtgaacttaagctgtcgtactcttgtagttactgtgaccatcagcaactgaggacaattatgcagaatcattaaattttagttatagtacttaattaaacacttgcaattttttgaaggtgttggtatctattaagttttttgtttctacaatgctaaatatcttctagacataatcatcatattagaccctgtcatggttagattgctgttattaaatgtctcagtcatgaaagtctgtcaactgccaatgaggatggagagttcaaatcttgcaattagtcagtcagcaaaagtacattcagttgtttttcttaatcttgtcagtgtcattttatatcattaggtaaaccaagaaaaggaaggcacttatgtgggcaatttattccgtgatactatgaacctataagtagaacaattattgtttttcatttgtgaggttaatagaaacttcatcctttgaggtccatagtaaaagcgaatgcattcagaaaactatgacacgtttagattaaatataaatatatgttaaaattttcagattacaaatacttaaaggatatttaaaggtgtcacatctgaatttcaggaaactgtgtgagtattacacatatcattagattatccagtttttccaagcaaatattcagtgttattgtagaaataagtcaagtttctggggaaaaaattgctctctcacccaaaagaaagtccgtctgttcatattcgggaactgtaggtaactaaaagtcttagtcagtgagactgatcatggcttgttcatttgttgcaccctaccaaaaaagagattctgtgaaatcaaactacatcaaaactttcacagtggaaactcctttatggtttctagaattctcattgtaaaccccttaaaccagccatacctgacagcaataatcagagatatttgtttctatagtgaagtagaaatgcatcctctagaacaatcccgtcttcatgagtcccatcataacatgtgctcttacctagaaggctctgtctctcttctggttggcagcccaggttggagatgaagccttgtaagtgtgaatgcgattagttactttcattaaaagatcctcagtaagaaacctcttgatgccctcctgtgtatttactagcatcatcacttggcaaaaatgtatatctttcttttggcaaatgtgtgtgtgtatgctatcttcctgtaaataagtgcctataaatgttcaatagtattcataaaatgttcattgcaacaaattggtgtataaattgcatttatctttttaatagttttctgaagaatttccatttacttagtgcaaactatataatttttgttttgtaaaatttctgaaatgttcttcctagctttgtactgagttctcaatttgtctgcaaaaccgtttatttactaaatattagtaattgatgctacttaaagaaaaattaggagcaacaaagaaaaagaagagacataaaaataaagataatttttaaaccactattaatcctagtacttaaatgaaatgtctttaacatttagatgtattgttttctgaacatgaggaataatataacacagagaacattataggtcttttagaatgtatgtattatattttatatatgaatgaaatacactaatattcactacaataatgagataactaggatcattttaaagccaattatatgagcttctgggtttaattgagctttagacatctaagtcttttgtaaactcttttgatgcaggaaaaccaaaagagaggatttcagggaacatgcgggagggagtgagttagtttggaatgttagcttggtggagagaagggagtgttagaactgatgaagcaggttgtgggaagccaagatgccaagctgaggagtttcttctttattttattaactttgccagtgatattgttttgttcttgaaacaatcagagagatacaatcagagagaaacagggagactgaatgtagtagaattctcattgtatattttgtgccatgtaaaattacttacatggaaaaaaatcatttcctttggtaaagggctttctcttgctcaggtttactgataacctggatttttactaggcctcttttttctttgtattttaatttattttttttagagacagtctcactctcccgccctggctggagtgtaatggcatgatcatggctcactgcaacctggatttcctgggctcaagtgatccttccatctcatcctccctagttgctgggactgcaggcatacatcacctcccccagctaatttttgtattttttttggtagagagcggggtttcaccatgttgtccaggctggtgttgaactcttgagccaaaatatccacctgcctcagcctcccaaagtgctgggactacaggcatgagctaccatgcctgaccattactagctatctttttaacttatttaaagtcaagtcttgtaaaatagcctggagttaatagaagttatttttttttccttctaaaagtgatacagtcaaggtcctgtttcagaaattagcaaaattggttattgtcttttagcagttggttccttatacaagcctttgagaattcctttgaaaagataaatcaaattgccaagtttgattttttaaaaatatattttccttctttcagttctcattagatatagatttcaagaaaatacttggggcagtaaatgattctagaaaggcacttaaaacagttaactactaaaatagcctatttacatgctttgagtgaatgataaagagaattaagtttatttttgtcacattaattcccttcatatctagagctctccagaaaagctctgcagataggatgcccaatgcacatattccttggtgacaagtagtcaggataagttttatggaagtttcctaggaatctttttttctttttacaatacttggcttagtaaatcaatatttttgtttgggtttctgtttaaatcacaattcagtacagcttcagccactgaatcaagatgtgaaatccatgtactgtggcacacatttcaaattgtgtgttttaaagcctcaatctaagcaaattctaaattcctatgttttttgaggatggaatggtaccttaatgaccataacatgtggttagaccatatatctagaagtaaattgatttaattggtcatgataaggacttatatagtacttaatggtaatagatatagagttcgtgcagtctccttagggttagaattcacatggtgcctgtgtatggatccagatctatgcataactagctagccaggaagcaagctatctctatcttttaaaaacatttacacctatctaaagtagaaacttgtattatctttggaaaactgaggccccagaaaccctaagtaacctgcctaactcacacagctctaggagtcatggtgattccactgaaacccatcagcttgacactatgatgcaggttgaaatctgcagtgcgttgccttgggctaggttaatctgcccagagaggtattttgctgtgagtggattgtataggaaaagggtttgtgtggccagacagcagagaggaaatggatgaggaggcagagaaaatgatgaagctagtaatgaaagcattgacattgattaaattccacttcttagaattgtcactgattaaccatgtagcttagcattttatttaaaaattttccttatttctggcccaggatgccatgagtccaaggatttaggctttaaaaatgatagggttagctcaaaaggaaatggataggttgtgaattatctgacttggtgaattctaatcagacaaacagagctattaaaatgtttcaataacttttagggcattttcaaaaattagtagttaatatttctgaatggtactgctttcttttctgtaggctttatcaactattgatcatgtgaaatcaaccgtggattcttctggagtcttttggggggccttttaaagtaaatcagacattggaacacatagttctaagaaggagccagtacgttcactttagacattagaaattatccaacacattcggttcgtttaagtgtataaccgtacaagtaattgttttaacatatttaatttccatatttgttttaattaagaaattgtgttcaactttttcttctgagtcacacttctttgattgtttttatgattgccttgtaatcgttcaagaatcccttttatattggttagtatggggctaattatgcattcgcgagtgagctaaatgcagatgtagttaattctcacatctactccatgaggtaggtattaagatcttcacttcagagacgaggaaaactgagatagagcctggttaagtgagttgttaaaattctatacctagtgagtggcaaagtttaattacaattcaatgtttttctactacaaaattgatcttgttaatcctattccttattctgttcgaagtcagttttaacattatgcatacaatttttgtgttcttttctacctttcctgggagggttcttgcaagaataaaaacatagggttgtgtggcatttccggattgtttccacgattcttggttatttcctccatagaagccatgaacatagaggatacaaaagcattgtagaaagaagtaaatctgtcaagaaatgtcatgcctttgtttagattacttcctcatcagtccttgcagtttattgaaaaatcctgctctgggtggattgactatgagcttacattttattttatttctgctggtcatgtactactgcagagttgtttgtatttaaaaaaaaaaaaactcaaagaggggatttcaatccttaaaaggcaagaggattttgtttatctttctagaattcatgcagtgttgaatccaagtctcttctttacagctatattttaaactttttcaaggcagggacagtgtatttttatgtgaattttcatatacgctagatgcaactcagaattttatgaaatgcttcttgaattagattttgcactgtacattttgaagactatcctacctctttaaacagggagatacagaagtaaacctattgggctggtaaaaagggtatgcacttgaaaacttggtggcctttagaaagcattgagatattggactgagcacatcaagggacatattctgtgaaatcgttacagtagccagctagtcagatatgagcagagcaggagagtaccctccccacaacacacacaccaggaatgtcaggcagccatcaggcgatggtcaggcatttgttaccggcttctttaaaataataattggttatatacccaataatgggattgctgggtcaaatggtatttatggttctagatccttgaggaatcaccacactgtcatccacaatggttgaactaatttacactcctaccaaaagtgtaaaagcattcctgtttctccacaatcctctccagcatctgtatatacccaaaggattagaaaccattctactataaagaaacatgcacacatatgtttattgcagcactattcacaatagtaaagacttgcaaccaacccaaatgcccatcaatgatagactggataaagaaaatgttgcatatatacaccatgaaatactatgcaaccatataaaaggatgagttcatgtcctttgcagggatatggatgaacctggaaaccattattctcagcaaactaacacaggaaaagaaaaccagaaatcaaacaccacatgttctcactcttaagtggggattgaataatgataacacatggacacagggaggggaacatcacacaccggggcctgtctggagtggggtctaggggagggatagcattaggagaaatacctaatgtaggtgataggttgatgggtgcaacaaaccacaatggcacgtgtatacctatgtaacaaaactgcatattctgcacgtgtgtcccagaacttaaagtataataaaaaaaattaaaaataaaataaaataataattggttgcagcccatgtcagggaaaggcaatctcccagtaaacagaaacacctgaaaccggtgatcagaaacttctgaatatctcaggagttgggtgaatgggctcaactatgtgcactaaaaggcaaaatggcagagtttaactggtatatgaccttctatggacatttgactgttaacggaagaatgcctcaagtgagcgtgtgtacaactccagtaaacacagtgcacacgctcccctcccaagtgctagcaggccactgtgcatgagggcagcccaccatagggaagaatcaggagagaagggatgcaaggcctcagaagtacgccggcacacgaaatcctgagttaaaaggtcaaaccacgcacttgatctcccaagtcgcccacttggccctcttacaagtgtactttactttctttcattcctgctctaaaggtttctaataaacttttactcctactctaaagcttccctgagactctccttctgccttatgcccctcagttgaattcctatttctgaggaggcaagaattgaggttgctacagacccgtacagatacattccaccaccaggaacagaattagtaagcaatgatagaccaaacatttttcaattaattaattagttaattataactgacaaaattatgtatttgtggtgtaccacatgttttaaaatatatatacatgtggaatggctaaaccaagctagttaacatgtgcattgtctcacatatttatcatttctttatggtgagaacacttaaaatctactttcagcgatgttcaagtgtacaatacattaactatggtcactatactgtacaacccatctattgaacttattcttctatctagctaaaattttgaaacctctgaccaacatttccccaatttctctcacaccccagcttctgttaaccaccattctactctctgcatctatgacttccactgtttagagtccatgtgtaagtgagatcacacagcatttgtctttctgagtctggcttctttcacttaacctaatggtctccagattcatccatgctgccatgaatgacaggatgcccttgttttttaaagtctgaatagttatttcagtgtgtgtgtgtgtgtgtgtgtgtgtgtgtgtgtgtgtgtgtgtatttttttttttatccattcatttattaacatttaggttgattctttatcttggttattgtgaataatgctgcaatgaacattagagtgcagatatctctttggtatagtgattttgtgattttgtttccttttaaatatatacccagtcatgggattgttggatcatatggaacatttctatgtaccaaacatttcaatggagtaataaatcaagatgaaaaaagtggagtttgaatcagaccaatggagagagttttttttttaagttggcactctgttctcaagcctgaattgcttggaataggtcacttttccaaattggcactaggctcgaaaatggttggttttcaagttggcatttgctgaaataaaacactagcaccagcatccagttaaaggtacacaaataccatagttattttttattatgaggaaagaattggggaataataattcctcataacactgaggctgcaaaaatgttatatgacagtctctatatataataactcatggattcttggtttttaaataagcatagggcatggggaaattattaaaatagagcaaagccttatggaatataatatctcatgtgtaagtttatgtacacagcccctctatataaacattaagtgtgtgtgtatttgtaggatgtaaggaggcaaaatcatctcttagttgtgtttatatgaaacagataatttcatgattacattttttcttctgtgtcacttgcagtatgtcttctaacagttgttggacaactagctcagacattttaagagcctacagatgtcattattaaacttagtaatcagtctagaaataaacacacaaataacaaaggatcataaaggtcagcagtatggcaaggcataaacatggaattctagaacttgtttttattatgaaaagatgtattttgcagttcaaagcatgtcattctttgcatatgttcaactgaaatatgaaagaaggaaaattccctccaaatgactaaggtaacgttttacaggggacatatggatattcttagaatttaatgggggataggggaacttacctggaatcaattataggaaatttggcaaaatggaagtaaaatattcatttgctttgcttgttataattacgtttgttataagctttttaaaaatccaaaagaataaaatgaaagtaatttcaatcaatgggaattaattgtgttcaaataatagcatgacaaaagagacattggaactgattttgaataatagatttcaatatgtgctgagtaaagctctagggctgatgtcttctcttgtctgaaattttctaatactctccccaactgatgttgtttctcccatgtcttgtgttccttgaacatgcacttccctgaaagcaaaaatcacagaattgtttgtttacctacctatcccacgagactatgagtttcttggaagcagtgatctctcttacaaaacacttttggatcttcagttatttttaacacatcatgaacttcctatttcatgtatagtattgctagctcagggctgagagagcacaataaaggatgaataagaacttacaactaaatggacaaataaataaatgagtgaatatgatagtgtatgaatgttgcactgatatttacttattttgatttgatacatttcattgtaaacagtaaaaatgtagagaatattcttctctgtaaaaataaaatagtattttagagctttctttgtaaaatatatgtaatttatttaaacattacagatgtatttgattcaccaaaaaattaaaaatatcatagtaccattcatatctatcttcatattctaattatgattaagttttaaatagcagttatgtctttaaagtgaatgtgtgttatgttctgccctaaatataacttaacattgcaggtagaactctagtgtttgaaaatgtttagaagtcagaattgcaattactgagtgtgggataaatattagctataaatataattatgtataaatataatgaatataaatattagttataaaaagtataagcctcttccaactcttaatgtttataagtctactaaaaaattaaagatttctaatagtttaggagttgggagggaaaaaggaaaaaccacaaacaatgatgttggaatgcaagaaatataatttgatagtgcagaggtgagcaaaaaggtctgttgggccaaattcagcaaaattcaatgcagaaaatatttactatctgacccattgaagaaaatgtttgctgatccctgtatgtcatgaaaagataaacgtgaatttgatttgaatggcaaaaagtagaggtatgaagtaaaatgcatatagtccaaaatgtatatagtctccacagagccataaagatactccctgagactgcacaatttataaagaaaggaggtttaattgactcacagttctgcatggctgtggaggcctcaggaaacttacagtcatggcagaaggtgaagggaaagcaaggcacagccttacatggctgcaggcaagagaggaagcgaaggggaagagcttcttcaaaagcactttaaaagcatcagctctcctgagaactcactcactcactgtcatgagacgagcatgggggaaaccacccccataatccggtcacctcccagcatgtcccttccttgatatatgggattataattcgagatgagatttgggtggggacacagagtcaaaccatatcatagggatttctccagaatatttgtgttgtgatgctatcttacgtacttatttttaccttttaaataaaaattggagtgaaaatggcagagtcagaaattaatggatcaattatttttttgtttgtatcaaagtttgagataataaagataaatattttatcaacatggccttattaatactgtatattcaatgcaaaaggagtgctgactggaaaacaatttcaattagtaatacttattaattggatgctaagcctaattctgtccttgttttattttttttcccaagatattaaaatatatttacctataagttgaaaagtaaaaatatgactgcaggtggctcattttgttttcacatattttgaaagttctaggctatggtgcccctttttgtccccacttcatgctttcccatttctcggagacaagtcacaatttctaactatttttgctctttgaattattttatgcttctttgtagcaatgtgaggcttggaagaaaatgtacagtacatgactttctcaaagtttacattttaaatttaacacattggaccttgcatttcgagttcaggttgcactaatgagatttctttatgagcaaagacaggagaaatgtttaacgtttttaatagctgtaactctttttatatatagatatagggtcttgctatgtttcccaggctggtcttaaactcctgggctcaagcaaacctgctgccttggcctcccaaagtgctggaattacaagagtgaaccacccaggcaataattcttttttatgtttgtggatatatatctatcctaagtgacaaaggaatggacagtattcacattgcctcatgctttcaaagaatatatggtgcagggacatctagaaaatgggcttttggtggattaaaagaaagtcatgagtgggttggccaaatgatttctaaaaaaaaatcaactctagagtagttttctctaagccttttagaatcgtttctttagatatttatatgatcttataaacaaatatcataaaattatggttccaatttactgacacattgccttgctggaaatgtggtttcatgccaagaacaaatatgaaaaatgtagcaaagctaattacagtacaacatgtgtccatcatttgatcttttggaggagttaagggaaattcaaaagaaaaattatcatgtgcaaataaagagagcttagctatcttgcctactggcctaaggtttctccatcactcctgcagcgtttactttatgtatcaggagttaattaaggtgaaacatgaggtaattagggctaatcctcccagcctcctgctggcttgttgcctcccaggctattgcctaaaccaaactatgttcgcagttttaaaaaataatgctcgtgtttattttagacattactcttaacttttaaagttgccttattcattttaaataggactttccatggaaaaagtataaagaatgatcaaactttagttttgatttaaaaagtaaaacaagactcattaatatataggtggtcattgacagaattgtaagtttacacttgttcactttacgtgttactaacagatttaataaaatttgcattagtataaatctttagctttgattatgctggaaaggtgcatgcacttcccaagaaaataatatttcttatacagatttctcaatatattatgcatttggatgtgtatcagggtaattggagggaggatcagagaacaaaaacaaaaaaaaaaataaacaaacaaaaaaaccttccatgaactgcatttaggtattttatctttgaggaacattctaacttttagatttcactaaatagatctggtaagtagtgactgatttattctccttaaaataaatacatcgcttgtgtcaaatatttttaattccacactaaattgtttgtgcgtgtgtatgtgtcgtttatattttcactttttcaatgaaagtaaagaataaaaaggttttctatccttgttgtttctctaagttgaaataaaagcatgtgcttttttattaccctagtcttataatttaccaatcataatagaatctgtactcttgccaaagacatttcattaggatgtgaagactttagaattgacaccccctcacatattaattaaaaagcaaattgcaggtaagcagtcatgacatttataaaagggggaacttacatgggtaaaatctcttttgttgttttttataatatactatcaggactgggactaataattctattataaatttgatttggggagatgtttgttttcccaattgctatcaaaatttgacttttatttagcctacattgacttcttctgttccatctttttatttatttgtctgttttattatttttttagagacagggtttcactctgtggcacagtctggattgcagtggcttgatgatagctggctgcagcctcccttaatctcctgggatcaagggatcttcctgcctcagcctcttgcatagctggggctacaggcattcaccactgtggctggctaattttttaagttttaaaattttttatagaggtaggtccttgctttgttgcccaggctagtctcaaactcatggcttcaagtgatcctcttgcctcgtcctcccaaagtgctgaaattacaggtgtgagccatcatacctggaatccatcttttatatgtactcttaaaagaattgtttatgctagcatcttgaaatacatacatatatatatgtatatatatatatatatatagtcttttactgaggttaaaatcatttttttgcagagtaaaccagtaaagattgcagaacaattatattgcaacaagttgctaattcatagtttctgcttgagactctaaagcagttaatatttacattgttagatgtgtggccaaatcatgaacttttatttagtaggcgatttcataacctccaaatgtctgaatcttactctttttgtattgtattgaggaaaaaaatgatcattttgattctataggctttaaaattaaatcaaactctaggtagcattgtttgggttatttagtgaatttaatgttgattctttaaaaatagaagtggggcttttctcctgcaaaattgccaagagagcatttgcaccatggcatttaagaatatatcagttgagattttctattgatcccagctggggggatgagtgccccgagagaatacatgcgccggctttatgagggtccctgtcatcaaggatttagctgtttcatttacagattcctgtaaatgttcaccagatccatgaccagtaattttcactggagaaggactggaccgtgggtaagcaaatgactctttgtcattaatggtttcaagtagcattaaaaatgttctggcagctcagttgattttgatgaagctatgaagcccaactgcaatgtgtatctagctcatatttccaattataagaccaaggaaagaatcaaagtgaataatatgtaacgtacacacatacacacacaccctaattttgattacatagcttttcctgtatagagatttaacttgaagtctacagatgttcacatttagcacagcacaataaaaatacaagtaaaacagaaactactttttatgtaattaaatttatatctgctaatgttcacttccttaattgggttatctcctaagtgatcagtaaattgcatgcaataactaatttacatgcctccttagacactgtagctgcctgatgatttgaaaagtataagtacccacaagtgtaccaaaattcattttgaattaacagtgaataaagaaatcttcaaaaattcttgagacatgacagataaatgagttaacacatctctctgtggaatctgtttctatgtatcaaaactttttagttcatgttactgtttaaatgacctcccattaatgtaagcctgtcatttataaaaatattattattattgtttctaaatttcacttagagatgccttagaaaaatctatagctaattttcttcgcctgtattgcttctagtatgggctgactcacagagatgctgcattacacacaacaaagtgttccataatttgcaatatcctctcctcctccttccccttctccctcttctttcctcctcctcctcttcctcctcttcctcctcctcctcttcctcctcctcttcttcctcctcttcttcctcctcttcttcctcctcctcttcctcctcctcctcttcctcctcctcctcttcctccttcttctcctcctcttcctcctgctcctctttctcctcctcttcttcctcctcctcttcctcctcctcctcttcctcctcctcttcctcctcctcctcctcttcctcctcctcctcttcctcctccttttcctcctcctcttcctcctcctcctcttcctcttcctcctcctcctccccctccctctcctcctccttcttctccttcttcttcttgtcactctgtcatcccaggctggagtgcagtggtgtgatcatagctagctgcagtcttaaactcctgggctcaagggatcctcctgcctcaacctcccgagtagctgggaccataggtatgcatcaccactcccagctgtttttaaaaatgttttgcagagatgaggtcttgctattttgcccagctgttctcaaattcctgggctcagaccatcctcctcccacctcagcttccccaaaatgctgatattacaggcatgagctaccacaaacagcttgtaatctgtaatctcttataagcacagagcagaaataaaaatggcatcatttttaggttctcctaactcttcttgcccattcttcactgtctgcccaggaacaaagtcctgctcttgagtccacaattatccaagtaattctaaaggtcttctcatacatgcctggtgagggcataaattaatgaaacctttattgaggacaacttagcaatatttattaaaattaaaaatgcttgaagccttcaacccagcaattccactgctgtaaatctatatttcagataaatttgtgtatgtgaaaaatggcattatatgtgtcaacttttgcattatggcattgttttaaatcgtgaaagatttcaacctaagaaggatgaagtcagcaggggacttgctaagtaagttatggtgcagcttgttttgagccataataaaagaatgaggaagtccttcacaccttgctacggtaaagttaccaacacactttattaagcaagaagaataaaggtggtaaattgaacttctccattttaaataatttgtgtaaaaatggagaaatgaatatatacacatgtatatgtatatttatgcatattagcttatatgtgtgtaaactctatctggaaggacggacataaaagaaattaatcatactggctgtttatggggaggagaactggacaaagctaaaggagacaggtatgagcatggcatttttctttaaccactttaaataatgtttttatatcgttaagacattaaaaatattctcatcctttattgtttccttcccaacctgacatcccatgttcaaatgttcaaattacatttttcctcttcccctcttttaaatttccattttagtgctgtcaattttagttggctattagaaaaacaacccaaattcatattaatgtgtaggtgactcatagcctcagaccttccaggcgtgttttctatttagaagaggagagttattaacttgcatggaattctaactcgttaaataccaggcggttctaaaagtaccccaggcagtgcttgcacgatcatttgattaaagtgaggacagcaagccaaagacatctgtaggttctttaatccacatccctgacaaaaggacaaagcagtcactgccactcacaccaagattctacccagaggtggatgcccagagggcttccaaggaagttgcatgctggaaaactccaagtacagatgggacagagctgctgagctctaagccagtatatctaagtgtggttatcacacatgtggcaaaagacatataacacatggcatatgcttcatgatggaatgtttgttaaaaagaaagactctagagcccctctgtcctcaagatctactgaaggcactgtataaaagagccctagtttgagcactgctgtctgtcatgaattcgcttcatctgctacttttctgatttcagtaactggggacagtgggatctcaatcagaaaggatttgctcctggaacacccaaggcttgggcaatctctgagcagccaagcccagtgttctctgagttcaaagatctgaaagtctttgcaaagaccttagagacccatcctgccaagactgatcccaaaaatgctttcctaatccatttcctgaggctctctgctcactagggcccaaccccacacttcctgttttatagggatagttagcctctgccctggggcactgggctggtccatgtgttcctttcctaccctagctaatgtcttttgacatttggggatgcgtcagtgctgcagattctttaaactctattcatttattttaaaaaaatacttaataagggctgggcacagtggctcatgcctgtaatcccagcgctttgggagcctgaggcaggagggtagcttgggtccagccagcctgggcaatatagcacaacccccatctctacaacacaaataaaaataataaaaatatctagtgagtacaggctttgggaccagtactcttttgggccctggggattctgaaaggaacaaaagagaccaaaatcagtccttttgggaagtagatatataatagacaataaacaaggcaaataaagaaaacataattgttttaggatgaaactctaaggtttgggggtaaaaaagaaaaaaaaagtatgtaggaatggggagtggggacagaaaatgttctagaaagaggaaagaggaagtgcaaaggcttaaatttacgaaaagcgaggagttccatgtgagtggaacagcctgggtgggataaatcctgcaaatttgaatgaggtgaactgagagccatgagcaggggccaggtcatggagtctctttgggaactttggctttgatgctaagcgagacaggaatccattgaaaggtttgcgttttgttttgttttgaagaagaatcaacatgatctgacttactgaaatgatcttgatgttcagttgagaatttcccacatggtgacaaggcctgaaatacagagctccgttacagtaacgtaggtgagagttaaccaggtggaatcagcggagaggttaagaagtaattagaatatggtgtattttcaaatcaaaaccgtgaggattccatcactctatgtgaggatataaaggaagaacgagagtcaaggacgactccactttgttggcctaactggaagaacagaattgccacttactaagatggaaagactggagagagatgcaaatgttaatggacaagtaaaatgtggcaggtcaatctgacaactaaaaatggagctgtaatgtaggcagttggatgcatgagtccaaggaagagatatggcttcaacatataaatttagaatctttgtgtacatgtagtaatttaagtcatgatatttgataagtctacagatggagtctgtggaggcataagagatcccaagactgagctttggatcagttcatttttaaagattaagaagatggagaggacccagcagaggagactgagaaaaaaagaaaaaaagaaaaaccgtagctagtaggcagaaaaccaaatgagtgtcttattctgttggccaaatgaactaaatatttaaagatagaatgctcaactgtgtcagatgctacttaaggtcacagaagacaagtaacaagaactgaccgttggaaacagcaatgtggagattatgggccacctttataaaagcaattttcctggagtggtacaaggaaagtctctattgcaggaggttcaacagagaatgagagaagagactgtggagatagcaggtaatgataccacactagtgtcctgcagtacggggaagaaggaaaatgaggaatatatggagagaaatgtggatataacaggttttgtttttaaaacaggataaggaaaagcgtgtccatatgcttgtgggaatcatctagttaagttagaaaaattaatgatacagcagagagggggaaaattgctgaagcaaagtacttgagcagacaaaacaagacgggagctaggcacaagtgtagaagtgactgtaatgtaggcacatagacagattatcattattatgagagaagggagataatgggtgaaggaggtagataagcccagatatttggtctttgtagtgtgcagtccatgatgcattcattatttcacattaatgtttggaaaataagtgggaaccctggcatacattgtttggtaaagaaacaatgaattatgctgaaagagaacagatttccagacagtgttgttggagtctttatccattgcatatggctcctgttagagtcaatttatataaatagagaattccttttccagtcttgtttaatttaagcaatgaagtattgagtgctcctgaagattattaagactccacccctgccttcaggaagctgcccatctggtggaatgagccctaagatattttgaggactgctcactccacccatgatcccacaacaggaaagaatatttaacattagggacatccaggaatattcaggacatatgtttgccattactgtaattagtgtcagttgtttgtaagtgcagaaatagggaaataaacagtgttacaggagaacagaagagcaaatgctcaactttgtctgggaggtgtagagaagcaatgttaaggcattgaaacttactgaaatagaagaagagacaggagttaagcctggacaggtagattagggtcatattgaatgaataattgttctaaggggtatgaatatttttctataaacatcaatggtgacgttaagtatgtctgtgttttggagagaaatgtagtagctgtatggagcagaggctggccataattgaaggttgaaaaccattgtgtgtcctctgcaatagtccaggctaaatataataaggaagtgacaatgacacagggcgctttcagctccacttcaccagccagaaatctctgtggccagctgtgcccctgcccaggcttcactcggctctgggctcgccactgggctcattccacccacttggcccagtgggctgcactcagcttgcactaccaacccagggtagggcacaggtctttgcactcagtggctgagctgggtgtgggcagtttttgctttgggcaccagcatctagataaggggaacccagtggcatcggaaaactcagagatgccggtaaccacagagacctaggggttttatggctctttcccagggagtccccaggtttgagcccccaagaaatgttacatcatttctgctgcccgcagtgcagcaaacaggagggcatattacagcttattcatgttacagcttgttcgttcctgcagcccatagctcagcaaatgggggcatgttgtgcccagaggctttttctccacattgcttggtgaatgagagggagggttacagtgttacagctctttttgtacctactgtttggtgggttccgtgttcttgtcccacaaccaagaaggatgagattgcacagacattggagagtggacaaggcagggaagaattttattgagtgagagtaaagttcttgacaataagaggggagcccaagttggtggccctttgtgtgagggggagggcccgaaagtgggtatcccaatgtgtgcctgagtctggggtttttatgggctcagaatgagagagtgcatgctgattggtccatggtgggcctggagaatgcaccatttaattggctaaaggccttaaggaagttcttactctggtagtggactcccctcagaactggaagttcagttttcaggctttaagctgtctttggcttgaggttggatttcaccagagacctgtccctttctgcccagaaatttatctgccgtggcctggagcagtggctcatgcctgtaatcccagcactttaggagactgaagcgggtggatcacagggtcatgagtttgagaacagcatggccaagatggtgaaacaccatcactactaaaaatacaaaaatcagccaggtgcagtggcaggtgcctgtaatcccagctactcaggaggctgaggcaggagaatcacttgaaaccaggaggcagaggttgcagtgagccaagatcatgccactgcactctagcatgggtgacagagcaagattccatctcaaaaaaaaaaaaaaaaaaaaagaaaggaaatttatctgcctcctgctgctatcaacaagggcaataaatgttgaaaggagggagtacatctcattaagtttttaagcagggctttgacacgtatttagaaaataagagaaaaaataactgactatgaggttgctgtttggggtaaaagttacattttgatttcatttgtcaagatgtagattgccgaggatgagacagatttggtcagaaggtgagcaagcataatgagttcattatgtacatgttgaatattaggtaattttaagctactctaaagtctaggatttgtttctttgacatgtttcctgtcttttaatgaacgttgaatctataatcagaactcaacaaaagaaaactcaggaaaactagcaatatttaggtgcaatttcatgtgagggacattgactgctaaaggacaaattcattacatccctagcaaaatcaagggtttccattattttaatgcagggtagcagggtaaccactttttttttttttttttggcttaaaataatttttgtaagttacaagatgggccagacatactttactttcttttcttgttatatattcacaggcaatcaatcctttgataaagaaaaaataaaagtttagaaggatggttaggaggatgtgattaagtaatacagcataaagaaaaggattaatttacttgaagatacccttttctttcatatatgcccagtggaaaatgataatagttttaagatttccaagaacttcaataaaatatatgtaataaatgcatcaagcttcttattgcattgtctcagtcattaattatacaccaaaaccatttaatgtcagaatagaatgcttacttgaccaatccacaaaaactccattgatttgtaccactttagtctatggattcaatatactgtaaaaactttaaaaatcagtaaacttattttttaacaaactaaagaacactatgaaatgctatgatgttttctcattacactgtcatagtgttcttgtactcagcaatgttatcaatgacatagattatcatatgaatgtattatcatctttattgtgagattatgtatatttaatgcaatgcttttttctggaaagttaaacctaaatttaatatataattatggccaatatattaattcctttaaggtatttaaaattttctcatgttacatattttttaaagtttccttttttaagttcttatatttttattaggtgaatgactttattattgactaaagtctctgacagcagataaaaggaggaataaatgaatgaatatacaaactgaacaattaaataagccttgttgctacctcaagtgatttcttaaaaaaatcttgctttcagcaatgttagtagcccactgaaagtaacatccttatattttttttacctacagaaaagtatgtgaaaaagtcacagcagcctttttggtgcttcttgtttttcttcaaattgatatcaactgtgtttagcatggataggtactttgcttgagcaaaagttttcttagtatttctaaattagcttctcctcattttttggaggatattcttatcatcatattgactctgcaacatattagatgcatccattttccaaatcgtgtacatttttattgcggttataaatggtaatcttttaaattgtaaggtttttaaattaatcatggctcaatttaccaaagacattataaaatggactaaatttgctggatcttataatttatgatttgttcttttactttcatttatattttctcattttctttctttttcccttggagattcactatctcaaatattgtgtaacaccaaatctctttaagagccacaaagaaaagtattgtgattcatacattcatatgacagatcgcttacccaaatctccattttactaggagttatgagatgtagaaagtaaaggcctaacctgccttttccaagaactagtaatatgatggagagagacatttaaagtacagtacaagagagaatacagtatttgttgctgtagaatttttaaaaactataaactatgggagcacctagaaaaaattgttaaggagtgttaaaagcctcgttgaagttggcacttctctcacactgcagattatgaaggaagacctattcatatgggcaaaagggatggttgcaatcaggagaaaggaataatggtttgtttcctagagctaccattaaaaattagcataaattgggtggcttaaaacaaatgtattccttcttcattcaagaggccagaagtcagaaatcaaggtttggttctttctggagactctgagggagtaactgtcccaggcctactcttgaaaaataatagtttctcactattgtttcaatttattttagaagcagagagacagattctataaaggcccaaggcaacataaactcctatgtctggtttaagtaatgtcctatcatagaaaacgttaaatcatactttgtcagctcacagagatacattgacctatctaatagaataataataaatgttattagcaataaccgtcatgtattgaacatagttaagcgtttcacatgtatatctcatttaatcatcaccttaatggtagtactagcatgctctaggtagagataagaaaactgaggcctaaagagagttatctataaacatttgcttgtgataagcagaataataataaaacaaattgaacatgaggacatatattactatgaaaactgaaaaaagaaggagaggtggcacatgagcataaatatgaaatgatagtgcaatgacagaggaaatggaactctgtgtggtgtgatcaacttaattttcagcactttctgcttctgccttctgcagcaaaactcattacacaatataaaaatattatgtgctacttactatgagagtaaatattaaggctatagtacacattgctttgaaaccttgcatttgaggattgaaagctttatctcacaaagtagaagttaatataaactgccattataagtaaatggatatttgttaaaaagcaaacaaactgaagaacttctcaaaaatgaatttatttctaagctagaaaagcctaatatttttgaggtgcttcacaaggctgatatttttcaagtatgaccaccatagtgtattcctgaaaataggtgtcataggaataggtaaaagtgaagattactctgctcaacaccatgccttctgaatcgaagtttcaggaaacaaactgaggcaatttgcattataaatgaacatccagggtaattgtttaataccaaatacctgagaaccattggtgtaggtttaatgtgagtattcataacattccccccaacattaaaaaaaaattctttaatttttaactttaagaaatgacttcagtaagatggaagagatggtcataaaatgaaagggtgttctcagtctacagtggttccatgaattttcatttcaaaggagttgtattaagtaaatatttaaggtaactattttacagatgacttttttttttttaaatcaaataaatatgtttggaaaagccatgacctatttgtaaattcttttctaaaaagcctgaatgtgtgtatgcatatggtatatatggtcgtgtatcataaaataaaatgaaataaaataaggtagatattgggctttctcttgctggtcagaaaaaagccttcccatttcaagggactggctctaccaatcaggccaaatttcctgggcacacatccttctgggagtggttgctctctttactttccatttagcagctgtacagttgggaaatgttcaacagaatgaaagccacctgctcctctaatgatttcagccaaacagacaggattgaaggtttaccaaatgtgttgtctgtcactctgactctgctcaaaaaagtaaatcaaactggtcagatattcatatagaaaatgtgtcattagttaactcctggagtgcctgaagctcctttcaggctaccagactctgctgatttggagatgcctttttaaaatgaagaatggaagtgatttgaagagacaaatttggaaaatgaggcattctagaatgtttcccttatcaaatgctatatcattgcactctataaaatgagtagatttatgcacatttttccccacattgacagtttgattttagtatgtgattatatgttcccaatccgactaattaaatgtcaaattcccataagtttccaactcaccccttcttccagctcagtctctctgtattccctgaaaattgtctacaagaaagtatagtatggaagggaaaaccatcatagtctttcctatcacactggaaaaatcacattagaagtggaaattggcctccaccttctctggcagtttgggcacgctctttaatccttctgtgccttaggtttttaatctgtaaagtagaattattttatacattagatgtgtctggaaatgtcacaggacatttgttttcctgaataaatgttcagtattatgtggttttttaaatgttattttgagatacttttgttttatatggttatcccattaatatttacatcacgacaaatatccagagaagtttcattttatgtattttgttttactacaatctgatcgtgtataacattttttttctatggccatcttcaaccttatgttgtcaatattggttaacagagggtgatgcagcttcagtataaatttgtttgtgtaagtatttctgtaatctcaagggattaatgcttcataagaattagctcatataacgccatagaaataagtagagaaaaagcccacaaacttttgttgaataatttcaggaaaattctttatgggtgcacttttttgttggatcacagagctttagtcatcgaaagcattgaactagtgagcatcctcagcatcctcagtgagcataatagtgttaaaaactccataaacatgttaattgaagtagattttgaaaaagggaaaatgataagcagatagatatagaaaaataaaaatgggtaaataacatttatcagtaatccattggttatctttttttcaaaaggcatggtagaaattttattataatgaacaaataaattatatcagcctgaaataattttaagtttaaaaaacaagatctgctgtctaaaaatgttatttccttttacacattaaaatgttattaatttagactcctctaatttagagttcctcaaaatttattcaaatgaattagaaataatatcatgaaaaattagattcatgtgctgatttgtattcttgcatttaatgggcactttgctttatactcttctggcaattttgaatgctgaggcagcacactagaaaacgccaacatcggcagattagtgcaaaagtcaagaagccatttacctaattgctgtgtcagtctaactgcacaagcatcccactcggttttatggaactgtacctgaaggcgaaatcaagttggtgtagaataagacaggggattagcggttccttttgacattttatgcctttcatttccctcctgtgctcactgtatcttctggtgtccagggaatcttgcttagaaatggacatgaaggctaagcaggcatttatagctaatatgtacttttctactcctccatatcattatttcatggttatctttgcatcccagacggctcctggtacaaattgttgcacaaggtgggccttcaagacaccatttttaaaaacgtctttgccacgtcctcctgagatatgactctggaatcaatctgttcctaaactagtgtttcataaattagagtcagctcaatgatatcgaaccacagattcattcaaatagaactgcatttcaggcatggatttacaaatgattatcttaatattttcttgcaaaacatagctaatgtgttctttacatttatttgacctcccctggttggattgttctgtctttattgcttcagcatgcaacattgcctggacactcacagtgatttgcacctattttttatggatgtgtcagcctatgattatataattatatgactttttataaaagcgtagaaggcatagaaaataatgtgccctcattttatgaatactcaagtaccctttaaataaaacactttactcacttttagagatgatatgccactggaaagcaatcatttggtcttttatgtaaattactatttttcattgtttaccaattcccttatggcccatatgtagtgtaactatattttctatggcagtcagagttatacaatctagaagttaagtgattaataaagcagatttcctgggatcagatgcagtataatgctgtgctaatataaataactattttttccccacattactcattggaccaaaagcatcaaaatatattttatgtaaatgaggaccctacacttttcaccagcttatgaagcaacatttctttaatcttaccgtttagtttctaatatgcttttcagataaatttctttaaaagactagatgaattactatgtcatattaattgcatatttgttgtgtagttggtatgttcaattcagtgacattattttataagaagtagacctttcctgccatgagctttcaaagtagttgcagaatttcccatgaatgtgaaatacagaatgacaaatactgtaagtaaacatttaaaataaacaattattaaggttatactaggttgaaatgtatgaaattgccagttttcaactgttttgaccaaatataacctcatacaattgtattataattttacataatattttattcttcctcaattctgtgcctttgttcttcctggtttttctacttagaatgtccctccccacttttttctgacaggaacacttacttttcatctgtatggtctcacctggaacactatatgtgcccagcatttttgctgatattcacaagaagacttaagcactaccactactgattatacagattttacatttaaaataattcaatgtgtggacattttatcatatgtgatttcataaacccctaactccaccctggtgcttcctaaaacataattctcccagggtaacgttatgacttactgtgtccttcaggctagatgtcataatgtatttgtatctatagagcttattaacatgattggcatataacagtaggtaaattcagtgctgactgaatgaatatgttattctattaataattcagtaactttttttctttgaactgggaaaaatcttggagagtttctacttctttccccttattttataaatgagaatactgatgctcagaaaaataccttgatattgctctttaagagtggagttaaagctgatacagcacgagcaaaatactaaaaatcatctaaaattatatatgtgacaatttgcacagatattaaaccagagaaatagtaactctgggataactctagacaatgacaatcagagaaggtgttgtagaagaactgggatttaaaatgaattttaaaggacgggtagaatttggacaggcagaggaaatgggagaatgtgagtaggatggtatgagtaaagcattgacagaggaagacctaaaatgtgcttagaagagtgagcaaacagaatgttaatcaatgattgttctgatgtctttacaaagtatatgcttttacccaggggatatatacttgttggctttcttattttgatataagatacaatatatgtgaaattctggagactattcctttgagattgaaaagcgagtgatactttgtcaaagtgttctgtattacaagttagaataggattgaaaattaaatataatccaaaccttgaaacttggcttaaacataaatatatttctaatttactgaagcaactaggcttccacaatttgtaatgtaaaggttcttttcttttttttgttggttttatccccatgaaattgtttccatcaatttgagaaaatactgaggtttcttagtttggttcttttttgtatatgaacactgcgtgcccgtgtatgcgtgtgaagtcacaaagagaagggttggaggggagagttggaggaaacaaacatccccttgtcaatgtagtttagggttttcagctccttccatgaacctttgcacagtatgacatctacaggttatagatggttttctttctgtatttggtgttggctctaaaatcctccttagaaaaggcaacacaagtatcccttcccgattaatgtgaattggaacaaaaggtataaataccatagataaagagagatacatatatatgacgtagtatttgagtgagataaactcttacccatggctaatatttgagtgaaaggcaaattggtaaatattttctctattgaattatttttaaatcacttgagaatcatctgttgagttctcactacgtgcccagcagtgtgctagttgtcagggatgcaatggcaagaaaaaaaaaaaaaaaagacttgaatggtctttgctcttatggagctttgaactagtaaggagatatataataattacagaacaaatatacacattgcaaattgctggaagtatgttaagaaaagcaaacagatgatgtggtaaaaagcagtttggtctgttagaatttgagtaaaattaaaagaaaaaacatagcttgagatggtgtcctcttttggaggtggccaaagatgttctttctaagggggtgatacataaacttagagccaaggtgaaagatgaagtcacccatactccataaaagacagggacaaagtgctaagcagggaggtggaactgtatatgcagtggtactgcagtgagaggaactgggaaggagtgagggtgaagactgggtatgaggaggatggggtgatcaggaatagtcaggtcatgcaaagatgtgcagaccatgctaacgacttcaatatgactctttttttttttttttgatggagtctctctgtgtcgcccaggctggaatgcagtggcatgatctcggctcactgcatcctccactcctgggttcacgccattctcctgcctcagcttctcgagtagctggaattacaggcattcgacactacacccagctaatttttgtattttagtagagacagggtttcaccatgttggcaaggctgatctcgaactcctgatctcaaataatctgcctgcctcagcctcccaaagtgctgggattacaggaatgagccacagcgcccagccccttaatatgattcgtggtgtgactagaaaccatgaaagaatttaaagccaaggagtgcatgacccagttcatattttctaaagattcctgggattactgtattgaggttggattgggagggagcaagaacgaagcaggaatgtcacgttaaaggtcgttcagctgtccagacaagaaataatggtggatttggctagggtgatggcagtggaaatggagcaaagtgagcatattctagaaatacttgggacattgagctgtaaggactccaagtgccggcttcatgatgtgtgggaaagactgatcaaggagaatcgatgggtttctaacttgaacaacaggatggataaaggaaccatgaacagagatggggcccactgtggcgggcaggttttgggggtgaagaagatgagttccactttgtattctgaattggagatacctgattgtcgtgaaggttaagatgcttcagagtgttcagaaatcaggcgtgagattaaggtaacagataaggatttgaataatgggaatatatagataattgaaggtatagaaattctttttcttgatcataaagggggaaaccctatttgaatgtggtgtgtataatgtaaatacctacacacacatacatatgtgtgtgtctgtgtgtgtgtgtgtgtgtgtgtgtgcataaaacctaaggagtaaaaagaatagctgatatcatttggtcaggaaggaaggaaggaaggaaggaaggaaggaaggaaggaaggaaggaaggaaggaaagtttttcttgattgaagaaacccatgttcaattcaaccttacacattgaaatcatttactaatttgctttcatttactaatttgctttaattttcccccacaaagctgtatatgaatgtaaaaagaaaatgattaaaaatacaaataagattaactcagcttccaaagttcatatagggtaagaatttgcattgaaaatctgatgaaagtgtttgaactctatgttctctcccaagagtcatactccttttaaaatttgctaacagcgaacttcatattttaatttaacattgagctgaagcctctaaaagtgacatttctacatggaaggtgtgccagattcctggagagggcatatggaatgtgcggaatatgagcaacctgtttgtaggcatctggaggcactggaaaagggatgaggttaacctgaaaaccactggattcaggattagagtagcctctcttgccgctgatcctgaagttgtatcttatggaagcattgtcagaccacagaacgcttgctactgaaaacacagggctgaattaataattgctaatctatattttatttatgatgtgctagtcagtgttgtaagcacttgatgtattatttcatttaattattacaattcccttaaaatgggtgcaattgctatctctattttataactgaagaaattgaagtgagcttaaataatttgtagaagttcacgtatctcataagtggtacacctaggatttgaactcctgttcgcacaaagcatgtatcgtaattgttatttgttgtttgggatgagtgggttgaggggacaagaaatttcaatcccaaaggaaagaaatgctgtctttcctggatgttagttgatttcctggagtgaatggccttctggctcccactggccagggaaaaagaaagaaaataacagcaagtcgttaattcataaaacaattttcccaagtgcaaggcttgcagtttctgcacctgctacgttgctgactcatctcacctgaatcatttagtcagcttcattgtgtttgctaagactgctaattatcctactggaataatttaaactatcaataaagaatgcaataaatcattaaagatatggttaatagggagagataattttgactattcagcttgcattgatccttgatataaaaagattaattttatattccgtttttaaccttacaggcaaccattagccatttcttttcacagagttgagctgagctggtttttcattaaaaatgtggcatttatcttattgaattctagctgtgatatctcattccaggaacaaaaatatattctgacttaccaagaaagcacaacaagacaaatgttacatttttaataaaagtcattgtaaacaaatttttgaaatttttatgctttttaatctacccaagtatacatcctccttattcctattaatttagaaaattgatatcttttccccttaaaactataggaattatgtgattttattcgttactgaaattaatgaggatacagtgtcaaaattatttggcctgtaatacataaaatgtaatattttgtgtttgaggcattcacagcaaaacttaggtaatatttttttttttttttttttttttttttgagacggagtctcgctctgtcacccaggccggactgcggactgcagtggcgcaatctcggctcacttgcaagctccacttcccgggttcacgccattctcctgcctcagcctcccgagtagctgggactacaggcacccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccggtaatattttattgttaatgttccttggatgcttgtagaatggtgctcatttttaatagcttttaattaatttttatgtttttgctattgcttggcaaagttgtataataagaaatacttgtattagtagtcatgttgatctattgcatgccaagattatattggataatgtatgtatccatgaaatcaaaaagtttcagtgttaactttttcaaaataacagtataagaaaaatgcattttctgtcaaaactcatagagtttgagtttttaaaaagtttattgaagagaaagtcagaaccatactatagaattttgatttattttttattagaaccaaaggaatagttagtgctactctaaagttagatcagctaaacaattactgtatatacactagttttatttccataatctgataactttagaaacatgacaaaaaagagcaaacttcagagtcgtatcctattgtgacacaaatcagctatttatatccaaagtgtgcattcaaaagtattcctggttactcttgaatgtggacttgtggaagctcacaaattcaatctctgcattacattttatttctccatttactgatcctggtaataggccaggagctacattttattaccatcccataagtgcacccgacttgctttaccagactatgacacatatttttaagccattattatagcccccactggtacccaactggtcagaaaacacagattcaaactcaagacaagtaaaatgatatttctccccttcctcagacttgattggaaattcttcctttatgcaatcaactaatcatcaaaatcctattttgctggtctctgaggggaatctcaggcagtatagagagcaaaggactttgcagttttgttatgtccatggatctttgggttgtaagtaatagaaaacagttcaaaattgctcatgtaaaaagcagggttttttttttttttttaaatgcactcagtatttcatgatgttcaaatactgaaaaggaaattcatgagaatcagacctagaaagttgaaaaacacggttgtgatcttccctgtgatcacaatctgtgatcacaacaacacaatctgtgatctgctgtgatcacagattgtgatcagtctgcacccctttctctctgcatgttgatacttgtggtttgaaatggccccacacaaatcacaccttacggtctcttagctgcggtgctcactaatgactgtatctcaagagagagaatctggatcaacatggtagagcctaagagtgggagcccctggcccactctgctgtgaccatgaggttagatcaggtgaggcttctgtgcaatggacagtgatcgatatgtttcatataatcctatccctagaaacatggcacaggcactgaatgatagctagaaacccaagcctggagtgattaccagcttgcaatccattctgtggagaagggaggacttctactgatttttggaggatgagggcaattctgacagggagtggtatgagtaaaggctaaagattggatcctttctaaatggtgactagaagggtgaggggagctaaaggtctacatgaagaagttgtggaagcttggaaaggaaggctttgtagaaagccttagataataaaatttttactttggcatcctttgaagttttgttgttgatatggcttttgtgtgtgtttgtgtgttttagcaaggagtggccattggtcagaggtgtgctggtgaatgtttaacaaccagctctccaaaataaaaatgtgtatgtacatattaatgtattaaaaattttattgataggatatggacacacaatttacaaataataaaatatgtggctaagtctgaatgtttgttttccctcaaaattcttatattggaatcctaaaccacaaaaggatgatactagattatgaagtggggctttttagatggttagtgaccttataaaggaggccccagagagctgccttgctccttccactacaggagggcaccatctcaggggaaccatgccctcaccagacactgctgccaactcaaccttggacttcctaacctccagaactctaagaaataaatttctgttattaataaattgcccagtgtaaggtattttagttatagcaaccagagcaaactaagatatgtgtaacaccctttgttgtacatttcatatggctagttgatgatctcaagattctgtcagtgatttttgctaaacttttgtgcctgtatctcatctgcatctgcagtctagccatggtttcccaaatcaagttgcatcccaatctgcttattcttttcccagtaagtttattgtcattaaattttatatgtgatctgctgtaactatttctcatcctgatattaattacattctttaaactggaaacttttcagcgttagaatcaattagaaatgtatatagtgcaacaacagactcacaaagtaactgagcatttagcaattggctcctgagtttcagccggagctggtttcagtgagtaactcttaatgtctgagaggtgatgataccctcaattacaatgttacaatcctcaaaacaatcaatgggatttgattagatatgggagtatggtgaagacaaagaagatttcaggaatgtgtcctttgataaaggggttatgatcatccacaatggagaaataatataggaatccattcattcaacaaatatttatgaagaagcaaatactaatgaggaaaagctaaacattttatatgctctacaggatagttttctaattaattgttcaagtcaaccacagttcaaaaatagatataaataattattgatttctattaaattaagcctctcttttcagcttttagtgatgaccctacttgcacattatgcctgaaatgacatagtcgctggaccctgagccctcccaaagcagaatctgtcttactttcgtcctgtgttcccagcatccagctcaatgtttggcttatactattcaataaatgtgggttgagttaaggaacaaagaatctatacttggctccctaaaagagctagtcagtgatgaaaaggggcagactggttgacttcaaccactttctagagaaagtgttgacagtgttaaatctagggaggctattttttattcttttcaaatcccaggaaagtctatcagtctataaggaagtctacaagaaagattcaataacgtaagtatgttgcttgacactgatgtttctctgtcttcagggtgaaaattctaggaatcattgtttacagggacatccttgaattccaaatcctggaattaagctaaagatttgtgacttaggttggatattgatgtaactctaaatatttagcaaaaccaggctgagcaattttctctgcagcatataatgaatgtgcatactctatgcctctagcttttttagcaatttggaataaaatctttgggatttgttctgacacttttgccttgttaataaacatagtaagaataaggacaaagagaggattataaaagtcatttgtatggtcaagctaaaacagtggcatttacagaagtttataggaaatgtaaggaatgacattttatatacgggcttatttttcctttaatcctatattaataaagtgaattctgtatgggtaatacaggataccctctgtgagttgactgtgtttacaaaattcatttctaaactattgttcgcaatggggcatatagcggtgcatggaagcaatattaaatatagtttttagttacctccacaccagtctacaaaatctgatttagcaaagcatctgaagtctctgaagggactaacgatattatagaccagggtgtggggaagctattgtccctgggccaactctggttcaccccctgatttaataagtaatgtttttattggtgcacagctgtgcttatttattagcatattgtctatggctgctttggggccacaatgacaagactgagtagttgccacaaagaccttttggtccacaaacccaacttttcagtgggagtgtttgcctatcactgaatggtctttaatgaccacaaggaagggtgacctgtgaagtttattcagttttgactgtagagatcaatcaggaattcatgctaccctagtcgacccgtatgctggtttattgtgtctcacagcaccctcttgtattttcccgtccctccagacagtggtacaacttcatgtggcaggaattaattctcaaggtctgaagagaggactctcacaggacatagtctaagagacataaaagaatgggattggattgtttcttttggtgtctcaagttcaccgcagaggtgaggacatggctttatttggcgacaatgccttattgtcggatgacaattgtcggactagtgatgaagtcaattgcttgcttcctttcttcttgctacactgtccccataactagtctctctgcatctcagcccctgatcaggatgggtcttgcgatgagacaccttgcagacatgagttgatttttcaaaggtttagtcttggtcaggagccaatagagcaagataaacagaaataaagacagtgaggcaaggtgagcaggggttcccagactcctcctgcatttcagataatttattagctaggagagttaaccataaagtagctgtttcccatccgtcctaaactgttctgtattgtgttctattattctatgttatgctgtcagtatcactcctagatgacatctatataatgtttattagggaccatgcagggtgctagatgccctgcacgctaaggattttccttcttctctggcaacttgtatatatatatatatatatatatatatatatatttctccttcatctaatctttaaacaactgagtttctctagacttacttgtgagttctcttaatctcttattctatattttctccctagacaatcacatgaacatcacagcttcaagtgccttccctaaacagataactctcaaatgtataactctgtcctggacctaatttctgagcttcagatcaggatacccaactacctacttggaaacatttcctcttggctcactcatggtctttctatctgactcttcagtcagagactgtctcagtaaatacatccaccatccatgaaacttctaaacccagtaattcttgtgtcagttttgtcccttccctttcccttatcccctggatcaaatcacccagtctagtatgtattttcctctaaatataattgggaatccatctacttctttttattcatactgccatcactctcgtcaaagcagccgcatttctccctcggagtaggaaacagcttgttagctagtgcacctaaagctactcttcgcaccaatcatgttgctcttctatttgaaacttttccctgacctccttttactttttggaaaaagtccaatagcattaatgctacctacaagaccctgcattatctcttcacagctctcttcttggcctttttctacttcctcctgtgtgttctccttcttgcctttgaatacattgcttccttatccttagcctagataacccctgaatatctttctcagcagaacttacctcatatccttaatatgatttttttaagaatgatcagactaggtgaggacccccaaatttcccatttgcaactgtattcacaactgtaattaagtaaacaagtatgtaattgtgtaaaatgtgtcagcctcaccagaatggaatctctagaaagacaagagctgtatagttctgtttaggactgtgtttccatctcctaacacaactttatcattactgaaagaattaatgtgccgactgaatgaatgaatgagctcatttaacacttgcatacttgttagatatttattgttgtcaccatttatgagaactaggtagaactaagtttccaatctaggctatcagaccctcagaccatgtactgcgatacactgcaaagaaggtttagtgcttatttgctctcctggttccccattaccatgcataatgaaaagttgatgagttccagctactggatcctaggtaaggaagagcaaatcaatatgtaacagtgtttttggtgttaagggtcaaattgaataaattgtgtaccatattacccttacatttagaaaatggcttcactggatacccttttattttaagatcacttattgtatttttattttaatgcactcgcatataaaatgaagaaacagccagataatgagtacttgatccccaaatcatgaaatcaattttaatatgcttagaagatttaatattttcttagggcaatgagattgatgaagtcctgttaatgaatatattgatgtaattgaaggaaaatgggctcaacagtcttttgccatcagtgagatgaaccctatcacacaaactaagaagtaggtaaaaaagaaggcattaaagacattgcataagcataaaagttcattctaaacattttttattaataaaataaatttgttgatatagataacataaggctaattttctcttgaaatttacataacactaatataattattttaagtatcttatactgactccatgaatctgtttattttctttccatatcagagattgtagacgaaaaaagaaaaaacacctcctttttgcagtacattgatggaaagtattttatttcatatcatattttattaagaaactgatctattatgaaaaacactttttaagccaaataagtactaagaaatgtgaaaagtagcattgttttaaaaaatttaaatttcttttaaaaacattcattttctggaagaagttttgaatacaggtttaacaatttcaaattttttttccatctaaattctacctttcaaactgtattcccatgttaactagcctgaagacagatactaattgtaccccaatttgtaatgcatcagtttagcactattgatccgctaaaaaatgaaagcaaactaagcaagagccagtctcaataccaaaggaatgatatattgattccatctgacaatgctttgtctacagatcaatgtgtatgtgcagcatagaccagttaaaaatgaaacagggtggacaaaggtcgtgaaagaaacagggtatccaagattattggagatcatgaaatgaacatatcttaaagtatatctgatagttgttcacttataaaggaattctgtaggtttactgtgcaaaaaaatcataatgtaaatgttttatgatgacaatgccatatcttggtcctgggagtctctgaagaaattgagactcacttcttaatcaagaatgactttgtcttgattaagaatgactttgtcattcttgattaagaagtgagtcttagagaaaaaaaaagacatgatatggattcagtcctgctatgcttggtcataaagagatgactgtgtatgatatataatacatctgattcttaggttctctaatgcatgttttatattcctgcagttttttttacatttcagattttgaaaatcagatatattgggctgatgagagattgagagatggaagaaatgttttctggcataatcacaaagtagtaattaatcagactgtgagatttcctccctgtcgaataaaatttaatatactgtagtgaaatatatgcatatacaatacattatctgtttgttctcttcatcactgtattaaagaatcacaaatatgttctagaaccagaggtgggtaatgttgatagtatagctatggaaaaatagcctaccacaaatttctttttttcttttttattcctctacacattttattttcttgggcttgttacattttaagagcaaaagtaggtgtcagcctgtatcaacattgctactttaagaataaaaatactctgttttatgaattgttcaagttagcatgtctgtggggatttttgaagattcgaatatggtcagatgtgaccttctgagttgatgtaaaaagaacatagaaactaatttatgtgtagagatactggatttcagaataataataataatatttggaaatcacatattagaaagtcagaactagttccaaaaatgtatatttgggatttccttatctagatgctatttatgtttttaaaaccaatttgaagtctattcaaataggaataaggaaagaaactattatagcctgtatgcagaggaaatatctgtcaacccaaaagtttagcagctatgcaataaaccataatgtgtattcaggctttgcttatgcaacttattttattattaagaagtgtgaatattctgtaatagcaatctttggacaattgtatacacatgattttctacttttgcatttcttctgattcaattctgcattaaaatatgacaaatggaattcatgcaagaaaatgtgtttctgaataccttgcatagtccacatcttctgttattcataatccctgacaaaggatgacagatttttgcttttaaccactaaagtggaaccaccctgtggcaatagcataaagccagttcaccattcacttggcctgccagcatgaaaattctttgaatatttgagaaatttttaattttcaaatttgtgatttctaaaagtttgtttatgatatgaggatatagttcttacactattttaaataagctcaaaatgttactgtattatattgtctttcatcttataaaccttgtgctcaagtactgaaatttaatgtgtctagggttacctatttaggattttaaattatgttctaagatttaaactgtggatttaaatagaaatagtgattattattacattatagataatacatagtattaattaacaatttatttttatgatagcaaactttactgcctattaaagcatctaattttagtttatttttcttatagttatattaaaaaacatttgcatagaactgtaacatgtttaacctttctaagtaaaatgggactagaaaagctcctttattacattattcatcgtaagcttacagataagtgagagaatttgacattgttttcacaatctagcctataaaatggcttaggtttttgaattgatgattacctacttactcaaaactctttttttaaaatcaaaagaagccttccatcaaaaatgtccccaataaaatatgacagccttctgtgaatacaccctgtcctctgaccagtcaattccttaatatccagatgcaagaacttatatcagtcggtatgccacacactacagtgtgcaaagctaggataataaataaagtgtagcagtatgtttattaaaaatctatgccttaaagcaatttaaaacatttttaataacgataataactataataccatatacatgattaataggaggtttttactgtcttataataatactttccccttctctttggcatatgcttagtttcagatacaaacttttcaacctacacagccttgattggattggaaaatgtgcttgcacgctctctctctgtctctctcggcctctagatagatagataggtagatagatgatagatagatacatagatagatagattgattgatagattgatagatagatagatgacagagttgacctctgagagggatgagcaaatggcaacagcaacaagacatccaaagaggactagcaattgtccaaatgactacccacttagactgatttctgagcatttcaagcctgaaactgagttttaccaggaaataaatctgtatatattttatatatatatggaaagagagtgagcatacccaacctacgagagagagcaggtttgccagaacacttcagactgtttagggtgaaaagtgagtatctgaaaaagagtgtgtattgaagagaaggggatacacacacacacacacacacacacacacgcatatatgtgtatatatattgtgtatattacatattagattatattaatatcaatagttatgtttattacatgtaaatcaagcatattatatatgtgcttactagtcatttaaattgtaaccatttaaaaatgtaaatagcattcttggctcaccagctctacaaaaacaggcaacaggcagatttgacccacagggtgttgcttccagatccctgtgctaaactgtacttttaaagtatatgcagaagaagaaagctttcttttgtggatgatgtgttactaaataactatcatataatactaaataactcatattggctttgtaagaaaaagtgaagtagtttttttgagttagttttacatacagagctattaaatctgtagtgttctatgtggtcaaagtcatttaaactaaaagaaatctcactagttcaagggaaagtcaaaataataaccatgatgggggagaacaaaaattgcaaaatacaaaaggacaatatatattgtccttttgcattcaaaccatttttaaattcttacaattatcatcagctttagcagctaattttctaaatgttaattaaatagactagaacattctatttactattatccattgtcccttaaattaatagcaaaaagtgagtaatatcttgtaagttattaagaagcaattagtatcttaatacagaacctggactaatcacttcattgaaacagtcatctgctttatcaactttgctcaggatttgaacatgatgatcaaggaaatatatttaaaaaggaggactatgtcatttctaaaatgaagatatctgatgatttttccattgcagtgtatctgtattttatgaagctacatggctttgtggcctcttatgatatgaattagaaattatgatatacaaattagttctgaaaaagatggactgcatttttctcttctcttattctctggcatttgctgaaataaatacttacgttgttcagggcagaacagaccaagatccaccaaaagaataccttattaagtatgaagggttccttgtattaatgcatttcaagagaagacgcatgctaaccattagtattaaggagtacaaggcaacctactaaggcaagaatgtcaatcaactttgacagtcccatgtccttcaacatttcctgttttttcctaccctccccaattttcctctcattttccttgcttcctttctcctgtgttcttcttttctagataaacattttatctgaacattttacattctaacgtgttttagctctcttccagacacctcatacatatcatacctcatctcttaagtggtttttaattaagttaaacacattttggcctgttacttgtccaggaggcagtccaaaaatatttattgaatgaatgatgtagcaacataatatgcaaacaaaaaatagtttttacgtaatatgtagttttaaatacagaagatagttattatatatatgctcagtgtgagaaacaggatataaatgtagctaaaacacagaagttgttttcatttatgtcagtctaccatgtgcttagagtaacaataaaagatggtttagtaagatgaccattactattcccatttttactttgtctttacatatgacacatttttacactgttttggtcaataaaaagcctagctttccatattgattgctatcacgtacttattgaatccaggctttgtccctctaattactttcttatgctattttacatccttgtttttagtattgagtggcaaaactcattattaacttgagagtcttttgatctaaataaaagttaaatcaccagtatcacataccggcttttttccaaataaatgtaaagattttgcatttatggtagttaaaaagttaaaatgtacttttataatgagctgtgcatatggctttagtagttaaaatatgcactgagtaaatatcttagcccatatatatgggtcatgacatgatagatggaattattctattagaaataatatgaagaataaaaatgtaagttcactgtgtttatagtaaacatttgataggttttcatgttctttttgaacaaaatgttttgaaattattctcaattgcaagacctatgtgaaagctcaattttattcctctttattcattcttactgggaaagaaggaaagtctcagccgagtgtaaaatctttgaaattgttcaatttttgctacattctttttccatttacaccattgagaattgacctggttgtggaagctcagtctccaggaatatttgagggttgcgggtggtgaggacgggaggagaggatatgtcactatgcacccagatttagaaaactccccattctctgcgttcttttctcccatgcctccccattttctcttttcttgccctaattctgtttacaattcccatattctattctttctgtcgaagatttcctgctgattgtggaaagacaatgtccaagggaagactgacatacaaatgagtagagtgtagttctacacgtcattttctccctctggacctttcctctttcactggggcttgtccccttgtgccattcgttgcccaactggctttacaacagggcagccccttttcatttttgcttagttttatcatggtgtgccttaatttaatccaagaaacatgtttgaagattgctgtgtaaagcattggatgtttccaaaacagagacgggaatgtatatgtgctgatactagatcagggtgggttgaaatattattgtttcatttaaaatgtaagtgtgcaactgtatatatgtatatctatacacacacatatacctatgctgtatattaaaatattcataaaataatacacaagaaaaatgataacagtgtcatgtaaaaaaacccaacgctttaactttgttataaaacgttacttaaaaatccttttgcaaggattgaaaatacgagatatgaaggacatatgtcttcatgtctaaatttaaacatacaaaattataaaatgagctgtactgcataagaaatcagtgttctgaaggacagctgggacagaggcctttgggatcagactgaagaaaaatgatcacacagagtaacagttagaagataaatgtctttagtcaaggttttcaaagtgacattttacctctcctagaaaaaaacctgctagtttctaaactttaaaattccattttggtgaattagcttaaaatattagaagaatgtgactgtcagcgattctcttcagaaaatcaaagaaaacacaaatttacaatggtcattttttgctgatgcttatcaacgttttgattatggaggaatgaaagttttaaaacattttacatttaagataattttttatcttaaatgtgttaggtttacccacaacacattttagacttgcttcctaagtattagttaaaatggaacaataatatcagatttacggccgggcgcggtggctcacgcctataatcccagcactttgggaggcctaggcaggcggatcacgaggtcaggaaatcgagaccatcctggctaacacggtgaagccccatctctactaaaaatacagaaaattagctgggcgtcatggcgggcgcctgtagtcccagctactcgggaggctgaggcaggagaatggcgtgaacccgggaggcagagtttgcagtgagctgagatcgcgccactgaactccagcctgggcgacagagcgagactccggctcaaaaaagaaaaaaaaaaaaattacattcatgagtcatgtgtttgttgcatgatgctattttcattcaaagagagagtatggtcattctgtaaaactatcctgttgtgtaggaaataggactgtaattttcaaacttttttcacccaatgaaaaccttttcttcatggcagagctgtatcatataaaacataattaaatagtatttaaagagatactatgaatgtaaatgtctaaggataagcatttaaaacttatacatatcaaaacagtctccaatacatggcacaatatcatggtgctgtgacgtgttgtatcagttagtagcagtgaaatgactatagcgtgatgatgtgcacttaccccacatatgaccctaagtattgagtaccagggttcacatgtgtagcattctcatttgtaccatgttccaaatgagccggggcaaatttgaaacgctaaatcagaatcttctcttccaagatctattgtgatgtagtgtgtgactttcccatataaagtttctgaaatggttttgcaagccttacagtgctatacagatattagtaataataaacacctgaattttacatcagtgctcagaaagagtggactccaacctctgcatgaagtcagttagattgcttgcacatatggtggttctcatatgatgggattggaatataatgtgtctgagtgcattgttagtttttgttataaaaatagttgaaaaccaaatttaaatgaaattcaaatcaaatattgttgccattcttagagactttagcgaaatactaggatttcattggatacaatggaaagaacaatgaatgtaaaatcaaagtcttattataattttgcttataaataattgcttttaataatacttgtatagccctgaactgtttatagaaccattttacacattatgctcaataatcttcaaataattctcatacaatgaggataggatggttattattatcttttttttttcagaagaggaaatagactgagaaaaaaataaattcagcttaacatggatttttttctcacttaaaatcttaaatttccagtgtggcaacatcatttacatatagtgctcaataaaatagtctaagtgccactcattgcccaatttaagtagtgcagttctagtatattttataactactcagctattgttagtagtaccatgaaacagtatgtcaaaataatattgaagaataaatgtatgtgcttttggagttcttgttttagaggtagacaattctactaaaattgcattttataaaataatagaagaaattgagaaaaatactataattttttttccctttaacatttttacctatatattaacataaataatttctaatttaacatcttaatcatttctcatatgagtaaaaagacattaaatcctctaacttcatttggagagttcttgtctcttccccatgcaagttgtagctatgtagccagcaggcagacatagcattaagacagccaacttggacgaaaggagacataaagggaatgtcagagttacccagcccagagcccctccctcctaccaaatctgaactttttttcttgattctcatgtcattctttccaacttctcaatcttctaaaacaatctgcataaagcatcttaggcttcacactttacaaattaagcagataatgtctctaattagccttacttcttctcttcctgattacctccccatttgtttcttattatctttgtccatgccttcatttttgatcttagatcttcttttctatttattcaacatttccctctaagattccatatgaagtaaattcaagaatactatggaatagcattttaatattaagattttctcttactaaacatgtatttgcataaataaatgtaggttcacgtctttatgtattttattagaaagaataacctcctatttaatacagaggatgaagctttaagggaatataaactttttatcgtgcctgatatatttgagtatataattatatgcttactctgattaggtagatatgtgtgtataaaaccttcaaattttaatggaaacattaacttttgtatacattaacttgtgtctctgaatacattaacttatgtctccatgtaaacagcctcaataactctgttcaatgacataccagtttctgtctgttggtgttttttagtttgccctttgacagataattttttctaagttcagttaattgaaactaatattttgccaccatgaaaagttttaaagaggaaaaagaggttaaaatacacattggaattattgatttagcagcattgacatctctacataaagcacattgctgcttgatactgaaggctctcagtggatgacgtataaaatcctatgtgggaaaaaaggcagaaaataccgaaaagaacacatctgtttatcccaggctttgggagtttggaaagacctttatttaagctatataatgtatagaaaagggcagggatttcatatttgaatagttagtgtctccagttaggagttgtcagcagacatgcagaattgtcacctatgtttggaatgtgcggaggcatccttaccaattgctatgacaaggtctggatgggatacgtgtctacaatgcattccagttccagtacccaagctgatttggtgttctcattcttgaaatggcgtatggctctttttcggcaaataaaatcagcaagtgattgatgtgccacatccgtttggtgacgtcaactgccatgttgctgatacattttttgtcttctgcagatagagcctttttagggacttagatagttcagtgtcttaagaagatgaagacaggagagcagaaagatgggcacctggcccacagcatcattagccactctacgctactagtggaaagatacatttaaaaattaatgcttttttaatttaaggaaaaatatgaaattaaaattaagactatctcaggacttcttaaaaccagtcaaatgagtgtaacattcaataattgtcacttacctcaaaatcaataggatatatattaaacagaaagcttatttggtgtaatatgggtatgtcactcctcataaaatacttccctacttccctctcccagtgattatatatacttatttatactctcatccttaaatatccatacaaaaataattatatatcgcaactaatagtgactttcgaccaaacttctaataggaaaaataaaaaagttgactcttgaaattataaataatattgtaaaacaaggttagagatttcaaggttttccacaaagtaaagaaaataagtgaacaatttaaatatagatatagccttaacttgataactatggaagctagaattttcatgatagtttcctgataaaaatatgcatgtatttttgtctaattaattgtagtagcatataaaggtaccagttgcttttaaacaattaaaaggtttttttttgtttttttttttttttttgctaattttagtatagcaaggatagctttctgtaatataaaccacaggaattccattttgaaactgtgtctagtatactgtacaggtgaaataattactaggatgacacgtagtaattgggtctgtaactccaattaccctgaggcattgactcatttagacttatgcctttattcttcgggtttgtgagataagcttttctgtagaaataaattcagagtatctttcctagaattccaggagtctacaactctcctctccagaggaccagcaagaaatcattgaattatttgctaattgtgagcaaaatttgtattgatttttctctgtctctctagtcgatgttaatagcatcatacttcaggttactaaatacttttcagcaccatctaattgtcaaagattcacttactaagacaaaattgtagacatcaaagctatacacacacacacacataaacacaaagaaaatgatgacacaggcagtttatatgctctttcttacttctctttctcatatgataatgttttgcaatatgtatttcataatttgaaaccaataacaatttgaaaggatattaagactactataccactcagctccatgcttgatttaactgctgggcaagtattaatttctcattgcacccaagtgcagctaacagaaaaaaagtacatcaaaataagtatatatccatattgttttcatcatgttgtcatatcccttaaggatataagcagcatatcttttgttttcctattaaaatcactttatatctgtaaaaatagacactgtatttttcttatagtgcttaaacactgtatatggtttctactacaatgaaactattcccacatattataatttctacaatatattagcagagtttttaaaattaaatatgaatgtccgttctccacaccaatacacaaaactattgctcaataaatttgactaaatttagtgaaatatagtggtggaaagaacagaaaaaaaatcctttgggtgctcacagtagaattttacatgggaaaagctatttctctcatggcccctaaatagttgttaaaatcaatgtacctcatctttgacatctgtttgagcagaatgaatccatcttaaattcccaaatcactttcactgtgaaagaatgcagtaaatgaagcaaaatagtttggggaaatgagaaaatgtaaacaggccaatcagatgctgtttaatttcctggatagccagaagttttctcaaggaaaaatgagatcagagtttgataaaaggaaaacctacttataacccattgctagctgagggaagttttctcaagtatattgagattttaattgatactacaccttgaaatgtttcatagcaacagccaatgctaataagttacttagcactattgcttgatagtccataaatatctgttctgtatacacaggaacagtcatcactaatattttggatacaacttactatagtaagaaacatagtattctgaatgtcaagtgttggaatattcaatactttggccttttttgctgtttattaatattgatgaggttcttcttcagtaatgctgttggattattaattcctgttaaattctgagaacactaaattaaaatagactgttaaaaatttaactttttatatactaaggcttaatgtaataggcttttggttagtactactctgccataagatgctaatgtgcttgagtaatatctctggaaataggttcacaagacggaccaccaaaattatagaataaatttgacatcacactttgcttgagacggaattcattttttatatttatataagttctgcaggagcatcagcgatagtatccttttgaactaattagtgtcttcttttaaattcagagtaggaaatctcatctgctggttcccaaatcaacgttgactaattaaaaagttctagtgcacaacacaatcaagatagaaagaatccatatatgttaaaccttcatgtttggttgtcttgttttaattatagtttgtttctatccttgaaagattgtaagagatggtgaaaagtggtgcaatattgagctactcaaggtcatatgtgtgagaaaaactgttgaatataaactcttgctcattgtacataaagattataaagtgtcgcagtaaatttttcaagctatggtaggcagagcatttataaagatgagtgacaataatttcttctgtccctatacctacagtttttgcgatgtgacattgctcattttcctactgagaggaggagcccttttctttattgcttgaatccgggctggtcttgtgacttgctttgagaaaaataatgcagtggcattgatgggctgagctaacacctcatggggccttgctgattccacatttgacttccaggatcactgatgtccccatgtgaagtagtctggcctatgacttttgaagttgaaattactatgaggggagagtagcccagctgcccagctatatagctgccccagtgaccacaaacagcaccaactacctacaaatgtaaacaaggccacctttggccattcagcttcagtaaagatcccttgatgactgtagatgaatcagtgtccccaggtaagatcaagagaagaaccattcggcaaagtcggccctaatctctgacacacacaagtgtgagccaatgaaataatttttgtaagcccttaagctggctttgttaagccactgagttttgaggttagcaaggcagctagagttaactaatggatacaccttttattatgcgtaaggacaggtattagtctgcgtacatttcactgcctggcacagagtatatattaaggaaaaattattgaatcgaaatgaagtaagtagaaaactttatttcaagagactggcagcttctcgggggaactgggcaaaggaaccacatcccttattgaacttttgcctgtaagagtcacctccagtctcttgctgagctctgggcttgagaccaacattaagcttttcctcaaaaaatcacatataagagccaagttaaaaacatttatgcacaactctatgtgaaaaaaaatcacatgagaaagtgtgaataaatttattatctatttcatttggtgtgattgtgttggtttatttgaagtagaaaattacagatatttataggtatgtaaaaattgtttataaaagttttagctctttaagttttgtagaactactttgaaaagaaaggtaaacatttctaagcatactgagtattcaattagatatgctaattgcttacatgaaaaggtgtaaaaatcataaaacatggaattagtttgttctttaaaattaacattattaaatattctattctataatgcaatattaattaaaattttccaaagaaaacttgagcttgaagttcatagaatgaaataagcactttagtgactaaagcaaatggtcattcgggtcatgaaaacaagatagtaatgagaagaatgaaaaggtctgtatttttaatttccatttttaaatttttaaatatgcgtatggggtaagtgaattttaggttgttaaatatgcagtcagattggcaaatatatatttagggatgagaagggataataaatgtgctgtaagtccatacatcttgaacaaaatatgcgttcattttaatcacagagaggacacttttggttgagtttcattcaaaaaagggaagaaagaaatctgcatctttcattaaaatctccatctagctgtgtttccattagagttcactgaaaaatgactcataaaaccaacaattttatgcatcaggtgacaggttttgacagaaacagcactgcagtttttgcgatatgctacattttgaatgcttaagctgtgtgattaggtgtgctttatatgacttccacgtgcttagctagcaaaatctgagtttatttatataaaattattcaagtgaaaaaaatagtgtctctcacagtgagcaaagtcagatctcaaaaggggccataagggattggctagcattttatcaccaagtgagtccagctctgttaaaaacaagccacagaccttcttgcgatgcacaatgggctttttatttttaactgaccacagagtaaaaataataaatctgccatctgcctgtcaatagaaaataaaataattttccatttcagctctagcaaaataaaaatctgtgtctcctgtaaacacagaaaaaaaaaaatttgtaaagtaataacatgtgtgccagaagcttttgtttgtccatatgagaaatagctcgttgctaatttttagatactctctagacagttttctctgggcatattttagaataattgcatatttgagtcagctggttttatttaaaattgagaatccagttgttagaatattcaaacttactttttttactttgatgttaaatgagacactacactacttgttcttaacatgacatgttgatcacgcagcttcaactaatgttttctagtaagggaagtgaaaagaatgcatattttagagaaaaagggccctggatttccatctctaagcttaatgacctttggaatatcactttctgaaactcagaaatgtacatctagagataataatcccttgaaaagtgaactagagataataatcccttgataagtgatgtgagttttacagattattggccaatgtggtgcctgctgtataatagatacccaagaatggtaattattactattagtactggtatatttaataaatttctatttgtcttacttggatcccatcaattaatatgaaaaagttttaaatattatttgtggatacttatacgtgagatttctactttgtcaatatcaaaatggcagaataagtacagcaagcctaaaggctttagtttttagaaagactaacgattttcttgtgttattcataagtcgaggcaagttaaaggtaaagatagtggaaggaaaatgtctttgttaggtattgtatatgcagaatcgtactttgagataattgacggtattcaagctggataattagagaacgaaattttggcctttattaattaaaattcggagtatagtgaaatttatgaaagaattgcacatttcattgaaggcatatttgaaattctacaaagtcaaaaagcatgttccaaacaccctagttttcttgtacattttgttatattcatccgtcagtttcagcagctatattcattaagctttcctgataccacttttcaaaagtctaaatgcatttgagaatggccttaattctcaaagggaatcagaacatacgctatgtaagtggattcctacaaatttttatttcccagttacatcaaaattttcttcaatagcttaaaatccagtgtaagcaagtttcactaagcagcatttataatttccaattctttctatttaatttgtttgaattttaaagtttgaaaaatgatccctatccatataaaaaccacatttttaatttatttatgctgaaaggatcctccaaacttaaaagaaataaaattcctcctcccattctaaaattattatgattttatagtatttttctttgaattcatatgcttttcactatttagatcactacctttggcttaatgtcctcatgagaagaaagtaatgctattttaacgaaggtccatagggtacaggtatgttttggctccacattgcatcccaatgctagctagctcagtgcttgcccaaagtgcagttttatttaatatatattaagtgaataaatgagaagataattgcaagatctcactctttgactattccaccattaccagccaaaatgtgcaaagtctagttcatttcctctttatctctcccctctcctgccctttgattctcccttctactctttcttttttttgtgtgtgattcttttcaatcattctgactctaaaaagcaaatcctttttttttaatttttttattatactttaagttctcgggtacatgtgcacaatgtgctggtctgttaggtgtgtatacatgtgccatgttggtgtgctgcacccattaactcgtcatttacattaggtatatctcctaatgctatccctcccccaaccatcccacaacaggccccagtgtgtgatgttccccttcctgtgtccaagtgttttcattgttcaattcctacctatgagtgagaacatgcggtgtttggttttttgtccttgggatagtttactgagagtgatggtttccagcttctttcttcccttcattcttcttcctagcttccatctttccccctagacaaaaatgaatatctcattgaattatattttaaacaaggaataattttgaaagttgattcataggcaaaataatgtaaaaatgatccttgaaagtccttcaaatcatttgcaaagtatcatactcattcatcgtgagcagaagagtgagatgttcacatttcatgtgggaaacaggactgcaaagatttccaaactttatttcataggaatattgtttggaattgactgaattgtggaaatattatctttttctcccgctctctccttctgagcatatatatagttaaaatcagataaactaaccatgtttgtgtcaacctttatagtgaatacgaaaagcatgcttataagtgcagcagacactcattccaatcccccaggtacccctttgctatcactggaagtggacaccaattatacattcgatattctcattcacaaaatggcaatataataatacgtaattttgcggttcttttaaggttaaaaaagaaaatgcctacaaagtctttaaacagtactcagtttacagcaagtgctcaataaatagtagctgttcttattactagatccagcttacaagtgacaagattagcattaaatggattcatttcttgaatgtgatattttgtgtcctaaaaccaaaacatgttttttttaaataaaaagcagaatttaattatagaaatcaatgggaaaattaatcccagttgcagaaacaggtttgaatatcaaaagcacacatacaagccaatgtgaattgaattgtaatgttttttgcagttttcacttttcctgttgatccttaaaatgggtatttctcagggttcttgtcaggaattcatccatctcctcaagtagtgtcttctaatctcatgtcttcagctactacatggctgacatttccccaaagtatgtctatggcctaggtatcacacttccgtatagccaagtctactcaacattgccatttaaaaatcttaccaacatcttattctattttcttatttatctaaaccattttactgccttctctattaaactactatgaaattttggaagaaatactcataaaacaaaataaaaataggatatcttctccatcaattgtcttctgtgtcatttttcattcaacatttattgagcaactttctcatcactgcagttggctttgaggcacagagttaaagagaacatggtatctctccaaatgcccatctacttggattgattcctattagtcacaattttaaagcctttttttttttcacttcaatctcaatggctagtcatatccactaactggaatttaatttcacattcacttactattcctgcttgtttccattattgttttatttatgttataggatataagggttaaaaggaattgtagataatctactctgatttcctcaatttacagatgctaatggagcttcatataacttgagactttttcctttgtcaagcagctataataaatcctctgttagaatctgtttgataggaaaaaagtatgtaaaatttagttaatattcctgattatctctgagaagtattaaatgttttctcttgtttagtcctagtttttgttagattcttagattcttgaagacagaaactctaccttattactgttattttccaggttatgtttgagtgcatggcttggagtagtaatttagcaattatgggattaatttttatcaattgactgccaaaatcaaaaccaaataacatattgacctttttataatatgagcttccaggaagaacagtgaagaaagatcattagaagattgaaacatttctgatgtgttttaagtgtcttgcaaatacatgtttttttgctcccccgttcaatcagcacatctattttcaatcctcatttcccgttaatgattggaccagacaccctcattagacattttaaaaaatagaacttgtatgtagccttcttcaagattagcatcttcctcaaagtcttcttactctgggcttttttttttttttaatacttgccggtttatggtacaaatatttgctagcttatttctcttctttttaaatcttgtctgggacactgatattttaatggttactgttgtttaccaatataaacaagattgtgtttgagaaaaagataagcgttcaatttggttattgggtttttgcattttctggtgtcctgccttggtaaatttgcagagtcttcagttggcctcgtcaatttctacacatttccactgtcgtagtcatataggtcatgcccttatgctaaatccctgactcatttgcaatcaaaactctcttgattgcaccctaggtgttatattaagacaccctttcatttagtcattcttatacatttgaggcagaaagttggaaatatttgtattaatctcctgcagaatgatgtttatgctgtgacatcactctaactctctactggcatcatttgtacagaaaattatttttaatccatagtgcatctgacttataatacttcacagtttggcattttgaaaggtgtttcctttgaatatttttttcacatctagttcataagaagccatcatgcactcttaaaaatttctaggatgatgattatttttcattctaaccaattttacttaattgtgtcttctctttttcaatttatttatgttatttgtttatatccattcatttgtggtagaggttgacataatgctaagatcatttgttaggataccatatgaattatcatagtttgaagatcatggttgagttagctttttcttatagtgaacacattcctacagccaggctgagactgtaatttagtctaccatctcctgggtgtataaaagtggcttaaactaggagatggcgagaaaaaatggattagtagtttgttgttgctgatataaagtagatgttaatagtcactagcttgtaatttcaaaaggtaaaattattatgggagaacaaatagaacaatgaaactctaatgctgaccccaaaacagtacatttaactggctttacaataaatagaattactagtataaatagcaaatcttgcatgttgtttgattaatgagagaacattttttcatacctttgagaaggaaatactgaatcattgacggaaacttgaaaaaagtgtttcagcagttacaatcatttacgaaaaacttttaagttacgctaatgaaaagaatgtatggaaacaaatatggaaaaattatgacactaaaaatataatcgctgacatgtgaatatacttaattagggcaaaacagaagtccgaaattaaggaaaagcaaaaatcgttatactctttttctttttgagtcttgctctgtcactaggctggaatgcagtggcacagtctcagctcaccgcaacatccaactccctggttcaagctattcacccaccacaccctcctgagtagctgggattacaggcacacaccaccacgcccagctaatttttgtatttttagtagagatggggtttcaccatgttggccaggatggtctcgatctcctgacctcgtgatccgcccgcctcgggctcccaaactgctgggattacaggcgtgagccaccgcgcccggccttatactcttttttttttttttagatgtttgaggcaatgactaatatgcatttttattcattcattaataaatatcaaatgccatcatcctatatatcatctcatttgcaaagcaattttcacatgtgtttctctttatagtaatgtcctttgaggattgatggcaactaaggagctttgccagttaaatattcctaaatgtggaaggaatctgcaaagtaaatgcaaatgtttatttccctttctcttattaaaaatgaattatcaaggcccagcatgtcttcttgtagtagagtgatagaggaattattcagaaagtattgtcagtgctcatatgtaaccttgaattcttagcatcctatttaatactgtagtatgaaaatatgccataatatcatagcacattctatagaaaaccacacataaatagaactagtaaaaagcaataatgttgaaagctatattattttgtacttacaaagtgaacttttttataagttgaaacaacaagccaataaaattagccatcgaagatcccaaactaagtgtgaacaggagttgctgtctgtaattatttatgttttgttggagatataagaaatctcaaagcttggccctgcttcaaaggaaagaatattggttaggtaggaaagaggtagggggtagtcttggaactgttaaggaaacatttatgtgaaaaaacacttaatgatgttttaataaaagctaaaggatatacagtgtgctggattttgtgtgcaaaactttcattttgttccagttaaatactgagttctaatgtacagaagtgagaaattcagtggcgaatccaaaaagaaaagaaaagaaaacaaacagacttctcttcattctgaagtgccaaggcagccatccaagtggtagaagatcttaggtgccatatgtgctgttcttcctatggggatgacattttaaacttaactgaaatgactgggcttatttgaattctgctggattcttttcacttcatctcaacatgggatggctcttctcagtagaatatattcttagaagaatccacacttactgaaaaaggaggcatatcatggccagtgtcctttcatgtcatgcagttcccatcatggaacacaactcagggtcacagtgtagatatggcaatgtgaggcatatttggagggtctgcatctgagcaccaatttccctctctccccatttacacatcttctttctgtctcaagggtaccaaaggattatttgttgcttttcagataaaccttgctatttgcttccacactgaatagagattacagtcccctccagccctttaaaagtccagcacaccaagctttgccatatgtgagcaatctacaggcactattagccccgcttgagtagctcttgataacattctctaggaagtcaattaaagatgtcaggaggtgggctggactgcttttcttttactaacaggcattcagagagtggaagatggaactgtcagaaacaggtgattttgggttgtcaagaaactaaggctcctgatttgttttgtcttttcccctcattatttcaactttttttctttctgtgagctcttttagtttttaaccagcaatagctatataatagggaggacaaagcacctagtgtaataaatgacaataacatttgcttagtgtaagtttaaaatataaagagagataaagtcttagaaatttgagcgtagcgaaaatttctattaaggagttactttttgtgttaaaatgcctatatataaatacaagttaaatggttattcactaagaattggtcataaaacttgatcggtattatattagagtgattctctgcccttgcttcccatacaacagggatcactttcttttgctacaaatctcgacccttttattttatgtgctttcactgagaaagactatccaaagaagtaaatgactagattttattctaaattaatatgaagcaaagtgtcacaactatttatctaagctaatgaatttaagtgtttaaaccagattattctgtcctcctaagtattattttgttcggtcaaaatagtatttgttaaatattatattaatttaatatttgttaaattaaagtaataatagagaaatagacattttattgtttgagctacaacctagttatatgtttatatactaatcaggacaattatcactgtgggcaaataaatactttataagagactatatataactttaaatatctctatttgattatgcaaaaccatgataatgaatgaaccttgctctttgccaggtatgtgctaaatgccaaaaaactatttcacttaatcctcatcgccgccttagataagaggcgccattatccccatttcacagatgaagaaacaaaaaattagagagggtaaataacttgctccaaatggcatagctgttaagcaacaataccaggactcaaacaaaaggctttcaatcaccaaaacatgtgggcataacctccagagggcaaagaatagctgaagacgcaagattctgtttgtacttgcaattgcagaaaatataacctataagaattatgtgactctgagaagttaactgtctccaagatggtaacatacagttttgaatgttttaataacggtgaatgaggagacagaaaagattgaggctggctagaaggtttgggtttgttggaagaagaagctggcttaaatttttcttaaaaagtgaagaccagtcctgagggtttccgcatacctattaggaaaaggtgccatagttggttatacagaagaagaatgtaacactgatcagcaattcactcaccatcagcttttgttctccagtttttgtttttcttttttttttttatgaaaaaaaggcaattgtacagaatcaagctcatattagggatttattcaaagaagcaagtgtcatcatgaattttgaattaaaaatagatttagcttaatgttcaaaatcaccatctcacagcatggcataataactgattataatgaagaccttagttacaaagctaaattatttttagtatactttgattattaggttaaggaattgtaaaatatgcctgttatatcttatttcatcacaatatttttaaagtataagatctagaataaaaaattgtctattttcaaatcctggccacttttattaactagatgaacttgacatcttggaacttctgtcttttcatttataaacctgcccacctcacagggtcattgtgagtattcaattgaccttatagacaagaaatcttgaccatttagtagacactgttttattccaccccactagacaactgcaatattttaaaataaacattcagaacatgatctttaaaaggttatggatgtgataagaagtgatacaagctactggcttttttctgatcatttgaatacatgaaatttagaagttagtttttacctttgaaaataagaaactactagcatttcaagatcattccacagtgataccttcaatgcatattacattccttactaaagcaagagataagcaactacccatatattgagtaaactcaacaattagaccaatataaggaactttctactaaagttgcatatgtaataattaactatatccggtttagtaatgacaagaattgaaattcgttattcatctgtttattcaatgaacatttattgcgcacctactgtgtgctaaggataccattctagactctggaaatacaacagcaagcaaaatgaacttggttcctgcctttgtggagctagcttacattttattaaaagcagatagataacgaacacaaacaagaatacttttacacagtaatatgtgatattcaggggagaaaacagaggaatatgatatgtgtgatcttgctgcttctttagtttgggtagtcctaacaggggaaactgaagaagtgataagtaaactgagatttgactaaaagaacaggagaggtgtaggaagtcatggggagaataacaattcacaggccaactaaataatgtagaaacaagacccaaggaagtaactggccttgctagaagaagaaaaaggccagcatggttgggaaggaagggagcagaaggggtagatactacgagatgagaggtcatatctcttgaaccttgtaggccaggataaggattttcacttttttctaaatgtgatgggggtggtggagtgggtgggggggtccttcggagaattttatgtaaaaagatgttaacatttatttttataattttgaagaggttcctctgtctgctgcaggaagaattgactgtagtgtggacaggagtaagagtaagattgttgagttggctgctgtgtactctgagagatgttggtgactcagacaaaatgacaggggcggaagtcaggaaaatcgggtggattctgaataagtttcacagtcattggagcttacgaatggtcaggatggtgtgagtgtgttcatgggtgacagaaatggaggagtaataataattccttgagcgattcatagaagatgataccatgtacaaagacagggaagattgcggaaataaagacttgtatggcgaaaaccatgaattccattttggtaatgttgagttactcttagacattcaagacactgtcaagcaggcaggtggacacaagactgaagttccagagtagctcaggctggaggcatgcattttgggatcatcagcatggaggcagaaccagcaggggttcactcagaagaatgtgtggctggaacactccgttttaagtactgacgattttttaagggcaggaagcttttggcaaagtagatggatgagtaatggctagttggaaggaaattaagaaaagtattccagaagacaaggtaaaaaacacacatttaaattagatgcattttaatgcaatgctttcgtggtaatgatttcattatgtaggaattcaggggagaataaaaaaaaactgtaggaattttccacatattaactcttagcaaatatatatctagcacttattatagataaggtgcaatgggagagaaacatggagttattatatctgcattggagataatagctgatagctaatttcccatatttttttccatggccatctgattcttcagtcttataaggtactgatgtattatgaaatgaaggaaattaatcactatattttattgagccatccgctgttgtatggaagtcttattcgaccaaatattttaaatattgaaaaggaaataatggctatattagtatacttttgtaccattttaaatgattttcaattactaataaacaccatctttcatatgactattttttataattgaaaaaaacaacaacaactgggactctgtggtaaaaaataatatgtttttagaacctgcaatttaattattgggctgcttaatatttgagatctattgaaaatatagagtgaactttttattatgcaaatttattcagttctaaaaataactaaatgataataaaacattcttttttctttacatcatattacagtaatgaagctgttacctctcagtatgcattttaatgaattttaactaacattttaatgagccaacattattatagatccaaggattagacaaaattgaatttactggtattgagaaaagttcaccaagagttatattgtttaaagatggaatataatacattttatgataaaccatcaagtatcctgtatgaaaaattgtgctaatggttgaataacattatatttatgctatacatagatatattcttcatcacactttaaaaacattaatgatatttttgtttttgtatattcaatccatatgaaatataaaagacatagcatatcaaagaaaataatattttataatattagatttttaaaaaaaattttctttaaggaaatctctatgaagtatcattataagtttttattttttaaaggaggaatcatttataattttcttgatgtactttttttttttttgagacagagtctctctctgttgccaggctggagtgcagtggcactatcttggctcactgcaatcctctcctcctgggttcaagccattctcctgccgcagcctcccatatctgggattacaggcccgtgccaccacacccagctaatttttgtatttttagtagagacggggtttcaccatgttggccaggatggtgtctatcttctgacctcaggtgatccacctgcctcggcctctcaaagtgctgggattacaggcgtgagccaccacgcctggcctgatttacttacatgaaatagatttatacactcacaacttataatttgagagagaaaaataactttttataaaattgataattttgggtaataattgatattttaggttctatagaagatgtattaataactgtaagccgctctcaactaaaacacagttagtaatacttgctccttcctttagaacctcctcactcaatattctgttgaggcactgaaaggacctaagtctcaaatcaaaaggttgtcatcgaattcgtctttatgtctcttgtgcctagctcgcaataggccttcagttaatgttaaatgaaaagaaatgtccttctcaatagcaaagtttgtgaatttttagtctatctttgaaaaaaactcattagttgaattgtacactttgatcaggctcaagttaaggccatgcttactagcatcctacagatattttattgacatttacatttcaaagcacctaattgtggaaaattgccatttgtgtcactgaatgactcttgtaagaaaccatgtttctatactctcttcgcaactctttgtgttgaatccagttgggaaagacagtataatttgaaaacactccgtcaatatactttttctttatacattgaatttatacattggtaaacatacgtattaataagtagttaatacatttacagggttttaaagaagtataaagtagatgcagggaagtcttcctcccttattctttactttccagtattttttttttcctgcaagtgcatttgttattattagtttcttgtgtgttctttcagagattgttttatgtgcatgcaagcacattccagcatgtttcttttccttttctaattaattaaagcatacaatgcatattccaaacccagctctgaaactcgctcctccaaaaagccttccttatgaaaacaaagtttcctccattttaccttacggcattttaagtatacttgtccccaataattcatactttcatctttcagtttgtggtttttgagttaggtatggtaactttcctaaatctctttagcaccatgaggggaccatctttcattgaaatatcttgtactcctaaagtgtgctatatagagactggaacaacatgtgcagtacatacttgaatttaaaaagtgggtgattgagaaataaaactcttctgttacctcacagaggtagtctcaacaactagagctggttgaaaagtgaaaaacaaatatctaagtttgttatcaattaaacagagcaaaattaaaggtcatattaaaatcaacttttaaaatgaactaggtaaaactcactgggcaaaatttatacttttagattgggaagaaccatggatattagtactgtataacataaaatagtacctctaaatgtgtttgtttttagaattatattatatataaatccctactcgcttattcatagcgatgatcgcttttagcaattgcatagtaattgattgaccccaagacattaaggcctgaaaaattttatatatgggacagggttattgaagattattattattattgttattattattattagttttcttgagacagagtatcactctgttgcccagactggagtgcagtggtgcaatcatgtttcactgcagccttgaccacctgggctcaagcaatcctcccacctcagcctccaaagtagctgtgactacaggcgcacaccattacgcctggctaatttttgtatttttggtggggatggggtttcaccatgttgcccaaaatggtctcgaactcctgagctcaagggatcccccgacctcgtggcctgtcaaagtgctgggattataggcgtcagccaccatgcctgtcctcttgaagatcattaactatttgatagtcaaaggaattaaaaattgacagccattaaactcattgaagatcagatgcagaagtaaaattcaaagtctttcttgtttactatactacttctaattcctaataacagtgattcttttatgaactacttcctttacttttcactgtactttacaaagatcatttgttcaggcttcataacaaaccaaagacaaaggctttttttaaaccttcattttacagatgaaaaagctgaagctaaaatggctgaaggacctgtaataatttaataataaaagtagataatcatctggataataaaagtagcagaacagagacaaccgaggccatctgactaagcccattatctttaccacagtgctgtgttgccttcctgccaaatagtagtagctccataaacacttgttaaatgggagttccaagtccctaagaggaactggcatatggtggaggggatttcgagtgcattccagaaatagagaacaaactgtgtttaggccctaaaaaaagaaaagagcgtgttacatttcaggacctgaagaaaggcctgaggaaatgtgggttgaatattatgattgaagtgacaaagaagaggctgtagagacaattttagaggctagactacttagagttacagggggaggaaggggactattcagcctgaatttcctggaactgtcctgcaataattattaatagtacttccttaggatttcaaaagtgttagtttggaaggtaaaatagaaagttatccaattcttaggtaatgttgaagatttttttttaatttcagaatgaatgaatgcatttcctcctttgctacttgggatattagaaggaaaatgaaaagtctgttagtccatacttcatatccagcacttttatcaactgagagcaacttcagtgattggttctccagtgatatattgaagacatttgtcataaggccctagccctctaaagcaaaggtctttcctttaactaaatatggggaaaatatgtcaagggcagtattaaacatgtgcattagaaattactgaatctgtatataacatttgagtatttagtatccactaatttatttcaaaaattatcccatttgccaacttcagattttttggttgttgttgctgacactttagacaacttgccctacattcacaacagccgtaatttgttcatcaagagtaccgagaaaacaaggttctaattttactatttgtagacagtttttagagggagtaaggttaatatggtgcatgaaaaaagccaaaaagagattaaggcagtttgtgaattttagtaatatggcataatgaagtgcctcgatcatgtcaaaataatggaggtttcgtagactttctggtaaatcttatttatcaagtttggtaccatcccagggagagaaactcaaaccatctcatgcagctaagtaagtagtaactacaatgtagagatttgcttcctctctgcacagaaaggaaatggctatgattattttttatctccaagcattctgagaatgaaagtgtagtaagtcctcaggctaggagaaacagggtagcccagggaatagatatatagctagagactcagaaggcagtactatttgttttcttactgctgagcacatactctatggatggtcaaggtgactccagtgtgtatcagaggaaaagaaggattttattaaaactctactgaagaaggcttctttccagtttcagctaagatgtgaaggtttgattaaagcatccatgagttttaaaatatttacatacttttgggtaaaacacacatataattaattctcttcatgagaactcagtattacttataccttaaaaagatactcagtatctgttgtttgatatcagtttgtctttaggaatgtaagaaactgtgcttttcataagtaaacaaacatcttcaagcacattgttctccaatcactgtcaatggtgtaatatgagttttctgagataatttaaatttggtatttaggatatttgcatgtataaaaagtacttggatatgctccttgcttcctcttctcctgctgaactgtcagaagatggtgatgcttttgaagatttatggtagatgggtaatgagattgctgaatgttaactactgcatttggaattcatttagtagcaaaagaaaagaaggttactgggattgggatagagtagaaaagtgatagagctatttttaatcagtgaatttaaaaatcaatatgatacgttctgaattaggatacatttcaagtctcttgtcatgtagtaatcaagtagaacatttcttgaagaatataggatgtcaaattggatctaattcagcaaaattcatgatagtgtagtgcccatattttgtgatgtggacatatcaaattttaatattggaagactaaggctaaaaaatccacaagcatgtggaatatgtttttaaaattcaaaattcgaatataatctattcagttaggctttggtttatgttctggtgcaaaagaggaacataaaccgtgtactctcaaactgctcatttttgagtttatggatgatgatgtgattcatgtgaaccccctatctaggacctccaatggttatggttacaaaatgtgttgttaaaatagctaaaatgatggaaatggtgaaattagcagaatcaagttgtgagcccatagatataattatatttctactctattcggagatttgttgagtttcgggtagaggggaaagaaaagataaagcaacaatagtgttaaagtaactggcaaagaaggttgaccttgaccttcttttcctttcaaccctcatttcatcagcaggggtgagattactttgagaccctgccaataggtaataaataacacataaattccaggacacccttgcactgtagggtgccctaatgtgtaataatccttagactattgagtttataactcatgacatctggcagttacttggcattgtaattcatgttgatcatgcacatcagaatacacaacagtagagaaatatcggagcaataacacgttgataccaggagaggctagaatgacaagagatgctgctgaaactgtgtacctctgtgaactgtgcagtggaatgctgtaaaagctaatatcttcagataaggactaataaggtgggaggagagaggcgatctgttgggatccagaataatgcagcacattaatatgtacttgataacactctttatttcctttattcaaatggacaactatagctataagtcagtaatgaatcctgaaatttggatttaaatatatacttagatatattttaatttaaaagtgcatgtaaacaaatgtattgaattcaaattttgtataaatatatgtaaaagagatttaataatttaatttttgttttctttggtctaatggtaagggctaaatgaggaaggaatgcagagagttagagaaaaatgagaagcagtagggaaaccaggcaggcattctacaaagcacctgtaacacacctacctggtacctagcagcctaactactttgtctgaagacccgaggcccatgggacatgaaccagactgaaaagctagaagcagacagatggttatttgtaatcatcctgtaaatgtaaattctttaaaactggtgggcttgctggctttatcatctatctgtctgtatctatctatctatctatctatctatctatctatctatctatcatctatctatctatttatatatctatacccaaacccagatctaagaaaagtaggaggcagtattataaccttaaaacaatctggtgtttccccttgttaccatcttaaaaagcactaatataaaaaaaaaaaagccagcctgtgtagttcttaattttaagttgactgtattatatcttctaatgcccaaagttataagcattgctttgagcaagccaagacagttttgtccgaactgggcaggtgctgaaagacagttgcctgtggaggagaacagaatgtgttgggagcatggtgagatgggtttttgttctgcagctgagcaagacattgccttgaacatgtttaggttaatactagcatttctagaaaccatcctcctcacatgctatgtttggacacaatctctaacttgatctggtttctttgagctttctgtgatttcggagacagcaatgccacgtgaacaattctgtgggcgatagctctttaagggagaaagaaaaggaactgattaaacattaatcagcttcaatccacagcttcctcataagctaatggataggctatgcagatccctgtcaaatatcacatgctaggctttgccaaaaataggacttccaagtgttgaaggcatgccaactgctggctctttaactgcaaaccaaagcaaatgattgccagagacaggcctagagtctgccgtggtcagatgtcaccagtttgcagtgccacatgtgatccaagagtttatgaatgatctcaacacttggtccccaaggagaacatatgcattacagaggttatggatacaaattacagagagcgcgatgtttccatgcaatttctaagaatccttcagcaagttttaaacataagtggaaaacattaaggaagacttggcactcttagcaggacttcaaattatattgtgggtgaggacagaacacggctaaaaaaaggattcaagaataaagacttggctaagaaactcgaagctggccattcctcctgtgtgaattatgtttgtgtttgtgtgttttattccctgcagaatactagacttcacaaaatgctatgacttgaaaatgaacaagtcacagggcattcttgtttattcaacatgctccaattcctaccgctggtttatctggatcatttgctcagtgaatgtgcctgtgcacagaatctcattggaggtgggggtgagagcttctcattttggagttgtcagcatgctacagggtgccagagtgtcagcttgcacagcggcccccggatgtctccccactgagttctttctttcccattccccttctgtgcagaagaaaccacttatgacttatgcccacatgttcagatgttattgtctatttaactggtggctagcctgcccatcctgaccatattttgttcaattgtaccaaatgtaataaagtagtttcttgtgaatgacaatctttatcagttgtttagtcattaaaacttcagaaaaatacagaattattatgcgatgtcagtggggagcttctggttgaaaaaggaaacttacactggcttaaatataaaaggaaacatacctagaaagtccagagttagcatagttttcagaattaatttgtccagccatgtccttaagagcccagatttttttacactttgtacatagctccagtttcatcctgaggatcggtctccccctggggtcaaagcgtggctgccacctatagccatgtagtccaggaagagatagggtgcttttttcatgtgcagagtagaagttctgagctgcatgctggttggggttacactcagtcattccctatggtaactggtggtggtggtggtggcagtggtgttggtagggctaggggaataatctgtggtagttttatgagtgaccatcattgttttttctcttagtccattggaataatttaatatgatatacctataatttgtgctaccagtttttttggctgacataaatctgttctattccttgagtcgttgatttctgaccttcttgaactgtctggcttttattttacagatatatgagtatgtagataggcaagccaagaggattctatttcttaaatccaaacaattcaaattgttcttcataaatgacattttaaaatcaaattcaaacactgtggtctattttatatcataaaaaaggggtgcagcacacatcttgaaggagagcacatcaattcaatcaaccaatcgacattatttggttaacttttctgatacccttcaactagagagctctttggagggttacccagtccagttaagtagataaggaaagacttcagatgagtgagtccaaagttgacactgaatgaacagtatgtacttcagaaaggcacaggcaaaagtaagagaacaaagggacagctaggagttacttgcaggcagaaagaccatcatatgccaacttacaatgataattaggtgttccttcatatccctagggcatggaggttacagaaatgtccctgatgagcctggagatatatgcagggacctggttccaaacaacatttgaaatcatattaaggagagaattttatcttaagagccattaaaaagtgttaaaaagggaattgacatgatcacatttgcattttagctaactcataatagctacaatggaaagtttaaaggagaaattagagaaaaaggtcaaataggatattcttacagtaattcaaggaagatataaggacattctgaactagggcagtggagagaggatgaatagacccagatgatattgcaaatcagtgcagcataatgactgtgtataaattctagtgtcagacacactgggttgaaaccctgtgcttacctaacacaatagatgaggctccaatgacctattctatatccatgacgctatctttggcacatagtatgtactcactaaattttagctattatcatagaacaagttattttaaaaatagattaaaagtgtcattatatgtgcctgttaattaatttttaaaagcaagtctaaaaaattcttactgaaaatcagcacataattacatatattatatatatggataagtaaaggctcctgagtatgcttctatttatcataatttactgaaactgtattcataaactaaaatgtatgtcatataaggaactgcttcgggctagaggtcggtcttctactgagaagtttggatgtcattgtgccacataactccagcagttctgatacatacacagagagaaaacctgccggcaggaaagacttgtgttcagtgttgtttgggtctcctgcggttttcaactgctgttggccgtacctttcattacaattatttcttagattatctttctcgtaatgtttagttggttgtggatggtattctttattcaatgatgtgtgccaattcttttatcagtaacattttaggctttacccttctaataactttagttgggatcatgtgcacattgtggtttagaaatgtatctttcagaagtccattagttatacagtctcacttcattgtcattgctaatttgttttaataaactaagatggaaatgactaagtagtgatttgcctagactgaggttaaaaaaaaattctaagaactattgatttaagacaaaacagagagggtttggggtgggaaaggatatgggattataaggaagcaggagccaaagatataagctctaaaatcacagctggacataaaactttttaaaggcactctgttagttacctattgcttcataacaaattactacaaaattcagtggtgacttgagtcctcaagggtttttggactgagggccttggtttcttgccagctgttggctggaagctgacttcagatccttgccaaatgggcttctccattctgcaacatggcaccgtgcatgatcagagaaagtatatgaaaagagagtaagagaggagttcagactttccctctaaagattcaataacttagtctgctgaaatacactgacaatagacatattaacaggagaaaaaggctacatatttactatgcacacatgtgcatagaagccacacaaaatatgagactgaaagaaaggtcaaatacttgaagcttaattattctcctcatagaggagaggaaagtgggagacacaggcaattttagaagaataagtgatttttttgaggagatgaatgggcctgaagaacaaagggtggcctgggacaacatttccctgggctctgggtgcggtgtcaactctggtctttcctcctgcaggatgcgccaatttcccctggttaatgagatatctgagaaaggaattaattgaataccttctggaggacagcatctttaggtagacaggggatctttagagaaagctctttcttccatttgctactcactgggtgctcttagtttaaagtctgaagtggcgtattttggggtatcattttctaagccacaatgagagagagagagagagggcaaaaacatgaaggtcacaatcttttataaactgatcttggaagtggcatcctaccactttgtaacattctgttcatcgaaggtaaatcgccaggtctagttcatgctcaaggggaggggatatacaaagggaataaataacagaagggagtgaccattggagaacagaacaagggtctatcacaggcactgtcatgtcattcttgttaatctatttcttaaccagttcataggagagtgtttgtcacattacagcattcaatacatacttgcagaattttaatttgtcaaaaatctctatgtcgtaaggtagtaatttagaatgttccaattttccaaaataatttcctaagtcatggtgcatcccaatgtaaaaaaacatgcaaatataattcaggttatattatgactagctaagtgaactatttatatgtgttttccagctcacatatggaagtgaatattcgggttctagccaattacatatcccccccacctcaccccatggagatttgaaaccctgtattctaacttagatctgaaagcaagttctatattagaatgtacctaccatatcccttttctttttaaatgaagttttaaaaattctatttttatttgacaagcaatcgtatatattatatatttactgggtacaatgtacacctgttagaaaagctgttatctgaaagatgaaagataaatattggtaagggtgttgagagaagggaacccttgtatattttgttggggctcagaaactgataccctgaaatatgtcactgaagcagtgtccttcgtctggggtaatacccaaggttcgttgcctcgtgccaaggaaatcaaggacatggacacacaaggactgagtttaagaacagaggtttaataggcaaaggagaaaccctcccttgtgcagagggaggggttccgagcgtatctcccagggtgcgacgagatgcggttggttttatagatgagcttgaggatgcggtgtctgattcccacagggtttagaggattggttggggcaggtgtgtcatttacacagagcgtgaagaagttggccaccccatcccaaccttttattatgcggatgagttctgtacctggtcggcacgatgttgcctgcttttttactgcacctgtggcggaagaaaaaaataataataagaagaagaagaagatggagcctccgtgttgaatagacttggcttccaggtatccctttctatcggcacagctgcggcattcacccgtgcaagcttccggcttgcttctctatgtctgcagttcgattttacaaactgctctttttttttttttttttttttttttttttttttttttgagacaaagtctcgctctgtcgcccaggctggagtgcatgaactcgactcactgcaagctccgcctcccgggttcctgccattctcctgcctcagcctcccgagtagctgggactacaggcacccgccactgcgccaggctaattttttttggtatttttagtacagacggggtttcaccgtgttagccagaatggtctcggtctcctgacctcgtgatccacccacctcggcctcccaaagtggtgggattacaggcgtgagccaccgcgcctggctgcaggctgctctttgttagaaattatttggggctgttttttgttaaaagggaagcctcgctgaggacttgtttaccctcactatctgcctaaataatttctagctcctatagcagcacttggacatgctgaactgaagaggaagcctcaagatctctctgaccttccttcctccaaacccccatctctcaatcctctgtgtctcttgaagcacaggatgaagttgttctccaaagtttcttacctgcctaaagtccggacctaccaaagaagaaaaccattacctctggccccttccctgaattttcatgagctcaaatgatatcgcagaaaggaagactgaagttggacaacaaacctgggcaaactttcgtcaaaaaccatcgtccccttgtgagccgaaaagacttagtcccaggctattgtatgttctttaaggttattgaatccgcctaaaaattatctatacttccccatctccctttcccctaagaaacggagtatataagcattggtataccatagcggtgttaggcaattactctgtgattctcctcagggtacgctaataaatttgtgtaccttttctccaattaatctgctttttgtgagtcgatttttcagtgaaacatcagaggcaaaggggacgctttcccttggcccctacaacttggtagaaatgtaaattaatacagccattatggaaacagtatatcctttttctttaaaacacaactgctgctaccctgtcatcgaatttatttctcttcatcatatttaaagactttttggagagttaggtaacacacactgtggtatgtgctcttcttttgacatacgtgtcaagtcacacttgaaaatatagttttcagttctttctagggtagaggatttagggggaatacacacacacacacacacacacacacacacacactcaatttagaatttaaaattgctttgctattttctacatttaccagaccattttagttctcttaatccgacacatgggaatacttcaccatggctaacactttcttgtttttatcggctacgataaagagcacagggcaaaatccaaggcagaaatgaataattagcacaaaaatgggaactgatagatattattttattttacttttcttacatttatgaatgtaaatacagaccccagaaacatataaacaaatatcagaatatacatatcttccttcaaaatttgagaagagtaaaaatgattttactcctttttctaaaaataagttctaggctgcctatggtggaacctgctgaaaagcatgtttttcaactgagagagagagagagaagaaacatattataatatcctgaagacttagggttaaataaatgatatcactaaacacaaatggatttactgagtactatacaaaccccaaagagcacattacaagttgaagagggtacagtatcaattatatcattatctcaccctactctctgggtgaatagtctgaaagcctaaaattacagttgatgttagatttcttggcttcatttgcaaattggagtcattttccccctttttgttgaatgccataagcacatgttttattgttgaagagtaccagtccttatagtttgttatgatgtttttcttctttttgtcctacatgtcaaaggacctttaaaaaaaaatggattgtggaaaattggtgtaacgttgtatttctgaatgatttgcaatggtattaggtactacttgtgcttaggctttttggcataccattttttaggagagcagatctggagaaggcccttcaactggccagctgtgccattttggaacagattgagggcctgcaaaaacaccatttgttgccagtaccggatattgtaggggtgctcatcaccctgttaccatatttttgcacttcttaacattgcataaataggcagctgttctgtatttagaatataaatgagtcaccagcttgctctccctggaggatttacctgcaagagggaaccacggtgttaaccccttctcatcagttgcatgaatgtcacatttaaatgcacactttcctcagcccactcagaagcaaatcctcatgcatataaatcacacctttcttgccagttagacaagggggccaaaaatatgcagttcacagagctaaaatggaacacatttctttagcagtgaaatcagtaaattaatcagcttataaactgagagtgagcaatttgtgctgaattatttcttactgctccttcaataagagacaaggtgctctaatctcataaagggccatgacttcattaagatggaaaaccatgttaaagggtgtgttgcaaaatacgagaaaagaaaaaccctgaagtcactgagttgactctctggagctcttttaaggacagggttttttatttatttggggaatgacaattaacctacagacttggcacaacaaagaagcagagtgctgaagtgggtctcattataggacacggaaggcagttggtttgacctaatccccagtcgcggcacatgatttacataacaggctaccacaagctgcctaatgttgatttcaaacagcttgatgtgtgcatgtgtctgtgggtatgtgtgtgtgtgtgtgtgtgtgtgtgtgtgtgtgtgtgtaggttcattttacctcaaggtactttggaaccaaacatgtcggtgttggaatgtccaagaacagaaatagtaaagccagtcaggaaaagcagaggcagttgcagtatatggtacatttgctgatctcaactacttttttgaatgtttaccctaaaattaatgtagctctgatttaccacctaaatgcagtccgatagggctgagccatctctccaggcttttcatcttgtcaggagcagagaagcacaagtagatagataggtgacatttggagaggcaggcatgccagattttcggtggttacagcgaaggtccaacctgctgttctccttaatgaaaggagggaaatttcagacaggcaaaactgctataagggatatctctgccctgaatgtcacactgcccagatgtcactcggcaggtggagttgcagaatgaaaatgtagccctgcgtatgtgggtgctagtgtgctgcaagggtgaactatgaatctgtcttctgaagtgtaatgaaaacagtgtggatcttgtctatgtttgtgtcatgagaaaggactttgtcaaagaattctcaccccactttccctcacagatcattaggcttgcaggctcacaaaccacatgcatatatatatgcgtgcacacacacacacacatatatgagtttctatatagaaaatagaattatactaatgaagggttctgcaccttgcttttttaattaatcgcagaactgtacatgaatatttctcatttttttgactgatttcatttttaaagttgaatttttgaccaaaggtgcatgataatttagtcagccattctcctgttgatgatcatttatgttggctccagaatattttaaggtggatgtagctatgttctcagtaaaaatccaggcaatttttactagaacaaggtaaacaagacttgaagttaccttgtacaacaaaaagcctaagttactgtcgttgagttttcttttcctgtaattatttttcctcagtgttacgagatgacttccgacaaaaccccacagatgttgtagtggcagctggagagcctgcaatcctggagtgccagcctccccggggacacccagaacccaccatctactggaaaaaagacaaagttcgaattgatgacaaggaagaaagaataagtgtgagttaaattaaaatcatggcccagagagattgaattttcagtctcaaaatacaaaatagatgtattttattctttaacattattaatacaattgtatttgaatgttaattacaatttatactgccttgaaaagatttaaaaacatttggatgagactacaagagacaaaaattatgtaaatcaagtgtacatgaaatattaataattgcaccaatctgagttatatctttacactgcaatattgatattttagctctttttttttttttttttttttttgagacagagtcttgctctgtcacccaggctggagtgcgatcctgctcaccgcaacctctgcctcccggtttcaagtgattcttctgccttagcttcccaagtagctgggactacaggtgtgcgccaccacgcccagctattttttgtattttttgtagagatggggtttcaccatgttggccaggatggtctccatctcttgacctcgtgatccacccacctcagccccccaaagtgcttggattacaggcgtgagccaccacacccagctgatgttttagctcttttataaaatctccagaagcttctgttgatcatgcagtacctgagtgttaaagtataaatgatagccataaaccacattaactacatctaattttgcaccattttcaaaaattataagagaaattaatttaaggtgatgaatatctcaaatgctttttccagtttttccaattgaataatatttataacagtaaaattttatacatgaattgatttaaaaggaaattgaatagatgtaaaataaaatggaaatcaaaacagctgactgattctgcatgtagaaaaataactgttttcaaaggaaatttataatcagattcatcagttgattaaaattcaaaatgaaacacacagaaacaggcaaatggcatgtaatcattttatttcttcagaggatccacgcaacatttgtatgtgaagtttttaagtgagaaccaacccacagaaatagtatgtaattgcttaactttctgatattattcagtagtataatttttatattcaatacaactgagagtgaatacatttaagataatttctcatttgactgaataaatgtgccattttaataaaaaaactataaagtattggtatctattatcttaaaaatatgtttattacaaatgaggatttttcctctgtgcacagtgagattacaacataaaacagaactagataggctgtggaagggatgacaatgtatattcatgcgtttctggtatagaggcaaagatattttttcccttcaccctctaaaggtttaagtcttttagtctgctgaaataaactggcaatagacagtttaatggaaggaagagcatacaaatgtatttatatgtaagtgcaagggaatcacacaaagtataaaactcaaagaaaggctagatggttgaagcttaattaccctcttcataggatagagggaagtgggaatagtaggtgattttagaggaagattaaatgattttcagagaagataagtgggcccaacaaatagacaaagttcctctggcctctgggagaggtggtgacaagttctgggaaggtgaggggcagaactgcactgcaagcaaaggttgtcttattatgtagataaagtctcagataacaaccccaagaagaatagttgaacagtctgtccagtaggcatggtaatgacctttagtttcttctttggtgattaatctttgcaggttactgagatttcagacaggggatttaaggcaattgtgtttcttttggaagaacttttctcagtcagataaggaaacttcagagagcttccctctctgttcttggggcaagtggaggggagaaacaaaggaatgtcagagagacattgatgttaaggaagtttctaatgacttacaatttcctttagttcaaagtgctcagaaagccaaagcaccacattttgggatatcgttttctgagccccaacaccagtctcactattaacactgtgagatctacattaccaaagagagttttgttctcagtggtcttgcttgggtaccaaatttatgaaaatgtactcctgatgatggagtaaaatcattgtttatggattggtagtttatgtttatagcatttagctcttgcctatttaaaggtgtgctggcagctgaataatccaggatgaccttacccacaagtctggcaattggttgactctcagctgggtatcttcgttcccctccttatgatctctaattttccagcaggctagttcagtcggttcccatgttggtctcagttccaactcagcaagagaaggcaagacacaatgtacaagaacctttcttccagtgaagtatttgctgtagttccattggtcaaatcaagtcatattacctagctctcagcttcaaggggaaggagaaatggccttcacagccatttttataagctctcattttattctaccagacagaattgagaacaggttaatggtctttttcacctatgtaaaaaaaagttgaaaattcctttctagaacatgacaagttgtaaatcttgaaacatctctgataagagccaacgtacatgagttgtgtttgcctgtgaaattaaaaaataatggagaaaaccaacatgttcttatcttgtatttcttcaagaacactcaatcattgtaaagctaatattgaattaaatgagtaccaaaaaaaaaaaactggaaaagaaactatgagttatagatttactgaaagcctaactctgctttaatgtcctccttagcaaatacatattttaatattattgcatttgtttttatcagccaataaatgcttctcatttaagaaatcttgaaggggaacctattagatgctaatggtttatactaatacatattaccattttataaactgtgtttgtttttatccaacctgccattttctccaagaattatctcttaaatacaattaagatgaaacaaagatgattaatattaacagttgaaatgtgaattctagggaggcaaagatttttaccgtttgatttaccactgtctcttaagtgtccagaatatgcctagtaagtatggatatatatactttctgaatccctctgattcagcaggattttattagattatttaaaatgaatatctagtatttctttctgatgacaaatgacaatagcaatttattcaaatgaatttcagtgtgaagactaactactgggatttagggaggtcagtcacaagactcaaaatgcgatcaggaaagagaggacagctgccttaaaaaatattttctatgaagaaagtatggaaacttacattgagggtgaatttaagaaaagaaaacatacctgcaaatgccaaaataatgggagagttttttcctttgggaaacaaatatgctcaaatactcaaaactatttattaatgacctttattttctattctgttcctttttcttcccttctcttttctttttgtttgattttaacagatccgtggtggaaaactgatgatctccaataccaggaaaagtgatgcagggatgtatacttgtgttggtaccaatatggtgggagaaagggacagtgacccagcagagctgactgtctttggtaaaactttcttctaaattataaatttttatttttatcaatttttctttgcttttaagtattactaacattaaaaactgggccatataaggacagttactcatgactcatggtaagcagtgacaaattagaattatcttgttttctgtctttctaatgaaagcttcgatgtaaagaaaaaattatttgaaactttaattaacttacattgttcatgtatttgtaagattttgcagttcatcaaaatgtaacgttctttctcaaagtctatttgagatattacatctatctaaagtttatcactcattcaactctcatgcatttatcaggtagctattatgtgcaagatacagggtaaggatttttaaaagttagagagtatagtataaaaaaacttgttttccagttcttagaaattcaaactgaagtatttataatttcaactcttgataaatatactatgtatgcacacatataaattcaaaatcagaaaatggacccctaaaatgagatattttgttatgatattcatgttccttcaactttaagaaccaaggctctccttagctggttaaatgcaattaataggttaaaaactgactagaaccatatcatataaatggtggataaagtattggaaaggagaaaactggggacaaataaagatggccgaggaaacaaatgtaaggaaaatactgcagggcagctgtggaaggttgaaagagagagaaaatgacaaaaaattggaaaaaatagatatgctaaagatactcaaaaatgaaacactcttttagaatacattctatttaaattctatttaaatctctgtatagacatacacatttatagacccacacatgcacacacatacatgtacacatatgtatgtatgtgtatgtacatgtgtatatatacaatcttcattaaacattttactatagcagatattatgtgattttttaggagcaaaaatatcattgtgattttcaaattatttttcagtagcggtaaaataatcctctacttctgtgcatgatttaaaatccctatttctggtcatttcttcaggacacacccaagtgtggcaccaaagccctgcataggtccccagagaaacgtattttgctggcttgggagacgccatcccaaggtgtaatgggagtgccactatagaagagctgtattatgacttccactatatttcaagagttaagattgtgctttgtgcatgtgtaccagaatgcaggcctctcctttcaatcattctgagcaccaggtaatctctggtaacactccctgtggctactaagcagcttgaagtcccaaatgacaaagctaggagaaatcccataatttgttaaaggaattgaatagaaaaaatagaattgttcaaagtatgcatgtaaatttctatcctgcagagctcagacaagtgtcagtttgcccctacatttcatgcagtcctctataagagtctcaagatgtgctccactctgtaatgaataaaacacagttttgcctggtaagaaatgatattagtggtcactgaacgttagcattgaaagcccacaagtatagctcttctatttaaagaaacactcattgctatttttctgtaactaccacaaactctggaatagaaagaaaaaaaaaagctatattactgcagtatagactgccttcagaaggaaattgaaagggtttaatgtcattacagaagcaattagacttaccactaatgagacatccttatgaaatatttactctactttccctaaagaaatgatgagaactactggggattcctaaacatgtcaagagttatgtgggaacttctaaattattttgaaaatagctattatccaaatagattgaatttgtctagaggcagttcccctggcagaattgatttaggaaacggagaatgtttattagatggtgtaagctagtcagaactgacctgaggggttataagtacaagattaagttgaaggaaaaactagctttccattattggtaagaaaacaacatccaaatccaaaagaaaaacaaaaaaaacaaagtgatggtccaaatcaaggatgtgacaagtattgcccgagaaaccccttctgtatcttggctccctattcttagagaacataaaagaaaaaaaaacagtgtactattaatagggaggtcttctttattttatgctggtgctcctacatctaatacacattttccaatacaactctttatattttagcattgttacatattatcatttttgaccaaatatttatataagtaaaactgattgtacttcatactctacctccctcaattttattttcatggagcagcaatttcacttttaaaggtctagctactataaccactctgtagctacagaaggtttttaaaggtcctttgcagttcaatctttatcttaagatatgttttacagaacaagttacattttgttgttcaaaaaaataagtatatatattattattataaatatgatgtaaatatattatattttattgatacctattattattataaatataataaaaatatatataataaagttacatttaattgttcaagaaatataagtcacttgtaaatgtcaagaaaaacaatgaaaggaataaagggttttttccagtataatagctgtctactttccgagacatattgctaggaaaaagaattttctgaattcttcaagtattttgattctagtgggcttgtactttgaagttgtatagtttaaaatttcagcattatatattttaaatgtgccatttgatcatatcaaagatatgatcggtgtaacctaactttaaaaagttactgtgccatactccatgaatcacatattgtggttgatcttctaatagtttttggtcatgaaataacatcctaattaactgggcattatcaaatctaaaaattagaagtaggtatcatagtctacagtagcactgaaatctgtggcccaatctatacaccttcctgaagtatagtccctagaagtttacatatgttaagctctgaagatcctggatggcagagaaagtagagttgaagtaaataatacaatttctaattatgagtagatttcagaaaactgctgtccaaaatttgggttttaaaaatgacatgtggatttcaaaaatgatttttaagtgtttatgaatgcaatacacgaaaacttattttatgtgtaacatttgtaaaatataataagtattacaaaacttagaatgaaatacaggaatctcttgccccaacacaaacacacacacacacacacacacacacacacacacatatatttctcatcattttacgttctgttttatctaattattctgggatttgtttccatatttctgaatatgtgcttaatctgctatttattgatgtatcaatttcatacattatttgacttcctattatagaagatgatgatttggcccacttatagctccttccccaccttctcacctccacttttccttctttttctctttttagtctatgaactttcaaaacattggttatattaatattcagaatttgagttattatagtcatgtcaatattattgactgtgagttgaatgttatagtattatgaccatatttcttttctggtactatttttgttcttctttgaattaataataaacccattttcccatttacttatgctttctatacctgtcatgaattcttgaaatctctaacagaaactataaaatcttctataatcatttttttagactttagctattaagtccccttcactacagtcttccctgaggctgcctgatctgacttggttagacattccttaggtcaacaccgtaaacctaattctgcttttgtcttccttgtctggaatgctggatctgctgttttctgcatcctatgtttgtttctttcttggttaacccctcttttcagaaggggttctcaacttctttctgcttggctgaagcttggagcacattctcaaccaaaatgccttcattctctccagaccttagagttctagtttagaattatactttagttagggaatttgactgaaataatatttttgctcagagtattacagttgtgactctaacatcatttagcatctcatgatgctcttgagaagtctactgtgattctgattcctgtatcctgtatctttgtatgtgatcagttttctttttctttttcttttcttcccaaatgtttggtggtctctttaccccagttttctgaaatggttcaatacattaccttagtttgacactcttctcttttctgtgctgtaagttgatgagcagtctcaatctgaaaactctcaaacaaaacaattcaatgaaatgtttaatttttttaaatttttctttgtcaaacatgttttcatcaattagattttaaacctccttggtttttcttttctctaattcctccttacttatagcatcctgttcttgtttcatgggtattatgacttctcttgtagcagagagtgttgtttttgtaatttgaattttgttttatttttttaccagcttttattaagccccaggtccatgtgcaggatgtgtaggtttgttacctaggtaaacttgtgccatggtggtttgctgcacagattaacctatcacctaggtattaggtcccacatccattagctattctttctgatgctctccctcaccatgcccttttgacaggctccagtgtgtgttgttcccctgatgtgttcatatgttaccattgttcagctcccacttataagtaagaacacgcagtgtttggttttctgtttctgcagtagtttgctaaggataatggcttccagctccatctgtgtccctgcaaaggacatgatctgattcctttttatgactgcatagtattccatggtgtatttgtaccacattttctttattcagtccatgatgggcatttgggttgattccatgtctttgctattgtgaatagtgctacaatgaacatacgtgtgcatatctatctataatagaatgatttatattcctttgggtatctaccccgtaatagtaatggtatttctggttctagatccttgaggaatcaccacactgtcttccacaacagttgaactaatttacattcccaccaactgtgtaaaagcattcctatttctctgcgacctcaccagcatctgttgttacttgactttttaataattgccattctgactggcatgagatggtatctcactgtggttttgatttgcatttctctaataatcagtgatgttgaactttttttcatatgtttgttagccacaggaatgtcttcttttgagaagtgtctgttcaggctctttgcccactttttaatggggttgtttgttttttcttgtaaatttgtttaagttccttgtacatctggatattagacctttgtcagatgcttagattgcaaatattttctcccgttgtgtaggttgtccgttcactctgatagtttcttttgctgtatcacagaattttaataacacttttttttaagtaaaattatcttgtgatgcttctctgcctttatttcctcttagtttctcttccccaccatcccccaccaccatggctccataccacattgttctttgtcttttcgctggaagcttttttcaaatggcacatgatctattgttgttaattcatatttagttgttattctccaaaaagattactggaaactctgtgccaactgattattttcacagtacgatgttcagattgagaactaaccattttggggaagatgaggacagagattggggttgatgatactggttttcagtctttgaatgagagataatagttgataccatgagagtagttgaggtattcagagataacgctatgagagaagatccttaggacccacaccttaagaagtatctgtattttattagtagcatgtggtataagaacatgaggtgttattaagattgttgtcggcaatataatcctttcttgagtatatttattgagcatctgctatgtcccatgccctgtttaagtgcttaaatactaatggtggaatgaataggcagagcccctgctctcacctggactcttatatcatgttatcagcaataacatgaaattttgcctctaatatgtggtgagagaggcattattttcctctgagaacatttatttatatttgtctttacttcataggatgaattttctcaggcaaggaaagttctagccaaaaagaaactaatgcagtcaggatttatttaatcacattcagacagcctgatcattatcattcagtctttttctggaagggcatgacaattcacattcaatgactatcaaacccatccttacctcatacatgcccagttaaataaaaggagacctaccagggccatctgacttccaatttaattgacactacagggtggcaggtctttctgggtgagctgaagtcaagataaggtttacaagcagtggttaactctaatgtccttttattacatagctttggtcttacaggacttaaagaactctacctatgtaattattgccataacactaattttataatgttaagcgaagtttatttttaaaattttatggtcatttgagaaatagctgttaccacacagtgattgacaattttaaagccattttcaatgactgaatacagttaaaaagagaaatttgtttgctgggcacttaattttttcatgtaactaagtaacttaagagatactatgcaaccacatttcagatttatggtattttgtgttaaattgtatatttgctttctgaatatttttgacataactacaagagacttggcatttgattttattatagctgtatataaagttggatttttccaaaacgccattttggaactaaattgacagggctgactacttgagagccatactttacagaaacacactggcaaacaacactactgtcccaagagagattaaccttgtaagcaagttatgcaggtgattcaaatcctgttaatctcacataaaaaaatgttaattgcattggcaaagacattgcctctgatcactctgcagttatataattagagatcagcccattcagagaggctctgatctaattgataagcagtcagcaaacgacccttgagatttcttccccgtttttcaatatgtggtcagacataaggtattaacatgaaaaaatcagtgaccttgttttgacatgttttaaaattaagtttgcttgttattcaatagtttaagattttcatgcatacttattttaattgtacagagctctaattgtccaaactctatggagcattaatagatattgagtgtgatcacttatcaatgtattggatggttttattatcaacttactttctaatccacctagcttttcatttttttggagatgattttgagtcaaaaggggagactcaagttacttccttataatttttaaaatttgtgtctgaaaggggcttggctttgtgtttggcttattgtaacggttgccactgcagatccaacgcatttgaaatacatttttggcctgtacaacttctttagtcttcatatttatgtttctgattctcagattttctggaaataaagttggttaagaaaagtggaaaatagttcttacaaaaaatttcttccatttaaataaatgttaggcaaacctacagtttttaacataatgttttctgtgggtaattatgaaaattgcaaagcagaaggtcagtttagtataattaacagaaaacaattggaataatgaataacacagtttagagataattgttagaaagggtgctatggaaattctcagaataatactttaaaatatgtgaccaagctccagtatctcaggaatttcccatgtcacatgttggacagcacatcctaatacccaggtataaaacccatgttgatgtgtcatgtatgtgcaggcgactttcatctcatttattctttgcctttgttttgctttgatttgtttttctatccattgaattacatttttcaccatgagccaatgtcagacttccaaaaattgtataccacatatgctcctgtggttatccagttgctaagcaactggactctgcttgagggtagcagggtagagagaaggttcattgtgaagtcctgcacccctgctgagttcatttgaacagcagcagggatcctgtatcttgattcttcttgaaattataaatcaagtgcctccacgtgtctccatataaaacaatgaggcttagaacaagtaccatgactaaaaaacccttagggatcctaatggtatccccttgaggaagggacagcttagttttgagacatctctgatgtaacgtttgccatttggattaattatatgttgtgattttgtgactgttagcatgttaaggaaagcatacacaaactttgcctgaaaatataagtattttaatggaactggtctcacatattgtttttcaatttattttatacccagcataatgtcatgaaaacttttcatgttagataggtagatagttttaatattgcaatgacttaacagtttttcaatgtataagtttgctgcaatgtatcctaaaatctcacattttccaatattgtcagttttgctgcaattatcctatggacttcttagttttgttgcagttatcaattatcgaagccactgttctgcattgttatattttgcagagtgtctgcaagtaatggtggctttggttcttcttcagggctcatatttcctttttcttactgatttttaatgtcggcatgcccgtcttgttccggacttcaatgggcatgacttttgtattttactttttttttttttttttttgggacggagtctcgctctgtctcccaggctggagtgcaggggcccaatctcggctcactgcaagctccgcctcccgggttcacaccattctcctgcctcagcctcccgagtagctgggactacaggtgcccgccaccgccccagctaatttttagtagagacggggtttcaccgtgttagccaggatggtctcgatttcctgacctcgtgatctgcccacctcggcctccgaaagtgctgggattacaggcgtgagccaccacgcccggcctgtattttacttttaagagaattttggcatttaatttcttgcaaaatatcttcatcacgtttaaaaagtctgtttgattccttctttatttagatgatttgtaatttgatagctatatctacagatttgatcatatttatcttcatttctcttcctattatataagtaacctcctttatctcattgaaaatttatttggcttcaagtaatataaatctgccgaacaatggcttaggcataagaggttcatttttctcattcttaccatttctatgatgaaaggagcttacacacacaaactcacacacacatgcccacactcacacacaatccatgttttacctgccagtctgtttcaatttgctaaatgaaaagttgagacatttccttgagtttccttttcaccctatgcgtctgactgatcacccagttttgatctctcttgtctgtccccttttcgacatcctatgaaccattgtgtcagtttaagctgaaataatttcttacaagaacgctttgacctaattcacgactttatgtttctcttctaatttatctttcacagacataccaacacgacctttttcatatgcttattcaacaagttgcttacttgcttaaagtccttcaatagctctctatcaacctcagggcagagctcacagtccttgagtggtgaacagggccttcatggtcttatcactcactctctgtctagctttgtctctcaccactttccccaatgtaactaacctgctcactattcaccagcttgaccacttagtgaaagcctctaggagtgggtgcattaacatgtgctgaatgagtcagtggatgagagaaagacttctctagcttgttcatcccagtgtcaggatgtagtatgctactcccactaaaatcaaagggaacaggaaaggtctcctcttgatgaatcatttttcaatctggagtaatatcaatagtgtctcaaacctctttaacattgggttaatgtagtttttggatgaatagctgcgcctgatagcacagaagaagtcgatcccgcttcctatgtgaatgatttattttttactattagcatttgggaccctcataaggatatattaatcctattgcctatttaactaccagaaatgatagctcaataccaactatgccagccccaaaatagctgttttgggcacatagtgtacagagttgaaaaaagtaacactaaattattttatccgacatgttgtctacagggcacaatttgctgctaatttattcagggcgtctaaaatctttagatgcaaccgtgtttttctttagtttttatggatcgtttgtcaattctgcatttacaaaatttttcatgatgaaattctatttgtcttgttttattgcttgggatttttgagtcccagagtacggatactctagcatatgcagaaaattttgatccctactgtcaaattctctggagatatacaatagtcttccttctaaatgccaatggtagttggttttattgcaataaaatatttatcttgcaacttacacatttgttttataaatatggatcttgatttagtcaataaaatcaaatactcttatttatactcttaacatctattatttgaagtaatttattttctttgaaggtttcctgccgaatacattttagtttttgtgccactgtatacaaaattttaaattagaaggtttgaaactcaagttctaagtggctaaatatgtccagatggccagaaaaattgtgtcagcttcctacagatctcatctttcttttccttggcttagttctctttctacctcagtaagtagcaatattgaatttgtttgtgatttgcagatatgggctaataaaatttaaatgacaatttttccagtctcagaccattatccaaaagggaagaaactggacaaggaatgccaatgtctggtgatacataaaactactttttgatttgtatcctcagaggctaagaatcttatggataggaaaagatttttatggatacagacttatttttctctagccttatgtagaagagtgctagaatacaatttaacagtgccaaatacagattaataaaagaagaaaggatgaaaacagtaaaacagattactgaagaaataaaaaacataaaattaagtaaaaaaaaatgggtagatatctcaaacacttaagagaagaccattggagaaaacctcaaaaaattgataaataaatagtttgcaacaattaataatgacagtctttgtatttaagaaaaaaaatcaggtagacatctttccatacatgaagttaaaataatcatgggaatattgagtccttatcaaatcatagcttaagtgggaaaatctaggtaatacatatgtgtgaaagtacacattttttggttttctctagcattcttgaggaatattaatatttgttttttaaatgtttttatccctttcaacttttagttttcccactttgaaccctgataatagattattgtaatcatttttaatctctctttttcctgtagaattcagtgttctgattttttatgataggatccacctgatttagctcagggattcactgaaaaatcaatttaatatttttttccaaaggttgtatggtcttatgtgcaaactgtagctattcctttgttccaaaatatcttattttattgaatgacattggattcacaaggccttattaaaacacagctgaggtacagagttaggtacctgtgtaccaaaagtaaattaggtttcctttgcttttttcataatgtacttaaagcatgcataatagtttatctcattttaccattgtttcattttttttttcaagaacgacccacatttctcaggaggccaattaaccaggtggtactggaggaagaagctgtagaatttcgttgtcaagtccaaggagatcctcaaccaactgtgaggtggaaaaaggatgatgcagacttgccaagaggaaggtaagaccaacatatggatggaagattgttagataaccaatgaataattagaaaataaaaggacagctacaatgccaccaccaaacactcctatgtcttggggtactttcactcatgtgatttttacatatgcaagccacatatttactgtttgtatgttaaagtcctccaggctttcaatgtcactctttcaatgagtatctacattaatgcttgattcttcattccacctcttatccccagataccaaggattcctgggtgccttctttcccctggaccctttgaggtataccattctgttcctgcagaatgccccctgcaggcctccatcaatgactgcccgttcccatgcttcatcccctctggataccctttgtcacctctgtggcccaaagcataactaacaaaagactattgcatgtggctgactgtaagtcctggagtaaaggaaaggtcagcataacactgaaatggtagcaagtagttggcatcatttttcacataggggatttccaacacagagaccttctgtcactttcttttttccatctcttcatggagaccttctcttccatctccttcttattgttcttatcacaaaacccccaaacccaatctctcaaactctaacctgtattcaaaaatgcttttcatcatatataaaaataattttgacttgttgttatagaaatttccttaaggccttgccatttagaatgaaataagtaattcaagtgttttttgttgttgttgttttaacacaagtaattttatctttaagatttgttatgccttcctgctagttctacctgctgatattataaccatcatgcattctccaattactgcctgcataaaattgtacaggctgtgtttttctaatttttcttttttttaaaaaaaattttttggctgggcacgatggctgactcctgtaatcccaacactttgggaggccgaggcaggtggatcatttcatgtcaggagttcaagaccagcctgacaaacagggtgaaaccctgtctctactaaaaatacaaaaagttagctgagtgtggtggcacatacctgtaatcccagctactcgggaggctgagtctggagaattgcttgaacccgggaggcagtggttgcagtgagtcaagatcgtgccactgtactccagcctgggcgacagagtgagactgtctgaaaaagaaaaaacaaaaaacaaacaaacaaaacaacaaaacaacttcgtttctttcaactgactgatattaaccatgcttcctccgaagctgtataccttttatgtgctttcactgctatcagtaatttcctaaatgtaaacattcatttcaaaatctcaattttataaatccctagatatgattggatactttacttcaaaaggcatgtcactcatggattgaataaactggattcaaatgcatcaaccatttataatagttactgagaggttctttacaatctacaggaataaaacaagtgaaaacattaattcagttagtttttcagcctatgtagtggggaaagtcatcattgtgtttgtttcatcattttaatgccagacatctgtctttaaaggaatggtattagtagaagaggtttgtaaatgtgaggcttttcatgccctctcattggagaagcaggttagaaaacaaggagagtttacactattgaattgttactgtccatcctctatatatagtcagcaactttcttcaaatttgagagcatgtagtgaataattttaaaatattaatgtaaggtgaagagattaattctatagtaaaatttatcctagtgtaaacacaggtttattttaaataactgggagtatatgcccttgtgcattgaaactttaaaaacctttaattttagaataattttgatttataggaaagttacaaaagttagtaacagagagttcccatttacactacacccagttttccttattgttaatatcttacatgacaataaaacatttgttacaactaatgagcaaagcttgataggtaataattaagtaaagtgtatacattatttggctctcccaggttttcatcattgtcctctttctactccaagtccagttcaggtaattattgggttgggtatcatagacttctgcatttgttctcatatctctccagtctcctccgtcctgttacaggtccttagtttttctagttttgtgaccttaacaaccttgaagggaagtgctggccaggtatgctatcgaatgtgccccaaacttggattagccggattagactgcgtttataggtttttaaaaagaataccttagaaatgacatgctcttcttagcacattgtatcagggggcacattatatccatataacagcactggccaccctgttaattttcaaacactgagcacgagctagttgacaaaagtattaaaaatagagaattgtaagtgtgcattgcattttaacatgtctatgttcctgaattaagataaaataaaaatgaattgagcctagtttgattatttccagcttaatgtaggtgttaggtcataaacctgacaacttaagctgctacactgttctctaaatcttgccaaattcatttgcttcaaagtacaaatgatacatataaatcaaacaacagcattaaagctacactatcagaaggtatgatatcaaggccactaaacaacaaggttgaaagcatgagaaatcttattttcactaacttcctttaaaacattttcatagctttggcctctttattctttttaccagcatattatggtagtactttgtgtaaccagttaaatattttaaaaatattagacaaatggaagtgctgtgtaagctttaaattgtttttgttagaaaggcttaaagcaaggataagtgcaatgtagaaactgaggtcagtatttcatcatgaaagaagcatgtactttttcttgaattcccagtctttaagtgatgtttcagaggagtttattcattcctcgatttgtatgtattagcataagcctcacttatgcataatgagagagaaagacacctctttccttggtgaggaataacagtaataacttttagccaaccgtagactaaatcaacaacattgattctattacattatttaggtctcagactagggagatggccattgttcttgtataagcaattggtgtggtgcatgacatttctttggcttaacatttaatgaaatttgaataaggtttgtgtagtggttcatgcttaacacatttatacgaaagctttgtagggcagctgcatagcctgtaattactatgtaagtaatatgtgactatttttcttttggagacaagaaaagcttttcaattcaagtttaaatttatgaaatgctgtgagagctattaaaaccttcaacacagaagaagatatctgtgccaacctttcagtaaccagagatgagttaagggagtattttttccccttgccttgaaaatattttttaagtagtactgatatgcctctttcttttatttagtcttaaactcctgacctttctcagtaactacctttaatgaaattacaacagactcttagtgagttgtattaaaacattttctgaaaagatgaatgtttcagtttggtaggaagcatagcaagtctaacaataacccttatgctcaactagggaaaattatttatgtggacattttccatgcgaccaagggacaaaatggaaaggagtctacattatacatattagtgccaaactgttaattccttgcagagacttctgaagatattaccgtttcacaattgagtatttcaggaagcatactgattctgtgccaagtaccaatactgttttctagaagatttcaatacatatgtgttagggacaaaaatttcataacactaacgtgagaataaagtgagtaggaggaacaagcaagtgaaaggcattttatagtttataatgattatgatttttgaagcacatttttaaagcataatttaaatagaagaagatgcacttttgggtttacctacatttagtgagtgcctactacatttgtaatgctcattgcaagtttgaaaaagtaagtcgttttaaacaaggtaagttaactgttatcagttctttagtttttgttttatattagtgagattgggtgacgtgggaaagtatttacattccaaatacagtaaagaagtaaattggaacagctctagttattttcttgggtactgtctgtcttttgcaggcaaatatccaacattttgcttattagtactgtcttgatagagtgccttcaatacatcttttcacaaagtgttttatgtgatagaagttgtcagtatttataataaatgaggtgagtttccatcttatgccatgttccctcataacataggtttattgtatattttcgttatataaatatatttatgtgctaaagctctgtaaaaaagtatcacatgaagaaacattaacataacacaagtaacatgccataaagaaacagtataatacatttgtaaccaaagatataaaaataaattgaaatatgacaacactacaatattctgttcaatttaatattaatgagaattttaaaaaaaatccctctcagaacttgggtaagagttagtgtgattaatctaattgtgaattcttatctgtgcatgtcagcagagtttgtatttcatttcattattagcagtctttaaagaactgtaaacaggagatttaatatctctcatcaatcatataactttcagcatattaccattacctcctttatcttttttatttcatttttattttctaaactaactctaaagtgacactaagttcctcaataagaacttctctcttccacagccgagaaaggaatgttcataatagcttgtcagaagaaaaaggaaataaaatatgccatttacatttttacgtatgcctgcaaattctaaatgcagttgatggcttgcacatagtggatataattaatgaatatttcataaaatagaaaagggagtagagaataagagtttcaagatatatggagcaaaattctatcaattttccttaacccactgacaaaatttccttttctaaagtgcaagtctattttaagagagaattttcagagtttttagttccatgaaatgtgagatttgcataagcacatgattctttaagaaaagaaactgaatggaactacttataattcctttttttttttttggatggcatttttatacaaagtggctctttcttcttagccctgcaaaatgtgtttagattaattgtttggaagctctattgtttagagcatgtgcttctgggacacagagatgctgaacaggtgctcagctacccttaggaggcaatgggccttcttcacatacagtgtatgcatcaaggacatgggataatttgagctcctgataaataaccacactgattaggttggctggtaaagactgggcaagtgaaatggtcttagcaaaagaaggaaaatctaagaacaggagaaaagcaatgaagcaatgtgtacaaaatattgtaaatgacatctaaaaaatggactggttcctaaaagtcacaaatttaaagaaaaagtgtaaatgaaaaatctttattttttatgctatacagatgtcttatccatgtctgtctaaaaacaattggaaacttcatgagcaatgactgtgggaccttttaatacaaattacaataacatacaaatatttaggccattgccaaggggttttagactttaggccttgttctgctactgtttgatcatttagtttatttacactgccgttttctggaaatgatagttgacaaatttctctactgcaaactaggaatgtgatcttgaagaagctatttaaactctatgttttacatcctgaaaatatggcccagcaatgtggtaggactggtgattaacctatatttttactgatcttatagggtgaagaattatgccatccattctaactcaaagggctattaaaatgatataaccatttcaaagcactgtaaacattgtacaatggatgcacatacatggtgcctcagttttacaaatccacctgattggtggcatttattaataatgcagttaactacagggaaaaaaattaatgctaaaaaaatataaaatatataatttgtatataatgacacattttcctatctttggccatatgatttccatagaaacatatacaatattatttttaaataagtatcacttacgctttttttttttttttttgacggagtcttactctgtcacccatgctggagtgcagtggcacgatcccgcctcactgcaccctccacctcccgggttcaagtgattctcctgccccagcctcctgagtagctgggactataggcgcccaccaccacgcccagctaatttttgtatttttggtagaaacgggatttcaccatgttggccaggctcgtctggaacttctgacctcatgatccacccgcctcagcctcccaaactgctgggattacaggtgtgagccaccgtgtctggcctgcttttaaattatatagattcatttataaatgtttctagtgactttgccaagtctgaaagttgcctgcattttctacctttagtaagctatacattctcctggtattgtgtgccacctccagtgcaatcagtcacctgggttgagaccttcacatttcacacatactgttttgtttgtctgtgagtaataagcataaaaccattattataaaaagatgtgtaatgttaaaagcaagtatttagggaggacttaccatgtgccttacaatgcaataaatgctttttacatatgttaattccattatttttaaagcatagtattacagcataatattactcctacttgagggttacagaaacagaagcttaaacaagttaggtttttaaggccacatattaataagcattagggccagaactgaacttagaatctgtctagcatgaaatctctattttaaatgagagggcatgataattatatgattattaattatttaaggatttgagtcacctatgaattttatattttagatagaaacttagataattggttagaaatactatattatgaataactaaataaacatagtatacagcaatagagttaaggtaatttttagaccaacttcgtaagccacacataaaatgtcttgacattataaaaatttaaacttagaacagttcaagtttaccttcttggaaactgaagatatagattttgtttttacaaacaggattaattgacaactttcagagggatgacagaattgtagttttcctgtgttttcatcaaataggtgctaatagttgctgttaacacaaaactaattgccacctacggtggggagtgcaagttgcctagtcctgtgaccacattggcccatctgttaagaatctcagcttaggaacaatgctggaactggcatccaatttgggttctggccagtggtcaactaacaagctggaacacacatggaatatgaaatgccttgaagtcagagatgctctgctgtctgttaactgacagctcttgtgtgtgtgggcagagccaagaccaggtgccagtatgcagagcaaaaggatctgtctgtgtgccacctgtcattgccatgtgcgtaatgtccaaacaggagccacagtaggtgtgtttcttccatcaaagtgtggttgttagagcattcagttaggctgaggtagcgactagggcaacattttaccttaaaccaaactataggacaagccagaggcttaccagaaggtagctctcatatcccgccatatcacacaagtggatggagatttaccactggagacactctcccctgtacctaggttcttacattaactctaagcaaaaggtaaaaaaaaaaagttgtttaattaattatattaacacaaatacttgtgtgcacaagacaatttgtggttagaatcatgcaaataagttttaatcaccccaggggttattctaaaaatatatttctaactgatttttgttattattcttaataagttgaactgtaacataaggctgaaaggtataatagaatttaagagatcaatgttcttatcccagctctgccataattcatcatgttattttaagcaattcatgtaacatgtctgagtaccagagtccacatctgcaaactatgttggattgaatggtttcggtgctgtcctcaaattctgaaaaattgtataattctatgtcaatctctcgaaacaattagagaatcacggcaatattttttttcaatagaagaaaaaaagaaaccagaaaattgaaatagatggacataaagaagaaaattaatattacctgtgtatctattatccagtgacaactacattttatgtatagaaggcatcttgtaaacttatttatattttagacatatttttcattcaaaattgttcttgaccctgaatgcttacttaggcttttattgttaaaaagccggtactgattcaaaatagctgtttctgactgcattttcctttcccataaatataatattaataaatgatatttacacagtgcttactgtataccagaaataatctaagcattttacaatagtgctattttatttttagaaaatgctatgatgtaaacattattatacctataatataaatatcaaaactgatatgcagagagggtaaatatgccaacatcactgactatgggacctaggatgtctggcttcaaagtccacacttttggctactacatagtggtgctgagtgggaagaacttttcttcattttttatttgggattgaagataaggaaaagacagcctagcatatgcttgcctagaagtagaatttttatcatatagtcacagaatacatctatatagaaagcacatgttaaagttttgaaaatttttattataaggacacttatttcccataatatatgtttattatgtcaaataaagaagtttatgtcttttcctttaaaatcattattttatactacttattgacacaaaatttaaaacaaatctattttttctcatggaatgttttaacttgtattcttttcttctcaacactatattgggtaagaaaaaataatttcactggaaacatattagaagttaaagaagtgcttgctgaaagagtcaaatggtgtgagtagggtgtgattggccctctccatctatgggtgccacatctgtggatttaaccaattctgataaaaaacattaaaaagcaacaataaaaataatagaaataaaaatacagtattacaatgatttacgtagcatttagattagatatgataatctacgatgatttaaagttgcaggaggatgtacataggttatatgcaaatactacattattttatataaaggatttggacgtcctcagcttttggtattttcagggttgtggggatggcagtcctggaactaagccccagtggatactgagggaggactatgtatacatctagaatgatgaactcttctagggtattgatagtttaattcatctttcacattcactgtctaacaaagttctcagaccaaatttaagtgtactaaaatatggtaagtatagtcaataataacaattctatattttaaaataatttaaataatggaactggattgtttgtaacttgaaggataaattcttgaggggatggatagataccccattctctacgatgtgcttatttcccactgcatgcctgtatcaaaacatctcacgtaccctactatgtacccacaaaaaattttaaatataaattaaaaaaataataataatataaatggccaggcgcggtggctcacgcctgtaatcccagcactttgggaagccgaggcgggcagatcacgaggtcaggagatcgagaccatcctgactaacacggtgaaaccccgtctctactaaaaatacaaaaaattagccaggcgtggtggcggcgcctgtagtcccagttactcgggaggctgaggcaggagaatggcgtcaacccgggaggcagagcttgcagtgagccaagatcgcgccactgcactccagcctgggccacagagagagagtccgtctctaaataaataaataaataaataaataaataaataaataaaataataataaggctatttggaggaaaaaagtttcttcaaaaataaatcaataggtactaagagtatgatttttgctaatttcctgataatgtttgaatatcaatagttccatggatggttatgagttaacaggtaggactgagttctaggctatatattttctacccaataaatatttttttcatttttttaaaactatgtaatggtccctcaggaaaagttgtaatttgatactattattttaattaactggtatgaattaaaagagaagggataaaaaagaataatttctgagatccagtactacaattacatgaacaaggaacatatctttgttagtgtatgaaggagatataattgccaaatataaggaatgggaggacaaatagtttcaaagtatttcagggtataccctgatccccttcagtgaagtcatttttggggggatctctgttttagttgttacatagtataactcactggcgcttcattttaaaaggccatatttggaggtgggaggttagccctagggctcagtgagtccttgccgagaaattagaagtccctctgagaagtgattcatcatatagacctatgggataacatcataataagatctcagtataaaaattctgccagttattcttatgagcatgatgttaaaattacaaaaggtattgtaataccattcaactcattcatcagtatagacatttgaaacctttataaagatgatctggttgggtatgctatatcattgcaattctttaaataaatggcagttgttataaaaatatgtcctatttctgacacatggtactcaccagttaagacattcagtgcagtgcttctcaaaaaaaaaaaaatgttcaattaaacccataaacattctaacccactaactgacattttctaacagtttgtccaaatatttaccaccacaaataacagaaacaaaaaagtaaaagagacctgttatctttatttgagagagtatttaaaagtgagaaagaaaatgcttttgtcttcattatgaacataatttatagtaagacatatatatagttgattttctcaaacgtaaaccccaaatcgccagactagtcaaatattatatatcaagaattatttcaaaaataatcccattcattgaatattctgtgttgatatttcaaggaataaaaaaagatgagattgttctcaaggattttagtaggtagtgtgagatatgcataacattattaaataaggtgaactatatacaaactatgatatttgaggctctttatggcttcagaaaataaaagatagtctattcctatatgaaactagagataggtctgaaagggaaaattgaattttcataagtggaatagcaatggctatttcaaaagaacgaagcaggatgaaaaagctttggaaagcgtgggccaacaattagtgattcggtttgcctggaacatggaggagtggcacttaaggccacaaaggttagttgtggttctattatgaaaccctttaatttcaagtgaagtgtttatatggaatacaccataaaatggggattaattgaagcacattgaatagaaatgcatctttgtgtccacctttagaaaactgattctttcatgtagagtagcttggaacagagaaagtttggaagtaggcacacctggtaggaagctgaaatatagtttagggaatacattgagtgtattgtgtgagttacacaaatatggacattaatacaagtggtcatacaagaaaacctttttttttttcaattggcaaataattgtatgtcagagttattggaaaaagagaaattaaaaattaatgctgagatttgtaacttgggtgcctggtcaaaaggtggtgtgttcaataaatagagaagtcaaaaggtattattcagtctcatcatttttaatcatgtaatagtattttctatcactgaatccaaggtagaattgattgtgagatttagtagtattttttctctgagttaaggagaggaaaaatgaccaaatcaactatgatatgccatctatgataagatgattcctaattctggaggtgttaaaatataaaaatgtgcatcttaaaatatattaaatatgggagtaatagctaatatttacaagtgctttccttagaaataactcatttaatcttctcaattttcttatgaaacaggaactcttatcattgttatttgataaatgaagaatctgaggggcaaatataaatgagagagatttgaatccaaatccaaatccaaagcccactttcttgactactatatacagtaatttatttctagtaaaacatatttaaaaataatggcataaactaattttattttaagggctcactggctttctgcttagtggctacacaatatttttaattaatgcttccagcagccttaaagtttgagtcccttctttaaacagaggagaaaactgaaggttagagacagtgaaaaacatgctcaaggtcacaggaaacatggtaacaaaactggattcaaacctcaggtctctctaatattaaaagcttgtgctcatggcttatgttggacccaggacgcccttcattccatgtgttagtcaatggctggtgacattttgttttgtatatttctatataactttctaacttgaacaaactcatacagagtccaaagttcagtaaacagaaaataaagtgattcttctgctcaaaatatactgcgtggtgtcccagtgtctccattgtgcacacttggaacaactttctaagagaaagtagtgctcagatcatcattattataattatttctttatctccccaactccctttgccttatttatgtttaatcctaacaatcctaaatatccagtcctatgactgtcacatggtgctcacgagttagtcctttagtgcagtgattctcacgaggggcaaatttgcttcccccatttcctgatatacatttggcaatgtctggagacatttttgattgccacatttgggagattgggtgctactggcatctagtgggtagacaccaagaatgcggctaaacgtcttactatgcacaggacaactcccacagtaaagaataaataatctgacccaaaatggcgatagtgttgaggttaagaaatgctgatttcatggaaaaaatcaatctgggcattgctcaagtagttattttatgtaatttttattttttgtttttaatgttagggcaaaaataatagaatataattcactgaaatacacttcgaagataataatctttttttgttgcctgagatatgatggttatacaaaatgagataaatgaataatatcataatttggtttgatataggcatgtcatcatttaacacaagaagaggacctgttggttttctaatgatttgagatgaatgtatatttttgcaccttttctagaatatataaggcagataatttttcttcatattccttgcacatcagatagttgctgaattggcgaaactagtaaagaatatcctaattagagaagtgtctgaacctcattttcaaatagacctacaaacccacaagttatgtgaaacatttaatgatcagaagtgttcctatgaggttgtatggaattcatgaattattccataaacacatttcaagaggaagtttctcttggcaaaagaaaaaagaagaaagccttttgaatcttccacagcatctcggactgaacatccctctgataatgtagtcacttccccagctagttctcagtttgaacactgatgaaggagacttcttagcatttttccaacaaagacagcaaggtcgccaaatagatggcacattcggaaatacattttaccaattttaccgtgaattggctgtctcttatcacagcatttcttcttgcacacagaagactgcaagaatgggctctgcctatctaaaaacttccagtctgagctgtgagctctgtggattcttgtggatgtgatccctaaagtcctgtcctgaaaggacttaaagttgggttaatttctacccaaacgcacaactatgagctatatctacttttccaaatctaataatgcaatttctagtcctattgtaaaaccagttttgaaagtatttaatccagtaaaacaattatttctaaatgaaaggataacttaacttgcttccacaactttatttgttccagtaggaacaaatgttcttcttagttgttcttcttagttgtaatatatttgtatttttaacagtaaatttccaagttctacttattcaagaacttattgaaaataatacctgcaatatttttaaagtatttaaaagtaataaattcaggaagatgcaccagattttatttaaataatctatgaaaagttactggaaaaattgccaaaagagtgttgcatattaaggacaataatgaaaataatgaaatactcctttctgatcatgataaaccaaagaaaccctttctctataatctaatctctataatgctttggatttgatcttatatgaatgtagaaagaagaagtacatgatttcacaaagcacatatgtatcttgttctcagaactgcagggagcttcaataattgttctgattttcactaaattgaaagttccagccacctctatatgtctttctcaaaatgttgcaaagatatctttatatttgaatctctaatctttaaatatgtatttatatagtatatatatttttaaaatatatagtaaaatcttgaacgttttatatattacaaaaatttatataaaacatatattattataaaatgttgtaagctatatagtgaaagcattatatataaatgtatatattaaaggtttagagatttctatatatatgtgatagtataagataaatatatacatattaaatatataaatatatttaaatctctaaatgtttaggagttctcaatttagtgaaaactagaatgactgtagttgatattaaagttctctgcatttttgggaacaataatgtcattgttagtgataggtcagtgcactatctgcagctattcatagtgtaatgacaaacaataatgaccaccatgtcagtgatttaaaatattctaagtaaattctaaagttgtggcaagttctttgatgttaatatttgatataaatgaagggtttatcaataatggaatctgtttataatttttatcatatgctttttaacttaaacttaatttttatcttaaaatttttttaaaaaacaacatttagaccttgctctttttttaccgctgaagatcaaacttcggtttcttcatctaggcaacaggggtgcatgtgtgaggggagaaaatgtatttttttctcaactctcataagtttgtagttgggatagactgcttcaacaaaacacagattaacaagaggaagagcaaacaggtttattaatgagtgtagtgtatgtcaaaatgagagaggggtaactcaaagcagtggtttacaagtctggtttacatattatcttcaacaaagaacatcaattttagaaaagtgacaagacaaagtagtcgtaggcttcaaagacaggagaataggaaagagtcgtttgctcctccggtgccatctctgagctgatgaaggttgcaagggagaaattacagcctgtcttcaggtgggaaggtaggaaggagggtagaaaggccttttgtatttgtaaatttctgtcctgacttcagcaaacacaaaggaaaagcagcaagttcccctgcatcttgtcttccccagcttaacaatcccgcatacattagggtatggtttccttcataaggttttcaggttaaacaatagaacaaagacaggtgtgagcaaggatattctatttaacttatatctacctcgaactagaggttaggggtggctcctgggtcctgtgaaaaactgtgttaattgtgttaatattcagaattgggagggattggacatagagagaatatttgaagtggaaaatgatgaatagaagatataacttgaacaaacttagagttcaaagttcagtaaacagaaaataaagtgattcttctgctcaaaatatactgtgtgatgtccccagtgtctccattgtgcacacttggcattttgtcatgagcaatatttgatgccgatgagagactataaccttccccttcctgcacgtgtacagccttcgtttattccctcatcaacaaatttgtcacggctgcctactaggttcaagtaactgtactaagttctgaggatacagctgttaataaaagtgacagggtcatgcttttatggagattgaaatctagaggtataagtagatattaaattaatcccgtgtcagcataagcagaagtagttgggctaaagggagagagaggtgggaggtatggggagtgggccagatgtgaaggctcagcatatgcagggatgcaagagacagcccgagaattctggggtatagttgagtgctcgagtataggaggggactggtgaagtggccagagaccaatgaggatgtcacatatagactgagttcagaagtttgaattattccctgagccctccagagagccagtcaagagtgaattggagtttttattaatctactgtatatatttaaagaagacagtaaactgttatattaacataaaattggggttttgccaggcaaatggaacattaaagctatggaacaagataactgaagatatagacaagcaacttatggaccacgacatctaagcagggtagagaaaataaagaagatacaaagggttgatagacatggaggaagaggttcagtctgtgaactgaataagtgaggaagacacaaccaagattatggcaggatccgacatttgaacctcagatttcaaaggcagagccatttcaaaagccagagaggtcagtggccaaagagagatggagacaataatatcactggaggaggttataagaatgaagtgagttcagctatggaaaatgttaggtgacatttattgaggatttactatgtgccttgtgcaaatctcaaaatgtattgagtcattaagttcttataacagccctgtgagatagggcctgttaattatcattttaaggaagaagaaattctaaatatttcatttgaaaactggatgacatgatactcaatgaagctgaattttgttttggtttgctgtattttatatgcacggcagaaaataaatatctcattcaagtaatatttattgagtaattgctctatgtcagacacggagtaattgcttggaatggttggaggcgtggtcttcattttccttcttcctccgcctttactccagagggcaaaccctcagtaaagacccagatttgcattaaggcatgaagaagaaatatctgagaaagacagataagaaggacacttcacaaatcaggaaacaggtagtttagcaagcacagtgaaaaatcctcatggagatgaccacaaaaattttgtgaggggttattttagaggagatgaaactcatttcagaggaaatgaaatacaagagaatgagatgacaggagaagatggaaacttgggcgatgaacaaaaacaacgagctgggaactttacagctggccacaaatttgccaagaaaattaatccctggagcctcccatgtctaccatgggaatgtaagatgggagagacgggcactcagaagacagccacaggctacactggttaaaacttgaaaggagttctggtttagggtgagcaggatgctttgatgtctgaaagagcccagctgaagtttggtttcattgcccacactccagagagaggctctagctccaaggtggtcagtacccaaattccttggcatcggttcaagtcctagtcttttgggcctagttaccttatgagctgaaatctgcacttcattaaatcaactattgtcctgttgcggtgaacatcttttttgtttgtatgtcttcgcttagttttttagctggaaaatgccttgctctctcagctgtgctaaaggaagattagcataggggtttgcgtttttcagtcaggccgaagagagagccagtggtcactggaggatgaaggtaagcaatggtagaatatgggaagtcaagagaggctaaaatattgtttggtttggctaattaagacaagataaggatgccatcatatttcaagtttcattttggttttctgtagaggctttcagaacagaacagcaagtacacttgaatgataaccttgcttcttactatttccctgcaagtgtaacctcccaggattttttctttctttcattttacaatgaatgctgtgaaaatttttattttcttaaaagggtatccgtctctcatacttctctaaggtgccctgcccagaagttgcttgcaacctcatccctaagagaactggcaaatattcacctcacccaaactgtgaacattagcctgcattataattatagataaaaagaaaagtgtgacctgtggttgtctaaagattaaaaacatagactcagtctgtaccaacaaaataatggcttattgtgttcgttttggggtcttagacctcaaaggtgatttaagtaagagcttgcctttagaatacaccttaaatattgaagattaagaaagcatcatatggaattagattgccgagaagtgcttatgtgattcttaataggagtttcaagtgttgcctgtgcaaagatattacttgaaaaattgtgaatggagagagcattttagaaaaattgagcaacttttcctattttcagctctcaaaattgaaagaggtaaaagatttaagtttctgcaggaaagtttatatttcatagaagcgtgccttgaataaatttgtgagttactaaaatgcatgttttaatgtaattgaataacactgtcactaagttctagatggatgtatctccatgtccataacatggtacagtggaactgattagttagtttgtatgtataaaaaatcagtacagggttccataagatgaataagtgattttctcctaaaaattcttctgttgaaagtaagacattacactatgtgacattttcatagaaagctccatagtgaaattttcttgaattatggaactatggaatgcctataattatagacctttactttctgaaagagtctgaaaggtataggttgaccttcggctatttgaattgagtggaagtgtttcaaaaattgaaaacaaacctttcaagtctccttaaagggaaagaaacatttactcatatagacattaaatgtttcctggttcaattcatagtttttactattggccaacttaacgattaatacagcagatgcataataaaattttaagtgctaattcaaaacacttgttctagaattggagccagaaatcttataataagaagtagtaggtgatttcaaaaactaaacatgttgagaaaatacatttccttccaagaaaaacaaaggtgcttttgagatgagaatggccagtcaggaagttttatagagtccttacataattcaaacaaggtgatgagatacacaggcttgaactgagcatgataaaattccagttggtaataaaaattttaatttatatttcttaattttttcctcctcctaaattctgtgttcattgtggaaggcttgggagtccctaaattgtctgaattatattcttaaaagctagaaaatcatgagaagttcctacccttgaggcttaatgtgcatcaggaattgcaaagtatgagtaatgaatgaaatgtggttataaaattttgccagttttcaattcctgtttgatattttaaaaataaatttagccatataggaaatctttccactaggtaggaaagcaggtatgtttatgaggaaaaaataacatagattcttttatttaaatttggaaatgattttagagtgtagtactttttttcttaaaacatacttaatatttctcttttgaagtgcttttaagattattcatcaaatataagatcacacacaaacagaatgttgcatgcaaactgtgggttttaagtattaaaataaatttactttgttttgtttgttattcagctgaacagatggtaatgattttgacacaattcagttttcgttttctttttttcttccttgagaaaaaaaccctgcaaaaacacagagcttcttttccactttgtcacagctggttaccaatcaatctcaattcacggtacagtgatgatagcacacgttgtccaggggccaaatctgattgggttgcatttttcagcagtgtttcatatcagaaaaaataaggtatctctatggtggggactgtcggcacacgattgtacaactctcattaatcaaacttggcaacaatgactgcatttatttaagtcaaagactagcagatttcaaaatgaaaatcaccaaatttctgtttgaatttcctcatcagtaatgttttttcatctgtttctttttttcttggttttaattacagccaatgataccttctacattgacactgatcattacatatgatcaacctcctgtgttgatcatatataatataatattataccatgttacaaagtagctgtttcataccaaaataaactccacttattgaaaatttattctagacttcttaaagaatgctaaatgcaattaaaagcaaaatataaatacctttgattgtttaataggagaataattttaaaggaaatatacatcaggaaaaacatttatgaacctcccagggttacatttggtgttagaggaatattgagaaaaaatattgataaagttagtttctggaggttttgaaactgaacacaaagtcggcagtacataaatacctacttgcccaatgcaaatgcacacagagcaataaacacacacatccaatagaaaatgcatgctgctgtttgttagaaaaataaatgtacttataaagagttccagtcacttcataacttgagagaacaatgtcagcattttctgtaaaattgtgtttggaaacagacattttctctaagttatttactgctgtgcaattatatgtaaagccctgttgtacactataaagatgtctttaaatgtaaggaaatattatttataacttattgtatcactctgtcaatatttgctttgaagggagaaatgcatattttcccaattttccaatgtaatggttacaatgacattaatattaaacatggaccaatgtatcttgaaagaaatctaagaaataaggccacatctgttagacctgggaaaatacttgaaacctattagttttagggagcaaattattgtcttagggaaaccatgacccatgagggaaagcagagactggtagtagatagtcacaagagttttttccccaactataactgcctccatatgtggttttgggaaagaaactttgtcatgttttgcttcagattgcctacatgtgaaattagtaatgagccaactatttacattctagattttgaagttacttagacataatttctttaaaaatagtctttatatttcttaagcttttgcagataggagttaatctgatcacaattacaggcctatcctttctctgacctgagacacttaaggtaaatattcataaaggtatcataatttgattgagtcttccgggatttttgcaggtgcttagcgactgccatagtgggtcggtgatgttgggaggaacagtagtgtctgcatggtgtacaattgtattaggtttgttgagtcagcagagtgaggaagccgaaagagcttgtactttggagtaagacatcttgatttgaaaattcaaatctgtatgttaaaaatgtccacgttttaaattatgtcaattgtttaaataattttaaaatattactaggccaacacgcacacacacaactacaaatttatacaatctaagataaacttcagtacccagaccatgagacctgaattctagtaacaacagccattaaaagcttaactgtgatgttaaccatttattctttgaacccattaggaaaaaattctgagaagcagctactcttttggtagtatatcccctgcttactttaatttccttatatggattcatacatcaggatttttaaaaattgaatgcctatattgtcccttggtaaaaagctgggtaaaaatctttgtaatatagttgatgaaaattgcgccagaagacttagattccaatacggtctaaacctttgctaccgatgaattccagggcactggataacaaagaactatttttctaatattaaaattaggacattagactaggctcaataattttgaaattctttactatgtctcagaatatatgatctgttggtgtcttgaaataaccaattttcatgtattttcttattattgcataataaaagagtatttttatctattatcatagaggtactttatttaggctccatatgttctcttttaatatgaataatattggattagctgaatattttcatgttcactcattcatatcttcatggttttctagactttaatgaagttctttgaaattgttatttttacacatgctataattcctttgttaagaaacgaggaataaaattgaaaataatatcccaatttgtgctatgccagattttataaacatctaagaacagctatatggtttgctttcaggttgaattttgtatatgtacattttctaatttttaaaatgggggaaataatagcttcccactttacctaccagaattgttaaaagtataaatgaaagagtatatttgagaatactaggcaaatatatttttattgtcatattttattttcataagacatgtgacttgaaagctccctgccaaaataatgagcttatatatttgaaagcatggaacaaaacacaaagcttacattgttttctctcagtcttcacatttgttttatacattctgctaaaattatttcatttattttggcggagagagagaaattatttatttgttcatgttactaatttacagagggtaatttattaatgataatatgtaaaccatatgtgtagattgccactcaaattgccaagttatctccatatagctagtagcattaacgaattaaatattccaagttcttacattttcagtatcatatcaatatgaatttaagttacatttcagagctaattgctggtatataaacacaacattactatgcttcttgatacaatatcttgttatatttcaaattagttaatctctcagtactgcatataattgttgcactggtaaccatgctataaagaagtagaggagaatttcaagcatttgctgatgcatcatgatattttcaataagcattcattgaacgcctccaatatctcaggcactgtttggttagacttgggctatacagtttaaagcaagagagaaccagtcctcattcccatggaacatacatgctcttggaaataaagaagacaagaaataaggaaacaaaagatgtggtaaagatatgtgctttgaagaaaataaaacgtattaaaaagtgacaaaagaaagatgaaagcaaagactaaaaagaaagtaattttttaaaagtaactggattggtggatagcaactagaattcttaggcaggaaagacatgtataagggaatgatatttgggtcatcctgaaattcaaaaagggtcagccatggaaaacacaagggaagaacattccaagaatttgcaaaagtactacaaagacacagaactggcttcttacattgaacaagtagaagagaagccatgtgactggaaaatagtgaacatgaagtttgagagggaggcaaggaccagattatctaaaactttaaacaccgtaaataaataggttttattctgagtgaccaaatgagaagccattggatagtttcgaagagttcagtgacataatcagatttatgtttatcaatcagtaaatctgtactgaagctcttaattccctttgaaacccttacataaaataactgctgttacagtcgtcccttctgatttgcagttttgtactttctctttgtggcttcagttacccttggtcaactgtggttcaaaaatattaaatgaaaatgtccagaaataaacaattcatcagatgtaaatggcacagcattctgagtaacatgatgaaagctttcactggccagcttcattccaccaagacacgaatcacacctttgtccagcatatccacgctatgcacactaccttccagtgagtcacttagtagaacttctcggttatcagattgactgtctcgtgtagtgtatttgtagttcagtgccatctgtggcttcaggcatctactaagagtcttggaacattttccctctgaataaaggggattattgtacagtatatggttgctgttattaggaatagttgacctgaagatgagataattcataagaaacccaaaattgaaaaagctgtcttgtaggagagagagtatacttttctgtttggcacaaggagtagtactatcagtagtaactttgggaagaaaagttatcatatgttatcatatatagaagatcttctaatagagatgttcaaagatagaatagaccccttgtcacaggagcaagtgggaggactgattggttgcatgctgcagacaggattcaagtgttgatggacagttgcagaaggtgaacttttaaagatttcatttagcctaacgagtcaatcactttatatatattcaaagtattctgatataaatacatcacataaactgctgataatacttgcagactttcctcaggcaaagattcagcgagaaatgagaatttaaaagattgtgagcatttcaataactaagtactcaaagtctgtttgtttttaaattacaacatcccaatgtgatgggacataacaagacatgtattgtagcatttacttctagttggagaaagacaaggcatggccctgggaaatgtgtgttagctggagagagccaaggaggtagctctgatctaccctaatgtggagacatcatttcactaggctctgaatcctatcaagttgtgtatccccaaattttggtgcaatgcgtagatatgtcatcagcatttcttgaataaaataatgaaatgtttattataatcttttccaacttcagtgatcctcaaggagaaattaaaagatgacaatgataatgagcatctactaattcctaggaactatgctgggcactgttataggctagaccgttaaaaattattacccaaaacttctttttactccaaagcatacctatctcattgggaatggatttagttactttccgtacttacatgttttctaacaaacctggcccatgtcaccagactattggccttggccatagttttacaatctgtatctgaaaacctgttctataggtagaaaaaaaatagatttgctgttttattttaatggcacagtctctttgaaaggtagtctcttttattaattgttaagattaattcattttattcttcccaagtaatatttaattttaacttttcacaaggaaggtaatatgcaatcatagaatgcacaattacttttatccctgatcaacgtaccattaattaaaaaacaaacaaacaaaatcttattcctattcttgtttccaccttcctttaaaatgataaaaaaatctcaggaagtcagatttcagacttagtttgggttcaaatattatgtatttagtaatttttaaataaaaacttttaattttttttaaatttcaacctttattttagatttggaggtacatgtaaaggtttgtgacatgggtatatagtgtgacagtgaggtttggggtacaaattgtgccatcacccagaaagtgagcatactacccaacagatagtttttcagcccttaaccccctccttctctctttcctctagtagtccacagtgtctattgtttccatctttacatccatgtgtacccaattttcaccttccacttataagtgagaacatgatttccttcttttttatggctgtgtagtattccatggtatatatgcatcacattttctttattcaatccactgttgatgggcacctaggttgattccatgtctttgctattatgaatagtgctgcaataaatatataaatgcttgtggggttttttggtaaaacgatttattttcttttgggtatatacacggtaattggattgctgggtcaaatggtagttctgttttaagttctttgagaaatctccaaactgctttccccaatgtctgaactaatttatgttctcaccagcagtgtgtaagcattctcttttttccacagcatcatcagcgtgtgttattttttgactttttaatagtaaccattctgactggtgtgagatggtatctcattgtggttttgatttgcagttctctgatgatttgaataaacaggtttttttcttttaactaaagcaggagatcacttttacattttatttagcttccgtgttgtcttctgtgtaatgaatgtctctaatgtgaagtaaaattttgtcatatgctataactaaatatttgctgaatatgaaattatttttgtccaaattatgtacttatgtgtcttactgttttaagttagcatttaaaaattaaactattttcttgcagagaagaagtacacatagaatgagaaaagtgacacattcagagtcagggttttaattctggtttttctatttattgataacatgactttgaacaggtcattttatttgcctaagtgtcagttttctcatctataaaataacaatttctaattccaaataaggttttgcagatactatgaacaatgtgtgcaataattttttttaactggaggtaacatacaatttttttctcaatgaccaatcgaaataatatacaatataggtatcttttattaacttggaatcatggcttcacatatatattgatccagaaaagactttttagaccattaactttatctcccctcttgtagctcttgaaaaaactcagctatagggcaatgtagagacttctgaaagtcagacaacaagaataaatagctaaacagtggtcaagaattcaatgtttttagatgaattggaaatggctgcaaaatacagtatttaaatgtttctatcttacagctaagcatgtcatgcagttcataggctaactgtagaaaagattatttttattagacatcaaatacatcaccagtaacttttctgaggccattatcaaaataattgtttttctcacatttttactggcaaagttaaacagaaagtgtttatctgcatgcattttagcctagtacttgctctaaactatactcaggtaaagtaatttgaaatattgaagccattcacagttggcctttatatcagtaggaaacaagatatgtatcatgtattcaccactagtgtttcttgagctcctagtagtggaataataatagctaacatgtatcgtgctttttgtgtgcctgttttaagtactttatatgtcatttaaagctcacactcactccacgaaatagatgttatctttagcacttattttgctaattaggagatagagacccagaaaatttaagtatattgccaactcttacaagcacattaagaggccaagtccatgaatacaactctggccattttgctcctgagcctgtgctcttaaccacttgattttgctactggatgttaaaaactctatgtttgggagtgtggatattgcagtgagtgaagcagacaagatgtctgccttcatcaaaatagataacaatacaaaatgtaactaagtgcagaattattgctgtagcaataagttttcaaaaaggcagtaattcgatttttatagtatggtaatggatggcttcacaatgaaagtagtggataaaaaagtagtggataagttttttccctaaccacttatgacatatttaataagcagaattttaaggcaaaacttgcagacagaaaagtaaccatgataattaaaggatggaagagtaagggtagttaagtttagttggcatgattggtaaatagacaatgctttttctcatgtcaaggtctataaattaggactgtattagttcatgccttagcctctaataaaattaagctgggttattcttctagctaaatctagaagtagaagacatctggttatggcagttttaaatgcaagcctaaaatgtttgtatttgtcctgaaaacaataggaagtcacagctagttttgagcagacacaaccaattaaaatgatatttggaaacatggatctaactgtggtatgtatgaggaagagaagcaaggtggccaatcagaaactattgcaaaatgtgtgtttgaaataaaaaccacaggtaaatatcaggaggaaagatcacatgtgaaaaaaatgatagctggattatttagtttgtgtaattataatttcttagaattaaataagaacatattctcatgcaagtactcccaaattttttggtgttataatgttttctgacccacttttttagtctgtttcattaatgaaatggaggtaaaaccataaatgcacgtgaacgagctgaggatgtgcatttccaaaaatcactccaaggcatgttgatgtttcaggagttaatattccttatttaaaaattgattacatacccttaattcttttaactaatgcccattttgtcaatttgccaacaaataagagaaaaattttgttctttaatatatttcggctctctaatagccaaggtgcctaaaaataaatcatagtattgaacacaatgtgactaacaaactaatgaaatataactcaccaagaaactgagatgtatactgttttctttagcagtcaagagctacaaaataaaggtcaaagtgctaattatgcctttgatagttgcgaagtggaaagaattctatacatatgtgaagtataggtaactgacaaacagctaaagatcagatatgaaattgaatttattagcaatatctttaatctaagtaattgcactttgtggctgatttgtgtgtgtgtgtatttgtgtttaggtaaaatacagtataaaaagaaaaatgaagatgaatacttaatgttattatccgtatagctactactatttaataaaaccagttcattttctacacaggtatgacatcaaagacgattacacactaagaattaaaaagaccatgagtacagatgaaggcacctatatgtgtattgctgagaatcgggttggaaaaatggaagcctctgctacactcaccgtccgaggtaagagatttaagatgtcaaagataattgaaccaggagactaatatttggttaaattggtaagtgaacttacgatcaaaataatgaattatgctgttttgttgtactaaaatgcctagattttgtgtcctctctatcattagttgaaataaaattactttcaatatttggttcccaatgatgataatttaaaaagattaattcttatttaataaattgcttatatggtttaacgttaatagtttatatggcttaaaagtaaatcttaaaaatagaaaagatctatactactctttcatttccattgctttcaactacttactgcttttaaatgtcatcagtttcaaaagtactctcatgctttctgtttactagtttgtcactttatactagtagcatactgttttgaagtcctttttaatgtcagcattcaaaacagcaatctgaaaaaactagcaatgcttccaaaggtgaaaatgaatacagaggagctctccagccttgagataatctgatttagagactgatttgtgaagttcattggccttaaataattgaaatagtcagtgctgctcttgtaataactttcactttctgggtgtcatgcacttcctcagtcatggaataatgttcatttatagactccctggaattgcttataagtgaaagaaagcattacttaacttcacagtgcactagaataaattaactgtcttttcagtgggacttgttgatcacgtgagggaaattacatagttcaaggtaccaagtagtaccaagtagacactcacactaattcttgaaacagacattagccatggcatcatctacactcctagaaaatcaaacaaagataggcaagcacatcctttctcccactgctaactgtgcctccttctctcatccttcgtgataaagagattggctgcatgttttcatccaagtctcagttacatcttaccccatttagtcatacctctgacccttgtgcagctttgctcccaaagagattcagaaggttaggaaaaaggttcggagaagtttgaagttgcaggaaaggtgtgagggattctcaggttagtccttcgcgtggtaagaaaaaggatttttaccaggtttatgatttgggcttcaaatcatacaaaactcaactacctccaggttattattaggagacaggcattttgggtacctggaaaaatattggtgcttttcatactactcaatatttcaccaaatccattttttcttctgtagatattctagtgtgaatttagatacaaaacatatttagacaaaattgacagctagttgcataaaaacattttcattcttcattagttaacaggtcataaaggactatgatcatatatgaattgaatatatatatatatatggattatgtaggatgaaaatctgataacctttgtaagccaatgaacacactttatttaacccacactctacatggataacttcatacatttgtcatatgtttgctaggcagctttttgcaaaaacaattcactagaccaaattatccccgaagttttctttttctttttttctaaagtaaatggaaaataataataaacaaccaaccaataaatgctccatccgaaaaatatttgctgactaaacaaatggtgagaaaacgtgaggagttgtttgtttgtagaagcagcagggtttcttttatacttgaatgcttggatgagtgagacttgaagtggtctgtttgctttaagacctttcccagctaattgttttcataatttgctgaaagtttcaggcttaacatttcatttaacaaagcatgctcctcatgcggggatgtttgaagctaacttacaaaactaatagagagcattgtttgttttcaatagttttttttttcttaaatcagcaaaccttaaatagcctctcccctaatctgtatactgtagatggattagagtgtttattctttgtggtatgaatttatcacctctctaagactgaaacctcaaaaactgggtttaaaaaaatctccttaatgcaatataatgtagagtaaaatactgtttaaaaacatttattttttaccattaggaaaagcatttgggttttctcatgctaagagattaacaggaaaaaaaagacaacactgttatctacgacttatttttttttctttgctaatttttctatgcacataaatgaaatgtgcagcctttctttggatcgttttattagaacagggtcaactgacccaagaggccatgcccattttcatccatttaatgcagagacacagttgtgtttaatttgctgattttgaaaacatccacctgctgtttttttttttttttttcaagatgaaatgttgctaatgtaacaaggacaaaaaaatgtattgtgatgtttctgctaaaattttatcataacattcacattagccaattggggaaaaggtaagagagtttattgtcaaaatttgaaacagatctactcagttatttcccatttcaaaaatatgctttaaaaaaaaaaactataaattgaggctgaacatcaagaagctccctttgctgacttggcaaatgtaaaattaggaagaaataaagccagtcaacaacaaacctcctagcattttcattctaatcaattaatttattattaataaaactttttaaatggcttaaaaatgacaacacaaactgcgtatttgtaagcacattttacccatttttaattttttaatttgctttgcataaagatctcattggaaaaatcatattgtttctagagcattaaagccttaattttttggaattattctataataaaataaaatagaaatacattttatttgtttaaaacatgatttctcaccacagtttcttttttttttttcttttgtcaatatcctacactcaaaacgcctttttgtttctgaaggaaacattatgttttaaattcacttgagatggcaagctgaaaagtagcaaattcaaagatgaaaaacaaagttctttttctactggacattttgcaaaattaagagaaactccatctgttagaataagccacaacttcacattattagtctgttatctctttttgatagtcaatcttgtattctgcccctcactcccctgcaaaaagaaagaaatcgtggtacattgggtaactcactcctcttttcctctggctatagcaaacacaccctatatgttaggccacattagggttccactaaaccaggcttttcgtaccactgctacaattgccttattgcctatggtctgaagcttccctgttttaattgtgaataatattataagaccatggctctcatagagatggattgcacaaagctagtattacgatgtatctgttaagtgaatatgtgtaaatatgttttcaatggctgttcctatcttgcccgaagagccatcatcaacacgaaactattggtatgttccagagtcacattacatatgcactagagctgtatctactaaggtatgggcgaaacactgttgaagaaattctatttttaatgtcagatttcatgaaatttcatatactactaagcatattgtttcttcatttggataatgggatcacatgtttcacaatatttgtctattgcttttgtataaaatggtttaccgtctaaattgatagcgtgttattcatttttaaaaaaggattatgaagcccatgtgtatctcttacaatttatttgcattaataacaggggcagcctattaccactgattttagtgattgaaagttatggtataataaaaaaatgataatttgttgaagcagcagtttgaaagccgttctcagtgtgaacaggaatcaacttgtcagtcattgtttcctgccctctgccagaagaagaaaaaagcttaacagtagttagggagctactgagttgaaatctctaaggatgttccaacctatctgttatattttcatccaccctgtccatggatgaaaagtgatgtaatctcaacttattactgactgaaaagcagcgtcaggggcttttctgcagtccttgtaatggttctgactaaccatgcttaaaatccaattgctatttaaatcagacagcgaggccttcttttattgacatgacatttgctagtctgtgacttgaatagttatattcatcaggtttttaactttggggtaacacaagactgtttaactcaagatctttgaaataataactgcagtaagtgatgatgataagactttacctaaaatatctctcaaattgcttacagtcagttctcaaagtaattattttcctagaattatatttataactctcaactttatcagactcagacatcttggtcatacttgaattgtgagactagaaatcactctattgtccatacttaaatgtaacattacacatcatgcattctgataatttttctttcttttttttaatttcttttttatgttctcaccacaccattgtaatgtctacagctcgccctgttggtaagtagccatccttctatccactaagcatggctttgcacagtgcttcataactcatgcatagtaagatttgacagaatgaaatatatttattttacccatgttaaaataatacttgagactgtatgctgtaaaagttgctcatgttttttttactcactttgataaacaattttgtagtgacttttgctacatagcaataagtaggtaacaatttttatgtaagagaataaatgaatgataaatgtttatgaactgctagcttttcttataggagaaaaatatattgtattaggatacaataagaaagcattgctctccttttttgtatgtataaaataatcaattattagttatgtttgatgttaagaaaaaagttatgaactaaattaaaaaattctacgactttccacacttcttttaagttactccgagtcccagtattttagggatatttttagctgctgcatatttattgcctgcatgcctatttaaacaaaattaagtaaaatgttttaagtagatgcttaccctaagtgggggagggatagtggagctgtgttctttggcatgaaatctgagtgtttgtggttttaatatatcttatttttcatttggctttgtgaaatctaagtaagttaacagcttgcttttgcagatatttaagtggtaattatttgtaaacatttggaagataaaatttttcaattcattgacttagtaagctttctgcatctcttttaagcttaagtttaattcaccaataactatgtttaaataaattttggtaattgtgttacatgtaaatgaatagatggatgcataaatggatggatgaaagagtgaccaaatttagtacactgcttctttaatataacaaaaaggtactttaataacaacttattcaattttgagggctttataaattgtccatctagcttcaaaagcttccttcatgtaccagcttgacatcattgacacctgatatatatgttggttcagactcacacatttttcccccttcggttgaaagagtcatggactttgttgctagacagtatgtttttacattgtcagcaaacacggtaaatatactttggtttcccaatctgactttctgatctggtgtttctgagcaatactcccttttgattagtaatttaatatcccttatcctcagtgacctcctctataaaatggagagaataatactgacttatcaaagctgttgcaggaggggactgagtttaagattgattttatatgtgaaaggcattctgtatgccaatgttggtagctatcgtatgcctagtttctgaggcatgacttcacatttcaatattttttaaataaagctatggttcacaattaattgaaacataaactgcagggtgttttttgaaactgatgaaatcaattgtggtttgtacaattgatgtttgaaaattgaagaatatattgtaataatttttaagccttattttcttgtatttgtagggattcctgttaatgataattttatgtatcttttgaatgacacacaaaattaagaaaagaatgagaaagaataagatgatgcagcaacagacaaagaaagagctgatggtagaatacatgaccactctcagatttctttttctcaacatctgtgagctagttttcaggttcagaaattcactcatttatgtgtcaaataagaaagcatgttattacatataataaaataaaataagtggaaagatttatatataaattatatacaacaatgatatagattatatataaaataaaatatatgaagtggaaagattgagaacgatctgacactttttcagatgactatggaatacaaaaactttgcaaccttatttagaagttttttaaagatattaagcattacagtatttataggagatatgaaaatagatgaatgattgaaaacatttctcaatagaaaggatgacagtaggtgttaaaaaatacaggttggttttgcatcggcagcagttgtacttataagctaatgacttttcaaatgaaaaggaaaaatcaccatttaaagtacagatctttgtacacagaaacctcatgccaatataccatgagcacttgatttatgttatagaatagtatgttaataatttccaatatatttaaaatctttaaatgtaggaaaaagtacattgatttgaaaatgtgatatacacagagtattgagatgtatctgtcatctgcaagatgtttccaaagttatttccattttttattcccgtttgaaatgatttcttaaattcccattggactggaactaaagaatagcttcttgacacattgtactttattctggggaagtctgtcatttcataaatctatctcaaatgacttatgacaatgttcagaaatataaagaactatactttaaacttgacaactactattaattttaaaaactgaatgttggatatgttttaattggatttccaaagaagacacataataaggcaattagcctcattttttttgtatctacttcttacatcaattttaattcaagaacatagatatctgaacatttattgtatggtcaaaaagtataagccaagtaaaataatgattacatattaaaatcatagaaaaactacattattatttatatttgttaatgcactaaaaagcacatttttcaactttgcagctcttagcaatagcataaagggcattctgcaaggtagaggccacagaaaggggagaaaaaaacagcttgtagttccaatataaattagatgaagaaatatgtaccaagcatataacgtttagagaaatttcagatcatagtttctgcctagagcttttgaatgaaaattagcaatcattgcagattctggaatacttagagattcagaaaccctcactacattactcactggatgaaacttcttgatggtctgtgtagaaagccccctttagaaatcattacaaacccccaaactgagaattttgtctaaatggatgactcttgtgcgatgcatttgtgttaaagaatttgcaactccttgcagtcacagttggaataaacacctctggcctgtattcagagttttcctctaggtgaacttagaggatgctctagtgtgggaggtattactgaaagcggacgttcatatacttgccaacagaggaaagtgttttacagatttcacttgctcatctgcagtgtcaccagtgggtcagaaagagctctttaatctaacgttcatatttgctggttgccacaaaatctaggcaactatcactttaataattaaaaatccacaagcccttcctgtggttttgacgttttactattccaaaggcattctttatatgaaaagaaaagtacatcgtaggatgtagttaactatgaatgctgaaatattcatttgtttatttggaaaactcttctgatgaggaaactgacagaagaaaatggtctaaattgggaaaaatatcttgcttcctatacccatctgtcttatttttctattggaagcctctcccaagcctaaaaataaaaaaagaacatctattttggagatgggcaccacattttttcccagcagcaactcaaaacatgatgagtaatttggaaaggaactgtggaatctaccagatgccttgcttacgaagccgtcctgttccgtttggtgacttgtataccatatgctagatgctgattgcctggagtataaaactgaaagctgagtacttcacgtgaaacttgtttaaaatatcaaaaaacaaactgacaattcacaacttgatggaaacttctaagtattttctaacttagtgacccaaaagtatgcttccttttgatggaagaatgtaattggccacacaagaatttagaagtaataagaagtacacatgctttttggcaaaattcaccatttaaaaattattttttaaaataagcagccactactctaaacagaaatctacagggacattttttttttaatgtttcaactgcttaaccacagtaattaaatatactattttagaaagttctgttttatgagtcgaagcaaagttttgttaaagcatgtttgaaagcagtctattctgaggccaccaagaagtccaaaaaaaaaaatggtttgtgattgaaaaattcattcagcatgaattataaatctgacattacttgaagaataatgtaacaaatattttgatacccccatctcccaccccaacttgaaatttggaaaatataatgtgctgtacataattggatattggaaaatcacagttttttaaaataagaaaacttaaaggtattatgtatgaaccttttcatgtttggatgcactttttgcaaaagatgttctaagtgtaccttgaaaggagacctagaattttgtttcttgcatcccttttctttggacaagctgttaccccatgacctgaggtaatcatctccctcctgagagctcttaatgtttcctgcacctggcactaattagctactttatgcagagtcccatttacttattattaagcatcaggttttccgttgctccatatgttttgattaaatggtaagtttaaaaaaggcattctgttttatcttctatattccaactgagtttccataatgtgaaacgtttaaaatatcttaagctaatgttcatttctaaagtgaaacacaagcgcgggttacttctcaggctgagctggttctagccttgtgtacttggcaatgtctgtccattgaacaggaggagaggctgggtcttaaattactctcacacttctttctttttttttcctctcagaacttggtaaaaatgtcctattgtcttggtattgaatggtattatagtgtagtctgaaacttaacaaaaaatatatttttttcttggctgggattttcttttaccatatgaatatgcatgtagtcctttctttcaagtaactttgctcagttatatcttggtaatgatcatcctgtaggtaatatttctaggacgcaacaagccacttgaatctgccagttctatgctttaacttgctttatttcaataaccttttcttctgttttatctttgaattttttttctgttttactttctcatttcttcaaattatatttcttcttagttatattggctttccttagtctcaatttcacatttatcaacttctctataataatttcaatcatttttatttcatattgtatgatttctcaatgacaatataccgcgtctctaacttttaaaattgcaatcattatatatttcttatttctaaaatatattctaatttttttgttttttgttattttcttgttaagctctaatataaaattctttatctttacttgtcttttagcctttgtaacccttttttcgtttttaaaagagagatttcattgtatataatttcatttagacgatgcctaagttatttgttttaaattgtttctgtgtttctttgagtaattcttggaagacacaggttctttatctctctttaattaattatgttcattttctgtcatgaattaaataagtaattggttaatatacaggtttttgttaaatttcgttttgcatagattttgttttggttcctatctgattattcattttctggttagctctgaagactagagtttgcatatttggagaagagaaaatgtgaagtagcagggtaattcaataacccttatttagaatgttgttttcaatatcttactaaaaacatactatgttcttctcagtattgtactaggcctggtgatacagaatcaccctttttaagttatgaggggtgtgcattttcctataagactctctcctcatcctcctttatactccctgcttcataataaggatggttttcaggtgtgtcagttttctattgttgcataaaaatgaccacacaatgagcaatttaaaacaatgtcattctataggtcccaaatgcaggcagtctcaacagtgttttctcctaagggtttcacagaccaaaatcaagatattggccaggttgcactctcctccggagactgtccagaggaatccacttcaaagttccttggggtgtttttcggaatctggttccttgtggttgtaggactgaagttcccatttccttggctgttggacagggtgactcactgtgttaagtggctgctcttcagccttcgcacattgctgccaccacaaccttcatagccagcgggggcaccctgaattcctcatgtgctttgctttgtagctctccgaggcctctttctgatttaaagatccagagtattaagtaaggcgcagctgatgaatcaacccattctgaggtcaactgattagtaaccttaagtatatctcaaaatattttttgtaacctaatataatcatgaaagtatttccaggaagggcaagcctgaggtcatggggcctcagaatgctgccaactacagtaggctttttttttttctttctgtcaatacttctttctccgccttctgaattttagcttattttctacagttatgtctcatatttcccatgtctcactcttgactttaagtatcatttttcccataaaaggatcatgggatgggctctcacaatgatgttagataatttttgtgcaactggtattgataaaggattaaggctagttatgttggtgtccagtgtgcatcctcagctttcttcaaactttgctgcatttggcaggggtacttcataatttgtggttttggggctatagtagttttttcttattattcatttcttttgttgtactcaatacaggaaagtgaagcctttactcaattatcttaacctaaacagcaaaaagtttgaataatcattatttttggagcctattcaaataagaataaaataaatattaagtatttctaattagtacttaaaattaaagtactataaatattaaatatcagaataatataaatacttaggcccaaaacggtatgaggagattagtattaagaagtttcactggctgtgtccagaaaaaaatcacattaactttgaattatgtattcgaagaaagtcagaattttcataagttgctgcactttgtagacagggatgtcatgatacatatactgtaaaatatatcttatgatgtgtgttacacctacatatgcatgatatttgaattgctacactatttgcttaaacatattaaatgtcactcaagggaatagtacataattagatttattaaaaatatataaactagcaaactatattacatttttatttcaaatatatctgaatgccttttaaaatctcacttatggcaagtattgctttccagatttactgaggttattattttcatctcccctacaaaactgttagctctttgtcagtaaatacattgttatatttatctttctgctgcctctaggtctagcataacacttacatgtggtgggggcacacaaatgttggtgcagttaattgatacacgcatatgcatacataggtagtacttgcctagaaaatgtttatgcaagcagctttaaatagtgctataaaaagattaagcaacattaatggtaacaggccaatcacatattccccattctgctggtagcagataaaatacaacaaaaagaaggcactaatgagctaggatggtgacttactaagcgtgtaattaatgttattaagaaacattgcagttgcatattaaaattccgttaactaagcaacccttcagcatcagtacatttgttccttggtttcaagtttttctttttctttttctttttttttttttctgattggcatcttcatgcaatctttctctaaaaaatgagataatgggatgtgatcagccctcgtggtttagctggagtgctgacatgacagttctggcaagttgacaggttaagtgagtgaaaatggatgtcttgtctcaccatttacttgaagagccattttaagctatagtttccctctctttactcccacacttacaactccttctatcccaggtatgagaagtcaagttttcccaatttaggaatttaggatcttgaaagaagtttttcaccactttaaactagtcttcttctgctggtcaaaaatgagatcatttctttacaaacaaagagttaatttctctaataatgaattcgtttttaagttaatagcactttttatttcatattaagagtcccttaaagaaaacaaaattttattgttttatttttagtattttaattataaaggcaggtagaaaagcaaagctacaaacgcactggtaaagtacagaataatatgggacaatggaatttaaaagttcagaacttgtttaatattttgacagattttcctagggatctctcaatttatacctatgtataatttaaaagttctgtgaaacttgcatggcgaatctcataatgatttccacagttacatgatttcctatagttacctataattaaggaaatctattttagtaatctgaaatataataaagtttaaaattacctgcaaatgtacccaccttatttacagtgtgagtaaactattactattgattgcaatgtagaaatatttaatatgattataggattagagtggacttgctaaacccagtaaagaccatttagatgaaaaaatacatggttccacccctacaatccctcagtttaatttctgcctggcaaactcgaactatgagcaagttcatagtcgaactatattacttgccggaggccttcaaatacctaaactgactcaaggagcacacccatctagactgccacaggccacaaagaagcaggtggggggaatgtgccttaaagcagtctgcaaaattcctgtctctaacatactgcctttgttttcccctctgggaggagcactctcccacccttccttcctttccaacttaatctaaaagaacaaatcaaatttgtttctctctctctttccctctctctcttcttttctctctccttcttttcttctccctctctccctccatctctttcctctttttcttcctctctctctttctctctctatggtttctccagctgtagaaggccaactgagtcaagttactcttttgcttagtatgtattgtattacaaccttcattgtattgtaacatgtcacaacacaattgtaaaatgtgttgtaacatgcttgattgtttccaggaatgtctcttgtggtaggaggtgacttccacaggacagagatcttagtaccctctgacagaaaagaaaaccactaatgttgtttaaaaaaataattggatagtattatgaattgaattgccatgcaacatctgaattcatttttgtagaaatttattactgtggtacgttccagtaatattttgccttcaaaaacaaaaatataagtgtgaaggcactggcccaagtataaaatggctatgtgcttatagctgttcattacaacactgtttttatgtgcctgcttatgagatctaaaaatgcaagacattttgaactgagttaactcttttcagaagcattctttccattctagattattgtagaattatttcattttgatatttacattgtggcatttcaggcaggagcacattatgtgtgactctaagtgaaagcaaatggtttgaaccactttcataaaacatatacatattttgtggggggggggtgtattacacttaccaaaataaatccaatgcctccttggaattgcctttacagttgcaacacatggcaattcagaagccacttctgttattttgtcgtcatactatgtaattattggctgacttcactgcctttttaagtaatcagattttgaataattgagagttttttttgtggggaggaggttctgatattatatgaaccctccaaaattaatctcaccatcaacaaattccaagactgtttctaaactgtaaagagtaatagctgcataatagtaacatgttttgctcatacaatgaatgaatgtaatttgtatgtatatgtgagacctctcatgggtgtagagtagaatatgaagtctaaatagatgaggaatctaaggattatgactcatggtagtcattctattctctttgattattttttcatatttatgagagcaatatatcatttagtgcttttccttttcattttgacattgaagaagcacatacatatatatgcttattgttgaaagaaaaggtattattgtattagtctgttctcatgatactaataaggacatacccaaggctgggtaatgtataaggaaaagaggtttaatcgactcatagctccacatggctggggaggcctcacaatcatggcagaagagcaaggaacatcttaaatggtggtggcaagagagccctttgtgggggaactctcctttataaaaccatcagatcttgtgagacttattcagtatcacaagaacagcagggtaaagaccctgccccgtgattcaattacctcccaccgggtccctcccaagacccgtgggaattgtgggaggtacagttcaagatgagatttgggtggggacacagccaaaccatatcaggtatagacattggtattttactatggaataaggatttttattattagctacaaggaagtagctggtggcaaagaaagtgtatcactcatctaaaggatttattgccatggactcaataaaaaacaaaaaaaatagttaattagaaaggtaggtaatttagcaatttgatcatttacttttttttttttttttttttttttttgagacggagtctctgtctgtcacccaggctggagtgcagtggtgcgatctcggctcactgcaagctccgcctcccgggttcacgccattctcctgcctcagcctcccgagtagctgggactacagtcgccgccacgacgcccagataattttttgtatttttagtagagacggggtttcactgtgttagccaggatggtctcgatctcctgacctcatgatctgcccgccttggtctcccaaagtgctgggattacaggcgtgagccaccacgcctggccaatcatttacatttcttggaaatagtgacaaatgagtaaaatgtgattaagtagtctctataaaagtgattattttaaatcctatatttctaatttatattttctattataaatacattgcttcctctgagatgaattatgtgttaataagcttcaaatccaacatttccatggcagtgtgtatgcatttccaatattattaacagaaaatcttttgaaatcaaatgaagcattacatagtaaaaattaaataaaattaaataagttgaagaaacaatcacgtatcaattagaacccaaactgagttgaatataaattgagtaaacatttatctcttactactggtctataattgcattgcaaagaaacgatttctcactctctgtttcttgttggtggaggcaagcctattaactaatttttgcagaaactttttaattttttttcttctttttagagacggaggcttgctctgtcgcccaggctggagagcagtggcacaacaatctcggctcactgcaagctccgcctcccgggttcaagcaattctcctgcctcagcctcctgaggagccgggattacaggcgcaccctgccacgcccagctaatttgttttgtattttagtggagacgaggtttcaccatgttgcccaggctgatctcaaactccagagctcagacaatccacccgcctcggcctcccaaagtggtagaattacaggagtgagccaccgccccccggccttttgcaggaacttttaaaacccattgttacacaatgtctttatttgtctgtagtgcttttgttactctggaatgttggctactcatttataggctttgggtcatacattttcaacgttgtgtagcagcactctctacaaaagggcgtatcagaatcggttagatttgtattcaggtaacatacttgaaacaacacatatcagaatcgattagttttttttcaaatcacatatatattgttttcaaacactatatttactactgcaatagtaagtcactgtcactggtgggtatgtgtataggtataatggaataggtataataatgcagatatattattccttaggtataatgagatggaaaaaatattgagtatttgctttagatcaagaattctgttctttttaaaatgtactattccgaggcattcatttagtgttcactgttttgggcttttctaggtgaaaaaaatataccatttatatgctaaattgtagacagcaccccataccagtaaaatcttcaaactgaactaaggaagtcagacatataggctggggaaaaatagagaaggcaatgcaagcaagagcaagtaccttaaattggaaagaacacaagacaagcacaaggtcagagattgttcaggttaatcattgttgacaaagaggaccaaaggataattgatatcggggtgggttaaccacaagaccaagcaaatactagtgattgaaagtagactgctctgctgaaatgctggagctagtttggggacaaatgagtgtcaggattggaaaatcttagatcagctgatggaagccagaatgctacacggagaagaataatttgcaagcattgctatggtaagtattgtaggtttcactgtgatgcgatgaaaagcactataggtttatgaataaagagtgacttgaaggaagtgtgcttaagaaaggttatacttacaggtagtatagaaagagaaaagtaatgggttttatgctaccctaataataaaaacaatcattcagaagaaacgtaatgttattattttgcaaatctttgtagcatattggaaataatagcgttaaagttctatcattcttcttcgtattagatatgacaaatttttagttaatcagatcttggttcgaacggaaccaaatgaatctggcatctcagtgtttaagagttcctactgtggcattcgaataagccagaagtcaaacctgtcctccaatctaatttaactaagaaagctgtatttcttgcatgttgtcacttataagtggaagctgaacaatgtgaacacataggcacagggaggggaacaatacacactggggccagtcgggggcagtgggggcgcgcagggggagggagagcatcaggaaaaagagctaacgcatgctgcggttaatacctaggtgaggggttggtaggtgcagcagttcatcatggcacacatttacctatgtaacaaacccgcacatcctgcacatgcacaggggaacttaataaaccaaaataaattaataaagctgtgttactcatgccctgagtaagattcagtttactggttttacatcattatgatagtagttgaaacataaggcttttcaaatattaattgagataatgcctgtggagggtttaacacaaaccctagcacataataagctctcaatgaatgttaattattgccattctactaaacagtttgtgactaagtgaaattttaactcaagcatatgaaggaagagaatgcttcttaaatatgcttatagaatatgttagtatttaacaagtaaatatatgaaatagcaaaaaaaattctacttgagtttgtcaaaaaattcgaaatggcaattatagaattaaaagtttattcattcaggcataaaattatatccaaagaaaaagagtggctgagcatgactgtattcaccctgtgccacatatgaatgtacgtagctgttgcatgactctctccatgctaatgcctgccataggaagtcatattttcctgttaaaacaactctgaacatgatgtgattaacctttagagtcccccatcccctcatctcaaagcccaactcatgcacggcctgtgcttcctactcatgttcagccatctgatttccatgtcacccactcactctcaccagcaggcattagcataacagagctgcagcgtgactttgattgaagccagcttgggctgaatgcagtatcaaagcatcatttagcagaaatcaaatctaatttactgtgcattgtatttaaattctcaaaacacagtttcaagtgaactgtcccagacctctaatcttaattgacctttttatatttgggtctacttctctggaaatcacacaacatactttccttatagagctattgtttttcagcttgtaagtgttgattaaacactaaattgtgtcattctgtttgcttcgtctcatttctagttatagctgaagcaataaggtataatcacgtgacagattaagcaagtaggatattacatcatagttaacaaaagatttttccaatgctttcaggttttagacagaatataagtatatattttatagtcttctgtctcagagacatataggagaattgccatttttataacaggcatattcttctggagtttataactcaatctctttaattcacattgggtttaagcatgtgtttggaattgtcgtcttgaggacctagtagttttttttttaatacttaatgggagtcattatagaaaatctattttatgtatagcacactttgtgctattgtgctgtgttgataaaatgccacatctgtctactccctctctttggtgccatcagccaaatactgtcttttcagaccattttcactgccacctggcagagacactgaaactgtggagggttattagaagaattattgatgcagtttttcatttaaaacctcaaaaataaattccttcagctgatatcccttcacagaagattgcaatatagatctagggcagacagagagtctacaaaagtaaaagtgattgatgcaatttgtttctttggtccaccttcaggtgataataggaaaggatgtgtattttcacagacttgaatactcttcaaattttttgctttgataaatgtttccattttttcattttttaaaattaaaatatgattagatgattttagttccagcaagatcaatgtggcataagttctggtgacaatagtctattgaatgcatttgaaatacaacacatttccgacttggagtaaatgtacaatatacataaacatcacgtgataatatattttataggataaataacagatgctgacagttttttgttagtggtctttaaaataatccagtattgggtaaaagttccagaaattataatttcctgtcctttttagattataccatcagtggtaaatattatgttttgattttgcagaatttctttgtcctttaaaagccctgatgaaatggtatctttaggtgctactaaaaataaaaattctcaactggattctctgccccaacttgtgaagatttgccagctctttgtctttgctctttctctaatcctcatctacattgcttctaaagcaccctttccaaaatataaatctgattatatctttcttacaaaaatgtctttgaacagatctttagagttttcagaatgaaatgttacacttgtttagcagaaatcatctgtccctatctatatgaccactgtgacctagatttcttttattctcagaatcttttacatgcccctaaaaatccagttcagtgggtctctgccttatgtgctgcttctctttgtcccaagtcaccttaccactcttcgcctagtcagctcttagttgtcctccaaagtacagctctaatgtagccatgccctagcagcttttctctttttttttctcacaacatggcctgattggttctgttccactctttctcccccagtgccatctgcattttttctgttttcattgaaaaaaatcacattttgctgtttttgtgtatttatttatatatttacttgtaagcctctgccacagggcaagaacaattttatttggcttcccatctcctgtaccaaccagaatgtatcatcatttttcgtcaatcagtacattttgtgtgaataaatggatgaattatgtcttttcagaaaagtggatgcatagatgcggtcatttgccagtccttattttgaggactatattttagcagtggtgttaaaatcgtattatctggatgccaaaagcattttgcaaaatcactcatctacaaaaaaaatgtttcaaaagtttgaaaattaaattcttggaagtctgtacttctaaagtacacatggtaattttagtgatagagatttgtaattttactggatagatgaagaataatatgcttaaaactatgaaatacataaatatatgttgatatttcattgatttcatttgatgatttcaatcacgtttattctcagttaatatattttaaaagtttgtaaagaaggactgtatagagtatccaggactctaaggttttactaactacttttgtgaggtaatttaaattctttctggcccaaagcagtacaaattaactaatcagctaaataggtgatttttattcaaatcttttaagtgactgattttgaccaaactgagttttgagtttttaataattttcgatacatgctaaattattcaacactcctcacttggcaagtgtccatgttggcattattatttttctttataggatcacaaagagataactatatactcattcttaactttttcataacaaatataatttttctacaagattgcagatgacggaaacaaaccttaagtgtttttttttttttttggcacaaatacctggtggtttcacatttctattgaaaaaatggtcactgcagtgttttaagagttttctctaaaataattttttaacattgatttacaccatcatttctatgagaaaacatggaacaaaaatcaatgtatctgctgattcgggagaactgtgtggaaataacaagaagattgtaagaagcaactaatctcctgaaaatacaaggcaacctataccacgctctgttcaaacagattcataaatctgggttttccatactgctagaatgagtcttctgttaatctatagttatagaagaaaatgtcatttagtagatttatcccatctgtccctgggttatgcgttagatgcgttgaactaggaggcggtataatagaacaccaaaaaataagtcaatacaaatcccagggaattgtctggaaaaatgctgctgctttttctacgctaggattcttgtaaggatgaagaattggttgcgtgtttggggctgatctacgtttaccccattcttggacctgcacttcttttctcctgaaggactgaaatgatttccagtgacagtttttaccagacatcactcatggttagagggcattaaagtgccactaggttctaaaaattagagttgattttaaagtgttttcttggtctcagttttctagcctaagaagcgagttaaagtggatatagattattagaaaagtcatggaataaacactgtgttttctgctcaacaaaaatggattttggtagggagacgcccttgtgaaaacttccaatgatactgcctactgtctttcactttattctctctcaagatcattagaccaccatttaaatctgaactttcttaggatttttacccccatccctttcttttattttctgtcggagttacttatgtcttggtctcattagcttcacctgtaccattttactagcctcccagccagacttcttgttttatagactaagtggcttcctctccaatccatgctacattcatcagagggttaaagctgccaaaaattacttttgcatctgtcacttttcagcttagaaaaaaatcagaataaaatcctcagtttgacttctgaaaccctcctttgtagccaaaagtgtttacataacttggaccctccatcctgccaaattacacactgtatcctaagcttgttcttgcttcttatactttgctccataatctccttgtttggaatgtgttcatttttccatttacctcaaagctcccataatgcccattttctacacagagccttctgtaggttttacaacaccaagggatttctttctcctgagtcttattgtgtttcgtatatatacaataacttaaattctcttccactgtggtctgagattacctctaccattgcacttaccacagtcttagataagtgttgatttaatttcgtttttgtttttgtcattgtcattgtgtttttcatttcccttagactctaagctctttgatggcttcaggataaaagcttcccatctctgtatctttagtgcccagtaggggaacatagtaattacctgactaacctttatctatctaaatgaaataaattagattgagtcaaccatttcaatacatttatttatattgcttattacccttgtatataattcccatctcttcaattcttcaatgtctttaatctttcaactcttgaattctagatataagcacttttaagaataggggtcatattttataccctttggtatccctgtgccttatataattcttgcagtaactacaaaaactgccaatgcttataaataaattgactttagaggaaggagatggttgagtaagagagtgattcttttcttatctttatttatttaaaaagcagaaccaacttgaaaatccatgtttttccttaaaaatgttaaaatcatttaaaaatctaattttctatgcaagtatatgtaggccaaaggattacaatgtacaacatataaaatacgtctgctaaaaagtttgcttctttcctcacattggattgaatataatgtctttctttttgtgttttgagaaatgtgtaaaagtaaataaaaaactgtagtctctctctggcactgaacagtcaacatagtaccatattttctccttgacatatttttatttgtctatggttgatatttacacgctttcttttcttttaaattatagctcccccacagtttgtggttcggccaagagatcagattgttgctcaaggtcgaacagtgacatttccctgtgaaactaaaggaaacccacagccagctgttttttggcagaaagaaggcagccaggtgagtgtgaggcttcactgcttttctgaaatctctgaacttctactgtctctgctgctcctgaaagcttgccttgcttctcttgttctcaatgtttgaatttattttatttctgaaaaagagactggtgaatgtaaaaataagtaggagtcagatgttctagcaatagcattctttatttgctagtattaatcttttcaaaattctgtctcttacatagaacagcaataaagcagtgtaacaaaattatcgttaaaagtccaaccaaaacctctgtagctatttaaaatctgtgaaggtaaagctaattttgttttcttgtattgagatacgtggtgtgatagagtcaggacatatgcagtacttagaacaatctctgtgacatggaaaacagtcaaatatttgtttaattggcccagaatttcaatcctctctcttatatacacagcataaatgacttttcttacccttaattaaagcatgcttccatttaagagtaggataaatcttttccttctccattcctcctggattcatccatagtggggttagacaggaaataatacatagtacactagaaggaacccatacctgtcttgtctttgttctgccctggtttgtcctctccagggccctctctgggcaacatggcctctcagagtctctatggaaagtcaactggatacactagttttctcatttagaactctgtctaaagttggacaactgcttagcctctaggttcgtagtcaatgagtgaaatttccaggtaaaactagattaaaaattgtgttgtttgcaaaataatttatctgtgcattcccatgggacctggagatattttccttctaaactttctagaaacatgcactactaggcatattctgaggaagagacctactggtggtcttcctcatcacattctgttattactacatgttccagaagaatttccttgggaataatggaaatcattattaaacatctctggaaatctaaaaccttggccagagatgggaaatgtaagttgcattagaagactctgttgattaaagcttacatgtgtttatctgcaacatacatgtgtgcaaggaagcctgtagaagttctgtgcagccattatgtctaattgttgtgggtttctataaattcctgtaccagctcatagtgagcagttctaacagctcagtctggatggacaaatggccttttattcctcactcagctctccttggtggagtcattcctcttgtgatttgtggaatgtaaacgtagtgacgggaatgtaaggaaaggtgatggccactgccttatcccacatcagaactgttccaggccttaactctcaaatcttctttctaatttagtaattacaaaacaggtttctacacatagagttctttaactgtttgctttaaaattcttttcagatgttagcgtctcagactctaaagtaagtgtaaggcagcatgacaattaaacacatacacacacacttagacacacacacatatacacacacatgcagagacagacacacatatacacacacataccacacacatacacatacgccacacacagagacatgcacacatatacacacataacgcacatacacatagacatacatgcacacacatagacacacataaacacacaccactcacatacacatacacatacatacacatacacacacacacacacacaaaaaggagagaattcaaaatccagtttcctccttataaattgtacaacttttgtagtgctatttaaatgtactggaactcattttcttaatctaaaatacagagctaacacattttacttcacacaaacaaagtttaaatgaataagttgctttacacattatgaaggttaagcaaaatgttatgtcactggtagtaaatataatgatgtaaagcaatttgatcattgcatactcacactttaaatccatgtattgagtgaaatctcattataatgtgacttgttattatatagctaagaccatatcaggtgtaaatcacattccctaaagtagctccaagttgaattacaaggtagtgcataaaatgtgtattggccttgtagcttaataaacataggatatttaaatatgctacatctttgttaatggtttcaaaataaataacaattaaatagcatttcagtattcctttttctgtatttgacgaagtggcatataattccagagatattaatgttaaagattacataaaatcttaagtctagttttcttttcctcacctatctctctcccatcagagagatagaggtagagatagagagggatgtggtgggagagaaagagagagagagagagaaagagaaagagatacacagagagaaaatactgtgaatgagaacaagagagaagtgcttgagcaaattataaattctcaaatcatgaattgggatattgggaaaaaataagtcggtcttactatttccagtatccagtttttacagttatctatgaccatccatcagtagaaacagttaaaagcctgaacttaatggtccatatttctcaatatatgctgataatgccaattagctctaataggatacccaggcactctccaaggcgggaagagctgtgaagttcccggtttttgcttgtaatccattttcttttgcctatgtcatgcaagcagagaagaaaaatgatgggttaaccttcatataatgccattttccatgtcaacgaatcatttagaaggtggactgatggtacattgtagaggaagccatcccgtagagaataaagcccatctgatatattagtgctatgtaaattagtattctaatggctaattgtgggaaagtgtgcactttgagttattgtatcattttcaagtgacttcaaaatttagactctctcttttagctcgtttattttgataatacatttggaatctacagtagaatcagctgattctcaaattgtgtttctatgcatgaaaatgtctagccttatataatagtacacattttataagaggtcaatagcatattgaaattacattcctgacatgctagcaaacatcactcgttttagacggagtttaataacatggtaatgtttatgtaaagtgggcttatagtgtcacacttgaatctaataaagtggacatccatcatgttgcaataaagagaagagcttctaattaaaacaggacatcatttgcaggattaaagtcattgagcataattgaaaagtgttaataccctattttatcctcttccattggtattacttcaagggtaaaaacattttaaggtgaaaatgtgtcctgggcctttaattgaatgttattgcctcctgattgcaacgtattgaaactgtttaattacaaacctggaaaattaattactatatggagaaacagatcccagagggttaaaatgtccttttttgtaagtaaatacaacataaaaattgatatctccttatttataatccaacttggaaacatgccccaatataatttattatactcaaatgtttttcttaattgaacaacagtaaagcaacacagttcatccaaattaatgttactcctctcatagatgaactttcacaatttgtaattaggctatatgtatatatgagatatagagtaaactaaagtaattttgttttaaaaagaaagtaatattatgaaattgtttaaggtaacacacttttagaaacattctacattttctttttatcttcagtaatttgcttactcttgcttaaattgtagcatttgtttataaccccattcaaagctgcaaaaactttacagcagaagtacagtcagctctctgtcacacacttttgaacaactttgggagaaattcagttgagtccatcaagtattcaaaatgatcaacagcaatcatattttgcattcttcagagctgtgcggtttatacaacccatacacagtcaatgttatggccagatcttcatgaggccttagtagttgagtcagataagaattgttttgcccattttccagatgaagaaaaaagcttcaaagatattaagtaactagcagaaaatcaggatgagataaagatccccattctttaaaaacacagatgattattctttcaactagaaaatattgacttcttagaggatattattccaccatgatttggaaaacctttatcagtgaaacccactgtgtggcatttaaacatttctgaaccatatatattttaatctgtgtattttctttttcccactgtattccttaattgtagtagcttttattcacataatttttttaagtggaaaatgaatattgatgagattgtgcttgcttccacagaacctacttttcccaaaccaaccccagcagcccaacagtagatgctcagtgtcaccaactggagacctcacaatcaccaacattcaacgttccgacgcgggttactacatctgccaggctttaactgtggcaggaagcattttagcaaaagctcaactggaggttactgatggtgcgatatctttactagatttgtcttatgaaaacattgatttttatttctagatacacgttaaccatgtggagtttgctgatttgttaaatcatttctatgtatgcttatcttttaagtttgaatccaggtcacattcttttggtagtttctaattctccctgattgaataccacttattttccccaaagaagaacttcagagataatttacttaattcttaaaaatagaatagtgcatttttttaaataaatgtcatcacactcactgcatactgaaatgtaatctgtatatttttatttagtcttaggctgacatgattggctctactagacattaataattttatttcactctaggaggaggtcataccacctttaatattatcagagatgagattttagttagctaatcacattaggacattcctatgattttaattatgcattcactaagttaaattaactacctttcaaagtgctgaacaatgctaaaattattatttttattggcacatatgcactttgaatcttaactgaggcacctacattcatagtgaaagttgaaaaggatgaagggctctgcgtaatctggttttttcccagcagtttatttgtcacaattgacagctagcaaatttgagatatttcatgaacctctgagcgtgaatttaatccctattctttgatgtcttaaactgaaaattatttcttactctcctttatttgtgaggatttttacttttgttttctcccctaatgctggcttctgagatacaagtgctttggtctgtggtgtcttcttgatccccttctttctctgatggtgaaatttgatgtgcttttatacaatttaaatttacatgtagattaaaaggtcatttaaaattaatagaaaggcagtattttttaatatctgttcatggtatggcctgattcagtgacatgtcaggaatgggaataaatagaacagacaaacattggctgcagggacattgagtcgttaatggctgcacctgctgatgctgcagagatttactgctatggaactgaaaggagaagtcaggttcaaggatagcagtgatgagaaattcttccttagatgggcaaggtctttgattctttgtacctccatatttctttaaaagaataaaagataattattaatcattaaaaagatcttatgttttcacctgtcaacaaaaatgtccagatacatacacttgaaaaataagatattctgtccaaagcctatgttttattctatattcctaagaacacaccaaatgtaatgcttaagataccggctatcatttaactacttataatattttatagaagattgactctcaaatgtttctaaatgaagaaattgttatggaaaaggcaaaccatatttgtgggaagcaaagttgatgaactagaagagccagttaatgtgactgttatcgttcataaaacaggtggatattcagaattacgtctgatacaattaatggaaaacctttgaggccttacactagctcatgctatattacaaaacagtagttagtctagctttctttctgtggtcaaaaataagtgatgaccaatgttaaatcttctgccaactgagattgctctaaacattttgttacaactggcttgagtattaattcctatattgatttttacttgagtaagcaattacaaagtcaagatccttttgcagagacattgattagaagttacagtgttgttgattttgacagtaaagaaatgaaactataagaactaaatatgtacacacatgttatcaattaatctgtctctaaatatgaagttgccacattggctgatgccttaagcttctacccatagttttgatttttcatacaggttaatgatttaatactatctgagccattatttcattttgaacacatttattttgatataattcagggaattgtagagccatttgaaattccatggtagaatgaaaacgtatgtcatgttcagagaaagaagtgattacaggcataccttcctttgttgtactttgcagataccatggtttttacaaattgaaggtttatggcaaccctgggtcaaacaagtctgttggtgccattttactaacatcatgtgctcacattgtgcctctgtgtcacattttggtaattctcacagtatttcaaacaatgccattattattccatctgttatggtggtggtctgtgatcagtgatctttgatactactataatttttggggggtatcacaaactgcacccatataagatggtaaacttaactggtaaatgtgtgtgctctggtttctttacccactggtttctttacccctgttgttctgtctttccctgagcctccctattcctcgagacacaacagtattggaattaggccagtcagtatctctacagtggcctccatgtgttcaagtgaaaagtcacatgtctctgactttaagttaaaagctacaaaggcttaagtttagtgaggaaggcatgtcaaaaactgagataggccaaaagctgggcctcttgttctaaacagttagcaaagttatgcatgcaaaggaaaagtttttgaaggaaagtaaaagtgctactccagtgaacacaaaaaatgataagaaagtcaaacagcctattgctgatatgaagaaagttttagagtctggatagatcagtgagtcacaacattcccttaagccaaagcctaatccagagcaaggccctaactgtcttcaattccttgaaggctgagagaggtgaggaagctgtagaagaaaaatttgaagctaccaggggttggttgatgagatttgaggaaaaaagccatcttcataactaaaagtacaaggtaaagcatcaagggctaatatggaagctttatcaagttattcaagttatccagaagttcattcatgaaagtggctatactaaacagattttcaatgtagacaaagcatgcatatattgaaagaagatgttacctaggactttgatggctgaagaaaagaagtcaatgcctggctttaaatgacagactaactctcttgtaagtaactaatgcagttggtgactttaggttgaaactgatgctcatttactatttcaaaaattctatgacccttagaattattccaaatctactctgcctgtgctctgtaaatggaaaaacaaagcctgaatgacagcatatctctttacagcatggtttacctaccgaaatattttaagtacagtgttgagatctactctgcagaaaaaaaaattcctttcaaaatatgacttctcatctacgtgtaccttgtcacccaagctctgatagagatgtacaaagagattaatgtttttatacctgttaacacaacatctgttcagcagcccatggatcaaggaataatttcaactttcaagtcttatttaagaaatatattttccaaggctatagctgctgtagacagtaattcaactgaaggatctgggcagggttaattaaaaaccttctggaaaggatataccattatagatgccattaagaacatttatgatttatgggaggagggcaaaacatcaacattaccaggagtttggaaagttggatgactttgagggggttccagacttcagtagaggaagtaactgcacatgtggtacaaatagcaaaagaactagaattagaagtggatcccgaagatgtgactaaatggctacagtcacatgatacaaattgaacaaatgaagaattgcttcttagggatgaccaaagaaagtgatgacttgagatggaatctacttctattcaagattgttgaagtgataacaaatgattcaaaatatcacataaacttaattgataaagcaacatcagagtttgagaggattgtctccaaatttgaaagacattttactgtggataaaatgctataacacagcattgcatgctactgaaaaatctttcctgaaaggaatagtgaatcaatatggtaagctttattgtcttattttaagaaattggcacagctaccccaatcttcagcaaccaccaccctggtcagttagcaaccatcagcactgaggcaagatcctccatcaccaaaaagattaccactctaggctcaaatgatcattagcattttttagcaataaagtatttttaaggtatgaacttttttttagacatagtattattctacacttaatagactccagaatagtgtaaacatagcttttatacgcactgggaaaaaaaatttgtgtggccttccttattgcaatatttgctttattgttgtggtctagaaccaaacctacaatacccctgagatatgcctgtattccgtttagagcagtgtatctgttgtcacatttttgcgcttagactcattttctggaaatatttataattcaaacattcataaaagatgaaattgctaatgatgctgaatagtgctatgttgagcaacaattttactgatcatagattaagctaatatgtttcaatatacttgagtttcaatatatttctctaaaagacttccgcattagttcactggcattgttctgtatttcttctttccttttgctctatctttttctctcagagaattaggaaattgtaatcagcattctgtgaatagagccaatagaagttaaaaagactggggagataagatgtatttatatcttgtactgacaataaatgtcacatcatgatcttatatgaatggtttattgagtatttataatgcatagtgagagaaaaccgtggagttgttcacagatcactggaatccctaaatgttcatttaacctttgacttaagtgtcatggaaacctgtggtcatctttcacccataacatccttggaactgaaaattatgtctggccaggagattttcaattactttattgatcaattcattcaaaaggtgatgagctactcattagggcagtaaaaaaacagaaagaaaaaaactaattagatgacctttggctgcatctaatgatttcagggatatgacaataaaagcaggttataagaagttacctgaattctgcataggtatttaatttggaaaaaaaatcgtttaaaatttaattagtatgctttactctggtaacacagactcactttctcactgcattaaaaaattactcatagtgttttgttcattggccttctctttttgacccataaaaataagtcccatgaaacttttagtttgaatttctatttgcctaattactgacagatgtgccagaattattacaatattctacttcaatattttcttaaaatgttttatttagtattaaaagtaagaatttgatgaaaaaagcagtgaaataaatgattctaatttttgtttgtgaatgataaacagtttttattgtttttcttaggttttatcactgataaaataggtttaggttgactagaatctgcaatgtcttgatatgaaggtaacctgtatcataaattctagcttcaattaaatttggttggctttctcatgataggttctgaaaaggctgcttaactttaatcttttgttccctaaaactatgaactctagtaaatatgatgcaagtaaattggaaagatagtaattttaagctgccatttataaaagctggtgggcaaaggaaatttgaacgttaagcaaactgttttcaattgtatacattgcaatacaaggtgagttttttgagaaacaacagtttatcttcacagttgcttagaaattattagaatccatcattcattttttcttttttgtggaagtctttttcatatatattcttttatatactacatgtattttatatgttacatataaccatacacaataaaaagcatattttggataattaaccaaagtctatgctgtctatgccgaagtttatagaactttctctttagaaagacttccctggacctggacatgtccttttgattatatggtgatcttctaatgaattctaaatgaaatcttacctccggtcaactctatatttttcttaaccatgtaaataatactgtacattttgatgtccttcttaaataatcattaaatacttctaaaagcactgaaatgctactacgatacagttgtattgtactaccgaaatgctactacaaatacagtatttcataaataaaaagcaatactaagctaaacatttagaaattatggaaaatttatccaaatgaacacaacaattgatatacatgtaaacactgattttgcacaagcactgtttttgtcatatgataaatataatctagatgactttcctttgatcaattataagcactaattaaatcaaatcatccaaatgatatgactgtaatttgatgagctcatgtcacaattttggaaggaaattatttataatctaatattttaacatcagcagaaatattttagcctgtataaatacagcacataactggtgccataagggggaaattatgtactatatttatgataaatgcaaaagtgaaaattggctgtactcatatgatacttcacacactttcttaaatatgcatatgagataaaatgaacatttcataggtgactgactgccataagctattcaaattttaattttaatacgactaagcctttttatacaattaagtctttataaaatgtcagaatttatctcaatgccattttaattataggtaatgcagaggaagttattgacaataaatagtatggccttagtatagtatatatgtatgtacatatatagatgatagatatatgatagatttagaatatacatgaccaagaatatacatattgcttagaataagttataagtaatatatattgtgttggggctttaaccttactttcagtgtcaatatatcaagcctactgaactacattgatgttaaaatacctgaaaagagctttattcttcagttttgacagatagacctccacctataattctacaaggcccagccaaccaaacgctggcagtggatggtacagcgttactgaaatgtaaagccactggtgatcctcttcctgtaattagctggttaaaggagggatttacttttccgggtagagatccaagagcaacaattcaagagcaaggcacactgcagattaagaatttacgggtaagtaatattggacttgtacatgaattatcatctacacataagtactgctctatggaaaaattgcatagtgaacttaaaatcttacatcctagtataattgctgcacgtttaaaaacagttaatgttattacttattttaaaaatgatgaaatgaaattagaggaaaggtcacagtttttacgttactcacacattcataacagaatctcgaaacttttattcctgtatcccattccatatgtatacagtcaacaaatctagaaatcttaaacacatagcattaatatgagtagtagggtattggaaatgacaaaaacaacaaatgcttctgatttactttcattcgcaaaagaaattgtaaggaaatgtagataaagtggcttggccaaagagttgagtagaagaaaaataaagagatgagactgagtacataaacggcgagtttgcctggttagtgggaaaccttaggttgtaggttaagttgttgtgtagtttagatttaaacccatggaaagaacaaggcattggtggttttttactgacgtttacatgataaaaaatgagcattcctggcaacttaacaagtcagtcctgcttcaggagcaactcaaaataaaatgtctacttctgaatattgtatcagttatctattattatggaacaatatgaacaaaaatacagtggctaaaagcaacacacatttattacatcacagtttctgtgagttaggagcctaggcatgactgagctgtgtcttttgcttctgggtcttacaaggctccagttaggtgtcatttagagttgccgtctcatctgaagattgacacaggatggatttgcttccaatcaacattattcttggtagcactcagttccttgtggctactggactaacaacctcaccttatcaatggctgttggcaggaggttgcctttggttccttgccatctggatcttccccatatgactacttgcttcctccaagtcagcaaggaagagagtctcctagtaagatgggcactacagtcctgtggaacaaatcacaaacatgacatactgacacttttgcaatattatattggccagaagggaaccaacaggtcccacttacactccaggtgagggattacacaagatacaaataccagaaggatgttatcatggagggcacctgtcctctatcagtacattcaactcattcaactaggtatggtaagtcccttcctcctacctgccatgtagcaagtgctatgtgaaagctggagagtatattttagtaatcacaagattggggatgagacccagaactaaggtagatgatgtaatagtgcatgaagaaaatttcagtggaggagaaatctgtagaatcttgggtccaggttgaaattcagagccaagatgaagaaaaacaaagcaaaacagcatttagaatcttcccattctggagctaaaaagaaaggcaaaaatttttaactacacatatttccaaatgatcacaatttggcatattgttcttttataatgggaatatgtttacaattatatgtttatctgattatcgctatatcatacagacgtatatcagaaaacaaagtgactatttttgctacatgcacacacatgcacacataagtttttactttatatatataatatttatctttaatttttgagatacaggcattaattattgctttaaatagaaaaaatgctgccaagttgagtttaaaaaagtaaattaatacagatattttgagcctgtctttttattgattgtaaattaattgttaaccttctttgaacaaaatggaagttattaaaaaattaatgccaactctctttgtgtaaacactttaacctctatttctgggctaaaggcagacttgggccatagaggttaatgcattttcactgtatcactgaattaaagggtatgcttgagtagtcaagatttctagtagtgtttgaaagaagcaattaaaggtgggtgcttgatgatgtcaaacaaactttgagccctctgacaggcttctgagtagtctctctgagatgccagctccttggggcttgtctgcagccaagtgcacaaggagaaaagtagatgatggaatttgcctgcacattaatctcattttaaagcaatttattaagggtaaaaggacaagcatggaaaagatgagaagcactcctcaccagaaaaagacattatttaaaattaaaggaataaaattaaaggaataaaatgtggtgatgatggtaataccaagagtgagttttagcaacgatatttaggtttatgaggaccccaaaatgaaaacgttgttcttttcctgtaacatgactgtccttacagggagacagaagtgggctttccaatagttcactcatacagtcaagagagtttctgtaggctgtattcctttgtgtctcactatttttttttcagtacttaatgcaagggaaaaaaataatgtgatgaatactgtgttcttctaggccagctaattggtaactgaatctttatcttttgagaagtagaatattccagcactcattaaaatatacctaccgcagctaatgtcatacttgtatctccacacaatgacaaggagatgcagttaagaagcattacctacatacttttcttttagcatttgcaagtaataacaagtgctacattttagttcaacagctataataaaatgcaaattcttttactctttcacagaccatattcaaatgaacatcccattaaaatccaacctcggctcattatatttagtttgtgagtgatgcttcttaaatgcaaagatttctaatgactataatgtgtgcacagccacatttgaaagaatggctctttctacaatggctatccccatcttccctctgtgtaatagaagacaattgtacagagataatatggcaaagaatgtcatgccagagcaatttggaacttaagttaaaatacataatggcatttaaaatcaattaagatagtgaaatggcagtaacatccaggcactaatgatttacctgagaatcaatcgagaaagcttgagtcatcaacacacttatagtttgaacccagcagatataatattccatgagcgactatatttcatcaacaattagactgatgttcatcacagaatattaattctacatcttctgccttgtctgactttgtttggtcatcagtttctcttcccagtgtgacttttcctttactcctaaattgatgagaatgaatgttgtttgcagtgtaagccacaaggcttgatcacacagaattttggagttgcctcttttattgatcttggggctttattcaaaatataatcacagaatcttctgcttcttgcatttgtaaaagaggactcttgattatattatcaactttttctgaaagtcctttgccactcttctgagaataataaaaccattttaagtgatcgatgaaatggcaagtttttattgtgatcaaaaaagagttatgaattatgatatatttatgttccctttcagcttgaaattgcagtcactccatagccacatttttttaatgatactttattctattcatttttccactactgcaatttacatataagtgaatattgaagtttttaaatgaagaagtttaccttaaaaatatttctttttctggctgggcacggtggctcacacttgtaatcccagcactttgggaggctgaggcaggcgggtcacctgaggtcaagagttcgagaccagcctgaccaacatggagaaaccctgtctctactaaaaatacaatgttagtcaggcatggtggcacatgcctgtaatcccagctactcgggagtctgaggcaggagaattgcttgaacctaggaggcagaggttgcagtgagctgagatcgagccattgcactccagcctaggcaacaagagcaaaactctgtctcggggtaaaaaaaaagttctttttcttcttcacttttttccatgtctttcaaaagaaagaaagtgtgatcccttattgtcttattgcttatttactcgggtatgttttattcattgaaacatagtttatttgagacagaacagttttgcattactgcttctctggaattttgtgagattctgaaagagttctgttctgagtcattcataaacaacttagatatagtagagccctgccataaaatggagttaagaggtaagagtattatcacagaggaagaaaaagagaggggcaaattgtttatcagacaaattaacattgaggtgcataaatattattttaaaagccctttggaccaatgttatgaataatattatatgagtttatttcattattttatgtatacatatgattgactctaatgcataatttagacaacaaaatgatacatctaattttaagaaattaaatattgcctggctgtcattgagtaattattctgcaaattgactgaaacaatttaattctctcccttctgtgcacactagatttctgatactggcacttatacttgtgtggctacaagttcaagtggagagacttcctggagtgcagtgctggatgtgacaggtgaggactttgtgaattaggagaaatcttgggccccttttctgatagctcaatatcaaataataagttaaggggggatcaaagtgtttaattcactgaatgtaaattttagcctttacattcaatgccattttttaattcatgcatgaatttgcacacaccattacatttgtggaatttaatacacttgtctttgataaccttattattttatttcctctgaagtgtaaggaattctaatgatcctatgtaaaaacacagcttacttttattaacatgtaggagaagcaaacattcacttacatacttctgattcatggagatgaatttctcactgtctaggtcaggtcctttagtagactgcttccttcttttaggcagtattgtcaacttatgcaatcaggaatgaagttttttctgtctgtcctctatagagtctggagcaacaatcagtaaaaactatgatttaagtgacctgccagggccaccatccaaaccgcaggtcactgatgttactaagaacagtgtcaccttgtcctggcagccaggtacccctggaacccttccagcaagtgcatatatcattgaggctttcaggtatgggacaattccttctttctccactgggttttgtcttagctcctttattctaaaatgtcacctgaactatcctgctgttttattaaagacatgtccaatcaatgcattttaagaattgatctcttctctctgactttattcaagaacagagttaattttttttagtttacaacttaattataagatttaaatatgcattattcatgcctaggtctatggggatccagttcataacataatcacttagctccattctttacccagaccattgtagggatttaaggtgagaatttaggcatctgaactgggtagaaaatattttaattaggcataggcacaggcactttttaaagttatgtgacatttattgaagcagaggactctggcatttatattcctaataattagagcagaacttaaaataatcccaatatttttataccatatattacatacatctattagatatgcctgagagaaaattaacaacaataattaataaatttattccatgtgcttctagttgcttaatggaaaagatgtttccacgtgttatctgaaataattgttgccaatttaaagatttaaatgtaaattagcaaatatcagtataaaattgtcctatgaaaatttgataaaatgcttacacaaatggtaaaatatgctttcatattccctttcaaatgtgcttctacgtgacagtataaattttaatggataaccactgttttttttaaacattaggacaaatgatcactttcttataagcttctctaatcattatttaaggtaatgctaggtacttaattttcaaatttcaaaatactacgtttctatcattcttatgcgtggacagttaagcatatcagaaaaataaactgaccaccctgaaaattacatttgccctttcttctgagcaaaagtggcatttgaccttagacaaactgttctaaaatggcatccatctgtggctggctgtaaatgggtcctcacacacaaattcagagagatttcaccgttctgagatgagaaatcacaatactgtataatgtacaattttattaacaatgtaaccaagggaaaatattcattacctgcttcctctcttcttttacagatatgtagtttagaaggctcagttataatattgcatgtggaaatgatgcaaaagaaaacacaccttgtaacaggaaaatgtattggcataatttactctgtagtccatttattctttctacaggttaattcttttcaaggtatatatatatatacatttacgaggaccatacttattgtataaacttgatgttgtgatcttggcctctgttccttttacaggtattcatttagtgggctgctgtgcattagcaaagggctgtcacatctcctgggctgagtttaattttgttgtgcatggcacttttgttaggtgggctcggctttgttgtggaataaattgaaatcatccaaatgtttcatttattgggctgaatacttcaagtgttgtgtgtgtgtgtgtgtgtgtttaatttccagccattaacctttgtcattgatacccaactccatttccaatcttcaaatgactgttctttaaatgaaatttctgttcgcgtttcagccaatcagtgagcaacagctggcagaccgtggcaaaccatgtaaagaccaccctctatactgtaagaggactgcggcccaatacaatctacttattcatggtcagagcgatcaacccccaaggtctcagtgacccaagtcccatgtcagatcctgtgcgcacacaaggtactttcaacagctgtcaacaagactggttctaggcagaaacatcagatatttaagaacgaggggcttgatgaggaaatatacatgtgcctgcattgctttgtatgatggctcactaggctttatccagggaaggagaaggtagcttgctgtttatcttggtgagatgtgttctctttctggagtttttgggtttattcagcaaaaaataaaaataattgggtacctctacgtcgaatgaattcactaaattagagctttactatatttcaaagggaggaaaatgtttctccttctttaaaattaattacacaataacagaaaagtggtctttaatgagtagatgcccaaatagaggtataaaaattatgtcctattgtttcggaattctgtttttatagtgcagtcgttctcacagtgtggttcctgggtaagcagcatctgcatagcctgcaactgttagaaacacacattttcaggctcaaattcaaacgctctgaggttggggcccagtgtttgttttaacaaaccctccttgtgatgctgatgtataagttttacaaccactgctacagtgaatttcgttaaatcagatgtttaaaggagcaatttattacagacagcaggaaatcaagttttctttctaaagaactcaattctttcgactataatgtaaaatacacacagagtattaaaatataatttcaaaatggaagatttcataattttatccttattacctgtctcttcaaactgagaagtcactggagtctgaggtttaatatacaatgctacattatagtttcccttctgacaagtaggaaaaagaaattaataaaatagaaacggtaattttattatttgttataacctacttcccacagggttcttcagaaagggttaattatttcttatttgtaaaagactttgaacaagatataattcaaagtagtatttttatgcaatgaaaagcaccatacagccataaaatattattataattacaatgtagttcggtgatagtaactagcatgctattataacggagaagggcaccttaaaggaatcgactgaaataaagtcaccacgtgactttgtaacgttgctgacatgatgacagtcaagggaggaggaaatgccattttgctattgttctctaagcagtaatgtgattaattttccatggcgataaagggcctgtaggtaaagaacctgtctcttgagaaagaaaaagcacaacaaggaatttgaaaatctgaaatttgaacctagtcatattttaccttccttaaatctgattgctttttactgtgtttgaattaagtgtgtaaattttattattgaacttaaaatggaaaatgtgtacaattttacgtcaagaaattgtagtaccgtgatcatttatacctttgtgcatagaaatagtttttgtgtgtagccagtgaaacgtagagagagatcagaatgggaagatatttggtgtgattgtatctggcagacctttttgatcattcgataactatgctagtcactaaatcttgactcataaaataactcgcagtgaagaggtcaagaaagattaatgaaaagttgtttgtggtctggtttgttccaatggaaagaatatatagagtgaaagacttctgtgctcttaacaaatacttaataggaaaacccacgtgttgtgtctgaaggtcaggattatttttgggtaccatactttcagcagctttgcaatctgcaaagcatttctttttcaaagaacactttgcactgtgaactcttatttttcaaaggtattaaataacagagaatctagaaatcttttatttcattaaaagtacaaatacttggattatcagcatcaaaacagaacatacatatataggcatagattaatgttattcacataaagggacttttttcaaattaagtaaaacttcattttactgtttatgttaaaaatgaaaaaaaaaaagtagaactggaaaaacattacctaagtattagtctcaattatttacgacccaatttaagttagtgctcccaatttaagtaatagctgagaaatgttcttaaaaatactttcgcgagagtgctgcatgcattgtagcctgagataataagaaaaaacaggattacgaaaataaataactttaaattggacttcctttcttaaatacaatagttggagaaaaacaattcaacaacattgtgtgccagcttaaaaagttaatctgagtatgtgtaaaattcaatgtttaatatcaatttgatggacttagctgcttacgatttatcattttttcttaatggacacagcctataatttatccttttttcttaatggaccgagaatataaaccatcatatggagaaatagaatagtacttaggagactgatgaataatgtggcataacaatgtgtgactgagggtataatattttaaacatgacctttctttcttcccttctccccaccactattcctaaacatgtctgcatgacctcgtgtcaggtattagagtactgctcaaaatgtattactttagaacatgttatcagtattataactatttctgtcaaaagtatctttgcaaatttgaggagctgtttcccctcttcccccaactctatttacctttaatgacagaattcactttcctagtccaccattacttctccatccatgctcccagactgaagtaggtcaagaagaaaacacaacctgcaaattgggacaagggattaacaggtcccttagcatcagtttttagatatatcccaatttacacatccagaaaatcattcaatacaccaacatctgtacaaagctgctctttctagagatctttctagacttctgtagagaagtcttacagcacatactttatcctttagtaataaagtaagtgatcttatacaacagtgtgtctgcatttgaatgcggatgagggattacaaatactcttctattagtatatttttaataaagatcaatatcatctttcattatgtcctaccacagtggtatatttatatatataggcttaaatgctttttgtcacaagagagttttcgttttgtttccctgtaattagttctaaagacatgaggttgatttacataaaataaattgtaattttaatatgaatttttaaaggtgggaatgattctcttctctaactgcagatatcagcccaccagcacaaggagtggaccacaggcaagtgcagaaagagctaggagatgtccttgtccgtcttcataatccagttgtgctgactcccaccacggttcaggtcacatggacggtaagctttcaaaggcaatgttaatagtaatctcttctctttcgggaaagcaaaacatggaaaatgcaaatgaacaaagagtgataataaaaattcccgccatttaaaatcaaggtgtaatcaatgatagtaaagaaaatcaacaaattaaaaagttactagaataaccatagtaagaatagattattatataaacatggcatatcctgtcttctgaattttctaacagctttcttgcgatataattagcataccataaagtgaacaacttcatgatttttagtgtatttagagtttctaaattatcaccaaaatctaattttagaacatttcatcatccccaaatgaaatcctgtgcctgttaacattgattctctcatttcccctaccgtagccctgtgtaacactaatctactctatgtttttgtagatttgcctattctggaccttttatatgagtacaattgtgcaatatgtggtcttttgtgtctagcttctttcactctgcataatgtttttgaggttcatccatgtggtagcgcgtatcagggctttgtttcttgttgttatcaaatagtattccattttatggatacttcacattctgtttattccttcttcagttgatggatgttcgggttgtttccagttttgtctattatgaataatgctgccatgaacatttgagtacaagtctttgggtggacacatgttttcatttatcttggtataaacctacaaattgttcagtaatattggtaactctccatttaatattttgataaactgccaaaatgctttccaaagtggctatagcattttctattctcactagcaatgtttcagtgttccagattctctcaaatccttgccatttttttctcacatccttgccaacacttattatcatctgccatttggattatacccgttctggtgagtgtgtagtggtatataattgtggttttgatttgcatttctttaatgactaatcatattcatcttctcatgtcctaattgaactttttttttagagaaatgtctattcaaactcttggtccatttttggacaaagagtttgtcttcttattgacttaacaagtgtttatatactctattttgtttgtcttcttattatagacttataagtgtctatatagtctagatacaaatgccttatcagatacgtaatttgcaaacattttctcccagtttggttactgtaaccctgttatgtatttaaagttgagtggcatgaagcctccttcttccttcttttttgcttaggattgccttagctattcaggctttttttgttattgttccatgttgttactccttaaagcaaactacataatcagtcaaattattggtttatgagtacaaaattgggttgtatatattttaaaaataagactaagtttataatattttaagagtaattatgattatttaggattacactttcttattccagttttgacataattttgcatagatttattctattttctgcatatattggtttctattcttctgttcccatgaagggaacacaattacgttattatttttacagtggcacagtagggggtattatctgccatgccttttctatctttcagtacccttgagtagatacaaaactaacaaagccaaaatactacgctgtatttttcacagcgtagtagttttcctcattctcaattgaaaaaagtctctgttctgttgcaagttataaggcggattcttttaagctgcatctaaatgtgggaagtctttgggtaagaatcaaagtcattatgttgatgaagttaatcactttaaagtcacttagtttcaagagtaaatagcattagatcaaaattgcatgacagcagactgggagttcttccaggagggggacgttgtctattcatctctgtaccccaagaagctatcattactagtttgcacatctatccccgtcatgggctgtaacttctgtgaggctacagccaatttctttcatttctgtttttttcagagcagagtgtctattatgaagtactctttttaataactgtttgttgaatgatcaaatcagttgttttcatacattttacactttttttaatagaagaaagaattcagttaatatcacggcatattgttctctatgactttgtagttgcacatgacataagtatgcatttgaaagagataaattaagtgaaataaagtcagactggggtgtgtccagtggtcaaataatttgtgtaactcttttattgatgtaatatttttgatttactaaatgcatgtgttatttaaattatcaaaatgttagcatttgctttacagaagtgttggggttgaagggagaaataattccccaccatgtgattaggttttgggccagctgaggaagtttcccagtggttggcaggattaatgaccaaaggcacaagacataactactgtagagaccattcgctgtcccccttctcaccaggctaaacttgaaacaatagttagcaacaactgctttctaaaatggctgcttttagaatgagtgtgggcaaaaatgataagaaacctgctgttccacaaagaaaaatagcaataagtcacttaccgaaaaatgattattctagctttactttttgtctttgttttgttcaaggacaaaaagaattacatactctttgcccattaagcatttttccacagagattgaaaagagtgcttcgacaaactagaatttcagaagtctgctaaaaccagatcagacccttagcagctaaacccatcaaagaaaattcactttgaatttttgctttatattgagttgttatgttgttttgttttgaaaatggaaaaggtaaatatgaagcatcacacttaaacagtttaactagaatgctgattttagggccacatataagccgtcttcttttttagcctgttgcttccttaacaattatgttttatcattgtgcatctctaaagccagcaaaatgctttcacttatatcagtcacttgattgtttctgtgcccttgagatatgggtattatgtgagcaaattaagtaaactgaggttcagaaagtttaagaggttgaagcctaattcaaattgagacctatggctggaagcctgaagttctcgtaatcattttatttttccttaagacaactctttttttattcatgtttcagaaaatactattttaaaaaaatatataaacccatgaatctgtggtcagactctgattgtaatcaactctaaaagaaaatcctctttcttagaatgttaataaaactcgtaacaaacatatggcctaacttgaaaatgaccacctgtcaaaatgagctccaaaatttagtgaggtagaacacacatccagtaaaaatctcacctattttttttaaagtaaatgttcagtgttttcatttctgcttccacctgtaacaacaaatttcgtcctgaaaaaaaaaaatgcattgccactgcacacaatcaagttaaactatttaattattaagccccatacgatatactggccgatgatagtgtacactgaagtgtgcaagtgtgcaaaacaatgttttgtggtaaacattagcttcataaagtccctaaaacacttaattaatgaaaaccaaacatggataaaaccaatttaccctgatttacagactcccttcatctggaaacagctgcttaatgttcttcttaaaaacacagcttgcttctttcagtattaacaagctattattgtgagttatgtctttctttcagtatataaattcacttaaagcaaatgcagagaagtttataaaatgcaaacttagtgttgttttaacatatactgcaagggtttttttgaacactgacagttttgatgaaagtcatctctctttggctctcataaatttaacttttcgcctcttggttgccttatttcatagtgtcagaaaaactcctgcttttcaaagaatgtatccaatggtagaaacataaactggtagcatgaatgaggacttgccgatcaccagcttccatgttacacctgggctcactttttttttttacctgacctcatacaagtgtagcactaatttcagaaagtctttgagggtgagaaagctttcaggtgggtgaaggaattcattcttgttgagacttatctgggaaactggaattagccgtacatagaaacacacacacacacacacacacacacacacactcacttaattgagggagttttctcgtttggacattctaagtatttccttttgttccactgtatttttattgaggctctgcatttttaactttctaaagccaatatttttagctaacattcatttgttgcccccaattaaaaataaataaaacaatactgcaactaaagaagggatattagtagttaatacatgaaagaatacgttttgtttataaactgccgacaaatttcaacatttcaacaaaagttgaaacaaatttcaaatgctgaacaaatttcaaatttcttggataaagaaatttgtttaaagctgaaattaataaccgtctccataattctcttttttatttcctctttctctacaaacttcctgaaatgaggttattccatttcttttccattaatctttacactttatttgatagtgaagtatgtcaaatttaagccttgttagactatagctattaaactatgataagggatattagttggaacatgctatcatagtttgtgtttaaatcaagtgtttctaaaaacatgacaaagtattaaaagatgcttaatttttaaaaataatttttaaaatccatagttgttttctccctgaaaatgaaacaaccataaaaccctggtaaatattttaaaataaatgtatacagagaagaatatatttcattttttaatcttgcatttttatatatttcatttttaggtgattgtcaatagcaaacaaaaacactttttaaaagttctatttggtatgagtttaatcttagattattatttaaaatagcttcttactgtatcttaaataaatgaagatatcaaaaagttgtcaaattttgtcaagaatgggacaattgaagagtcagaagttggtaaattagtaaaagtttttcatttaatatttggtaatgggcataaacgttcatatgcttttaaaacaaatgctctagctctacaactttaatctgtattatatgctttttccagccacagggactttatacatgatgtcctcacatttgttttcctgggtaaatcctgctcttcttgcctatctaagcacttacgaattcttcagggatgctttgcctctgcttcccaactcagtcacctttctctccactataggctttcttagctcttggcacctctcattcttaacatttgtttatgcttttttttttatgattgtaacttgaccatggttcagtcattattagaccactcctaccttctacctggactccatcttctcacctcagctcatgagggcaggggctgactctattttcattgtccattttatccccagagctcagcagaatttctggcacctatgagtaggaacccaaaacatgtgttttgattgagtgatgatgttagtgaatagacaaagaatgagaatggaaatccctgacaaagggcatattacatataaagccacataaaagggaattgttggatgcagaaaatgggtaagcagaggagacataaagttagagatactggcaggtctggcctttgagaggcccttgtgctaatccaaggcatcttaattaattaggttggtatcttagatactgtgaggtattttaaacaggagagagagttctcccaatcttcattttggaaacaatcttaggagcaatctgaactctaaaaggatagaagttattagaagcagagagattagctagaaagtcatgacatcactcagttgatagttatgaggacagaaatgggacaaatgaaaagaggacaaattcattgtgttgtctaaaatactttcctttagtttcaaatgcccttaactatgtttttcaggttgatcgccaaccccagtttatccaaggctaccgagtgatgtatcgtcagacttcaggtctgcaggcgacatcttcgtggcagaatttagatgccaaagtcccgactgaacgaagtgctgtcttagtcaacctgaaaaagggggtgacttatgaaattaaagtacggccatattttaatgagttccaaggaatggatagtgaatctaaaacggttcgtactactgaagaaggtcagtattcagatttcgaatataaatcaaacatgatgaaaccaatttctgttacagtacctatttgttatcttccttagaagaatggaaagatatcacctaaaagtaaattgaggaagtgtcgttttctccttttattctgagaattctatagaatctgacaagcagaaaaaaggacactaatgtaatttgaatttttcttaagtaaccatttgcaccaaatcttatgtttaagttcacttgaattggattattaaatattcccctatattttgtgtagatttagttcatttggatcatgaaagacagacgactggaaatttgagaacacaggctgttcattgtgactactcttcttttgttatagttaagtgtgacattttcttttattagccactttttcctatgggcactgccagtcaaacccatgatttctaatcaggaagggcacttgcgtatttgcagtagctttcttcttagtgaagttccctcgttctccccactttggaccttttcttacctaaaggtatgttaaagtcaatctgtgatgaacacaagctttccaccagttcatttagtagtatctctttcactaaacaagaggcttataataaatgttgtcattaaagttaaaaaaaaggagatgcgaaatgaaataaatccctccattctgcttttgtattaattttgtgctcacaactcttgtaaaaagccctttctttaaacatatttcatacaaaataagagaagcctttaaaaaatgtatataggttgcccacgttaacatctatgtgcttgaccaaagagctcttaaattatacatttcttacacaacatggcaaaaatgtcatcttcccattgttttgcagtgtgatacactggcaggggcaaaaatgcatattcaaaaaggcatcattaatctatttttaggatatgttgaaaagttgccagtaattataatagtatcttttctccttgccaacatgtttaaaaataataatcattatcatcatatctttattcatcgttaaatttcactctgtgttgcaaattggtagtattaatgagtggagcaggtaaccttaacacagaatgctctctttgaagcctgttaccaaaatcaatttcactgcagttagacttttcctctggattagacatttgtccctgttgggtatacattcatctccaatttctgtggctatgtgatggtaacaaatggaactcagctgggctgtgtctgggaatgatgagcggcgatttgggttctttcacatctgtagaacgaagctgagtcctggaataattgacctgtcaggaagcaggcacggtgttctcgccgagccagcagcaaggtgaatgagaaacccattctgaaagtcttatttttcaatgcattctacttaataactacaaggctcgtagacaagtggttggatttattcatcatgccatattttggagcaatattgtcacaaagaggaataggaaagaccagtactctattaacatgttgctgtgtgtgtcctatatctcaatgcaaatatggctatacctaagtgaaatatgtcatgacatatttacaaaacatgggatatctgctgtcaggcttttaaaatatattttaggatatttaggatagtttcaaaaaactaaaccatgtagagctatgtaagcattgatgattctacataaaaagccattaataccaccaaattatttgatattttaaactgttaagaacgatgttatgtaatactatgattttaactacccccacctttgattttaattcagagaatcactgagaatagatgaatttttccacaaagttattatttcttagttctcaggcacattaaatgagagatgtggcattctaaaatcaggaagagcttctctcttgccttttctcagtatggttgtaattagttataggagaaactataaaggcagagaattattgtaggaaatcaaaatcttcccatttcacatttgacccaacatgaactgttttcatttttatcatcagagtcccttgcccatccatataatataagttttcaatcttaacttgcgggtcaatttatagcagtcaattatttttcccagtatgggaagaaaaagaagttttttctgtgttgatgacatttatagttatgtttctgtttttatttagtaagcacaagctaaaagcataccaaaatagctatcaataatgccaccgttcagaaataacatgtgataaatactggaatatgtcttctcagaataattttggttagaagaagttatggttgtttttagaaagacagtctattagagtagagttctaaaatcagacatacaccggctcaaattctgacttgctctttgactttcctaagtctcttacagtaaccttctgtttcctcatctgtaaaaccgagataagagttgtttctacctcctgagattaatgcaagcattaaacctgacacttagctctgtgcggggtgtatagaaaacacttattagaatgttagctgtaaatttattattgagagcatattacaaaagctgttccatttgctttaaatctagatattgtatttaaagaacatttctcaaaaaaactgtcactgttgaacaccgtgtgcattcagaactcctggaagccagagtctcctgcaacttgtctttatactcatattctgaaagtagcatgaacgcacaccaaggcttatagtttgcatttattctaattacttcctctacagccccaagtgccccaccacagtctgtcactgtactgacagttggaagctacaatagcacaagtattagtgtttcctgggatcctcctcctccagatcaccagaatggaattatccaagaatacaaggtaggacccgggtgaagaaggacagctctcatgtaaaggttcccagagaaatctcagtgtctcacgaatgagacacatctctaaaggttctcttattcagtttaagtgtaaagtttttatttatatttctgtgtgacagagaatgaaacaaatgcataggtattagaacctgagttcaaggtcagagatcacacaaacccagttgaacaattaaaccacaccagtgaaatggttttctgtatagtgtgactctacaacctcaaggatttaaagagatgggacacagggtaggttgtgaagcctagaaaatggattttatctttgttattagaattctgcataagaggctttaaggcagctgtttttaaaccacgttctcagaaaaaaagatgcttcgggggttaaagaggtggagtgggttgtggcagcaccgactctcactctagatgctacttttgtgtatttattgaggttgtgtagaatatttcacctgaaaaaaagccactgaacatattttacaaaatactgacttacagaaaaaacagttgattgtctcatttttcaactgatgaatttttggctgtttagaaacatatgtatctattgtttcattgccatcatttggtgtgtaaagtagaaagtatgtctacgttttcaaaataagattctgtttgtgttgtgattagaccacatgtgaatgaaaaacccctcattaatctttgtaaaattcaaaactataatttattaataaatcatctattgatatcatttattaataaatatttctagatttctgaaaatagcatattctatacatctaatataatacaaaactagacacccatttcacctacaaaattcagagttggtatttaatattaagctgaataaatttactcaaaagtttgcagattaaattttatttctaaggaaatattaatttttacatacaattttattaaagaataacttgctaaagcaaatgaatggactaaatgtataaggctttattttaaaatgatttctatcatgttgtaaagacacatgcttaagaaacataagaataaatgcttttacaatacaataattatatagattctaagattttataagcattaggacattgttttaacagagtaacaaattatctactctgtgtgagtttgagtgtgtgtgtgtgttttaatgaggttaggaatttatttttgtaccatttggcactaaatatcctaaatttccatgtagttaaatattgttacttttttttacaacatgatgaattttttttccataagttgtaaatgttctcactctctaggcacttgccatattttggtttcaaagcacatatgtaggtaagagctaaatattccttcactaagaacacagataccatatatcaataaaagaaacacatgattcacaagaattattttttactgaaaaattctgggaacttacctgctccgaaacaaatcatatgttttcctacatatgtgtctacatgtagatttttaaatattgtataatatgaatacaaatgtggatacacagtggatttcttttcataacacatttcatcagaacaatttctatatccaagaagatgccctaaaatttgattcctacttgaaataaaagcctgacttccttaacatcaatatctaaagacttgccaccactttgttctcatgaatgtgtatgtgtgtgtagatatgtgttgatcaatattagatttattgctgtcaacgtaaatattggctttaatttcattttagtcaatacctataacttaggtcaattcatcttgttaactacttctgtgtaagttaatattttcttaaatgaaatataaattacttagatgtctacctatataccttagatattacaacttataatcaccatattttagtggattatatgcataataaatcttgataaataaaacagaggaaattatgtgttttaatccatacaaaaatgccatttgcaaccaaagaccacataccagaggtgttaaagaaatcactgtgctttctaaattactcactatgagcatgcagtgctgagaataagatataaatgaacatggcatagtttcagcttcccttattgttcttcctttaatacaggtgcatgtgcacacaaacacacttacatatacactcaaactgcagaggttgggctttagaagatgtcatttgcaaaacttctataagcctagaagatagacaggttatgattaaaaaatatttgatcagttacagtagtctcgttaccagaaacgataatcttatatccatgtgttattcactttccatttctgtagatctggtgtctaggaaatgaaacgcgattccatatcaacaaaactgtggatgcagccattcggtccgtaataattggtggattattcccaggtattcaataccgggtagaggttgcagctagtaccagtgcaggggttggagtaaagagtgagccacagccaataataatcggtgagtatcaaactatgtggtctgtgctttagaatcagtcagctgacaaggtggatgatgattttgcatcaacctactaatagtgaatatacacttatgaatgatagggtacacatatcatattgacaaatgggttaactgactagagttttttacaaaaatacttggtgcaattgatcatgctcttaaaagtcccagagccttattaaaattgcaatatttaagagtttaaatgctgaaaggtagtttaaaattacttttaatcaattgcctcattagcaattttggtgccattgaaatataataaaaatgagatagttactgaagagagaccatcatgtttcaaatctgtatgcttcctcttagtcagagaaatgtcaaaaattaacaagaaacaggtcagaataagctttgtaatctaaatataccatcccaaagaagaaatcatattaaatctaatatcatcattgcataaaattgttccctcttatcatagattatgtttgtctgttcttgagatgtatataaatggaatcatacagaatgtgattttttaaatctggtttctttcactaaggataatgtttttgaaattcatccatgtatgtattattcagtttatatgttttactgctgagcagtattcaattgtatgaatatgccatattttgtttatctgcttttcacctgacagaatgaatattactgtgtaaatgtttgtgtccttttggagaaatacctagggtctaatgtctgggtaaaagagttgtatagtttgagtttatgagaaactgctaaacaatattcaaattgttatataatttcgtactcccaccagcaagaaaaatgacttctagttgccctacattgtcaccaacatttgatgtttccagtttttgtgattttagccattctaattgggataacctgtgattttaacttaaattttcttttatgactaataatgtcaagcaactttacatgtgcttattggccattcacataatttcttttgtgaattgaccacatgtttgccttttaaaaattgggttgtctcttgttactgattagtaggagttatttgtacattctggatacaaattcttttccatgtatatgtgttacaaatattttctcccagtccatgacttccctattcattttcttaatagtgtcatttgatgaacaaaagtattacattttaatgaagtacaatttatcatttttctttgatatttagtgcttcctaagaaattgtggcttacctctagatactgaggatattttcttctagaagctttataattttagcttttatgcggaggtctataattcatctgatggtaactgcaatgtggttaaaggaatgaggcttatttatttccatatgtttttctttcatagaggttatttataagtgtattatttaatttccaaatgtttagggacttttccagatatctttttgtttctgatttctactttaattcccctgaggccagagcctcagaataatttttctttgtgtaaatttactctattaaatatggagacttattttttgacacaggatttgatctcattgaatgtttcttgtacacttgaaaagtatttgcatttctctgttttttcagtggaaggttttatctcaggtcaaattatttgttagtattatcaggtctttattgatttctatttgcgctcttaattactaaaaacagtctggaaatctattgtaattatggatttatgtatttccccctttcatctataagtttgtgtttcatgttttggctactttgttttacatgagtatgttttaagattattatatcttctttttaaatttaccctttattattattaaatggctacgtttattttctggtgagattccctatcctaaaatttactttgtctgatattagcatagctacatcatcttttgtaagtaactgcatggattgtcattttttcattctttcattttaacccatgtttctctgtatttaatgtgcagttctattaaattgcatattgttaggtgatctctgctcactgcaaactctgtctccaaggttcaagagattctcctgcctcagcctcctgagtagctggaactacaggcacatgccaccacacccggctaacttttgtatctttgtagagacagggtttcaccatgttggccaggctgctctcgaattcctggcctcatgtgatcctcacaccttggcctcccaggcatgagccacctctcctagccagtcttgtttttttttaatccaatctagcaatctttgcctttttaattgcatactcagaatgttattattaatgtaatcattggtgtgtttgtttagaattactatcttgctatttgtttgctaactttgttactatcttccaaatttcctgctttcttttgataaaatgagaaagggttagtattttttggctgctcttggattattaggtacacctcatttctttgctgacagttgctctaggatttgactataagtatcctagagcagtatagtgtcactccttttcctctcatcttttttttgttgttgttattattataccttttacttctatgtaataaacagcaatatacaaattatagctctagtgttgtttttgccttaaacatcagttatcttgcaaataaattcaaaataaaaagtgcagttctcatatttatctgatattctgctccataaattcagtccctggtcaggcgcagtggctcacgtctgtaatcctagcactttgaggggctgaggctggctgattacctgagctcaggagttcgagaccagctgggcaacatggtgaaaccccatctctagtaaaatacaaaagaaattagccgggcgtggtggcgtgcacctgtagtcccagctactcgggaggctgaggcagtaaaattgcttgaacttgggaggcggaggttgcagtgagctgagatcgtgccaccacactccagcactccagtctgggtcactgagcgagactctgtctctccaaaaaaaaaaaaaaaaaaaaaaggaaaaaacattttcagtcccctcagcttccatgagtgcttcagtcttttcaactcagggatgctgttcagcaatgtttgggttagtcttggctgcatcatattttaaagttatctgtaggtacaaagctgtgaaaatattaaagttgtccctgtttctttcccttctgtctgagatcacagccctactcttttctttcacatattttgcctagtcttctacttgtttgcaatgggagtgcatatcccaatacctgttatttcttcatgggcagaagtggaagtgtccagggaactggtcatttcatatattacactttcctgttctataacttccatttgctttcttttacacttttcatttccctctgatgttttccatgtaatcatttattatgaccatattaagtccatacacctattgtaatagctgcttcaagttcttttctccttatttcaacatccatcttgtctcatagtctacttctattgattatcttttctgctgaccttgggttatatttttctggtttgttgcttatttattttcacatgcctagtaattttttactatactgaacattgcagatgaaataaaattttgtgatcttttgaagcatgtttgtgtcctagcaggcacatacattactgtctggtcacctttaaccagtgatgtcttagtttttacattggttagtatgggacttcttatgtttgcccttattctcaagacaaaacctcagtaaaatactttcaaggcatgatcctctcctgggcttccggtgagaagcctcatatgtttatctggtcttcctaacatggtttggaagttttgcggtgaacatgagcttaaacctgtgctttcaccagatcctacaatcttctctttgcatgcacagttcagggttcacctttggatgtaaggggagagtatacacaaatttgagagcatcactctccaccatctccctctttcatatggttctcctctctattttaagtcactctggcctccctgaactccaccctgagacacctcatatcaataagattgagttttttcagctgaggtcctaactgcctcacactgtatggattgcggtgctccctaagggaaagaaagcctcacccctgcagatttcctctggtaaagcgccgttcattcaatacatgcatccccttcagttttccctgcttttatttgcttgccagtgcctttaaagaaaaataaacaaataagaaatcttcttcctagagtttacatgtttttaaagtgtttgatataagccgttctcatttttttctatttatttgctaaaatgatgcatataaagctgactgccagcttctagagaattctttctattacaaataagtattgtatatggacagatttaacattcagtcatagcgttaaaattttttagattctctaggttttctttcttttatatattaaaagcattgtagagaaaaagttacagtattaacttttctttaaattgtcttctctttcttaattagtcattcagactgaattaattccttaacctgagggaaacctacaatcttgtccttctgagattttctaaaataaattggaataagaaagaaatacaggtataccaaaaaggatttaacttacatgtgtgtgtattcatttatagtatttagaaataagcccttattttttcacttaagaagttatatatatatgtatgtgtgtgtgtgtgtgtgtatacacacatacatatatatacatatatatatatacacacacacatatatatacacacatatatatatatatactatatactggcatatatatgccagaaagacagtacaaaatatctatatctgtatatctttatgaaatggattggctgaatataattgttctaagtgaaggataactaagattgtcaagtaactgtcaaataacgtattttcctttcatagttttttttggttatctttagtaataaatactaaattcttaagtagagctttctgtttctttttcttcctagtgactatctgtttgccagatattttatctgtttgccagatatttgggggatttatttccttatagggaagtaaaaaattacaagcatacgatataaccaagctcatgtcatgacaatcacagttatgcactgaacaattgaactgtaacttaaaataataaagttaatgattattttaaaccaaatagaaaatttcacttaatttccctatcatttataaaagtctgagtcttcagatgggtaatgagtaccttttaatttactatttagcatttcatacaagtgttttcacatttttctatgagataaaagtaacctagaaaataatatatctatcttttgttcaaatagttggaatatgctgtactcaaaatgtaattataaaaatagaattacagaaattctattttttgtgtacacacacacacacaaatcacaattcaacctagaaaaggctatttgttcttcagagatttatttctttttaatatctactcttgtactgagaagccttctaattgtttctttaattactccttcgtatctaccttaacatcttgtctgatgcccttatctacacaactgttattccttagttgagaagtgatttagtgatggctaatcttcttttctgtttcaatttacactttcccattgtctattcagaactggaaacggcacttgaagtgactcaaactgtatcacatttcccctttgttttaattaaatcatgtattggcatttgatgtaatttatggttgagaattttagatttgtactatgccagaccatgtattgtttcatctattccttctcagtttagccttccttccagaaagttccattaaggaaccattaattaaaacattgtaaaaatgtaacacgctgccttacactggcgtaacattggtgttgttcttttctgtgcagtttcctatggtaagatgacttttacatcatagtgtccataattctgcatcattgcatttacagacacaaaaatgcaatcaaatacattcagatatatatccattaagcagcgtgtcatataaccaatttacattgacttaagagttttagttatcttgcttaatagtatagttattgcttctctaatcatttggcttttcacgcttacattacatagttggttataatatgtggaacagctgcaaactttcacggtaataggtacaatcgaatctgatgtgtctaattaatttttagtccaacaaattagttttgttcttcattactctccaatgggatgaagacattatatttcattatatttttttgtctgcaagaacaatggagcattacaggtcacacacatcccttgtctatgctctaattagtccaactgacaacattgtttcaaaaataccagcagcataaaaaatagcaatacaccttgagtaacataaatattgcaccttaataaaaatgaaatattatggatcctttacaaaaatgaaggccaaattttcttttctctttgttcaagaagttatttgttttctttctgataattcctaatagttaaggaaatcaccagataggtgtatgtctcatattgaaaatatgagctcattttaaatacagctttgactatgtttaataattatatgtataataatatataatattaaacatataataaatatatgtataataattaaaggcagacatagtgggaaaatgagccagatttactacataaatgacgctggtttttaaatctgaaatttaatacaaaagacctttcaggaatggattataagtatgtataaggaaatgctagcagctataataaaaaagcctgaattttgaaaagattaacaaaataaaattttatttctaattcacagctcagaccaatatgggtcagcagaatgggaaatggagtttctactccataccgttattcaggggttttggatctttcaaatcatagctctgccatttcttggaagcttaacatcctccaacagatcccctgtttctgtccaacagtgaggaaagagagtttcaagtcaaggcagtgttacggatcaggcctggagggtcgtgtgcactttttgttcctagttaccactggctaatgctcagttacttttttgaactctgctgcaaaagatgctaggaagtgtaggctaattttctgccttggaagaaaggagaagcagtgaggtaaacaagtgaattgagatttgcaggattctcaaatctagataatttatcactcatgacactgaggttgactgagaagcccttaaagcagcccttaaacttacatgggtcataattttgagtcaaaaactacatattagcctccacttcaaccctcccaaaatatatgaagtagacaatactggtgccaactaattgacaggggctctagaagatttagtgccctatataagcttactgcttacttagctagtaagtggcagagtggtttcatcaaaatcatgacttcaaagatcatgatctttttaacatattacagtgctatagctaaaacaaggaaaatcccacacattcctttgatgtgatatgctgaaatgtgccatttatattttgcttaccatttaccttttaaaagtctttcattaatcactaattaggcatgatattaacattagaaatcacttaattcccagcatctacatttcttaatctgctaaataagccaataaatcttatgattccacaagtttaagacctatttaaaatgtagattgagattttcttaattatctgagaggcctaaattttccaaacatgactagttctagaataatcttagttcagatttaaatgcatttctcagtaatggagacctcaaagttaatttttaagttgttctttaaatttagctttcaaatggattttcaaattagtttcagatactttaagggaatatatgagtttcatctttttcatattttaattatacacgctgatctctgtgaaggctgtttacataattgtcattgttttgtatagtagttttaatacttcccagaaaattaaaggatattggctcaaaataagttctttggtagaatattaaggtcaacattaagttacatgttcttgtgaattatgaacatttggaatatggaccgtgccttagcagaaaagcaatttgcaaataccccatgttaaaagttgtaattgctttcttaaaaatgagaactgtatttaaaaacacttgatgtaattcaagataagttattaattcaactcctagtacttatttttataatttataaggtgataaatcaactacgttgtgaatccatccatagcaaaccacaacacaagaggtcagtgttcttaatcacatttgcaaactcacgatttgattattcttttgaaaattatgggctatgcttatcaatacttgtgataggctcaaaactaaacaagcatttcctgccttcaaataatttttcttcatttttgatgcaccatgtttatattcctgtgcttattttcgttttaatatatactaatactatggttttttccatagggagacgcaatgaagttgtcattactgaaaacaataacagcataactgagcaaatcactgatgtggtgaagcaaccagcctttatagctggtattggtggtgcctgctgggtaattctgatgggttttagcatatggttgtattggcgaagaaagaagaggaagggactcagtaattatgctggtaagtgactatttccagctaagaaaatctcttgtctgtaggaatgtaatgaaatgaatggaaggaacagaaaggaataacaaatgagtgatttgggcttattttagaaacctgcactgtaaaatgcaattacactcaacatgctttaatgcattgctcttgacctatcgctttataaccataaggcagtctgtttgcttgtagctccagtgaagcataacaagagcacagactgataaaaatgcttaactgtttttctcaactagttctttgaaatcataaactcaaacacacacacacacacacatgcacacgcagactatgtgttacatgctatgaagccatgtttgagaagtggatttatgcatgagcattacttcaatgttcaggaaagaagaaaagtttgaaatatagcttttagtgtgtcaggatgcagattacaataggaaatgtccctcgtgaaaaatactgacaagcaaaaatctcaccagaattgataagactgatgaggcatgaattaagtgatttactgttcacttaaatagactcttattacaatgcaaatgaacagtattttaaaagaaaaggaaaacgaagaaaaagagaaagaagccgaagcagaacaataaaaagaagaccctagatggtctacatcttcacaacaatgttttcttcttagactccaagacagagtttcaagggtgtcctataatgtggccttcaaaatatctccatggtagagagagaagagagagaggacacacaaaattgtaaagtcagtgattgagagaatgaactcaatactgaagcaatgttcaattacaattttaagtgcactttattttaaatattttctccaacaacaatgataagaaatatctcacaacatttcacactttctagaattaataagggagcagttttaatttgacattattttacaaatatgtaagaagtttttgagacattatattcaatcttgtattcctaatattaaatttggtaggaagcataaatgtcttagtaactgattttgacagaggcgtcattgattattaagcttttacgatgctgtggcttgtaggctcctaaactgctgagaatgtggaaatagtgcaaaatgctaagtatagcactgacttggttgccttgtttgttatttgatgcatttatatgtttatgatcatttgattatagcattgtagcttgtgtctatatcttatgaagttaaaatttattagttacttgttagaagacatttccaggactagagaaagtactacagcatatccattgacaagaggcttccatgtttggtgacatgccatcattttgccattctcatttctcattggttgctgcctctctgcttcctcataatttgtcacccaagtgctatatcacttcaacagtgaaggattctttgcagaaaggggtgctaggcagtaactgagtgtcagagtctggaaaattaatgatactttaatgtaccttcttgttatgcagtccggttctctgccttcatcgctgaaggtattgcccatcaacctttctgtttaatcagccaccatgtcatattacatctctgtgatacactcgtataaatcatatgaaatataaggaagaactgatttaattcatggactattttgtgtttatccctttgcttgatgttagcaatgataataaaaaattgactgtgctggtcagttcggtgcaaagttctaatatattcacatttggagtgttgcatttttatcttccatacttcttcattcactcactccttataaataaaatatctctcatagttggtaagtttatactgttagtaaaattacaccagagagacttttcttcttttttttaacagcaattctttgcacaacctatgcacttaaattgaaaatatatgttgatcattgagcttgacaagaatagtgcatttcctgttacaattttttattgttattgctactcatctgcttgtagacgaactgctaactcagaaggtgctatgcccttcaggtgttttggagtaaggccaagccagagagaagcctttcagaagttttttacttaactgatagatggctcactatgaagataacagattttatgaagctcagtaaatataaacaatttaatatgagtgagcaaattatgtgaaatgctaaacacttcacacataggtcttaaaatcatcagtgaaatatacattattagacaaaaccatccaaggcacttaaaagatttgatggattttttatactctgattatctgggctgagttagtgcttattaaaaaaggattaatctgcattcatatttgagaaacagcttatcgggaaagggaatgaggcttgcctgcaacagtaaagtttctatttggagtaggaaaatgtgacctactaaagataggcactctgaaagcttcctcactcaaaatgtcaatttgccacagttatgttttctcctcctctaccccagttgtagcaggcatgagattaggattcatcctgtgaggtaatattagagttactttttgtatgttataatcttgcgaaatctctttaccttatatttgtgtaaaaattgcaagaaattcaaaatatttcatgcaattcaaaaacattttaaattgtggtgtctgcagaactttttggaaaccttagccctattcagttagtgtaagctaaaatattctgtatgtaactccttgaaagttcttaattttagatgctaacagagacttttgattgagagtcacagttattccatatgtatctctaataagcacaaagttactactctgtgattatcaaaattgtgacaagagcaagattgtctgaccaccccaacccttcttacagcttcaaggcaaacacttatttgaaatgagaactacctcaaaatagctttcaatttgctctggaatttgatttgtatgttcatctctctgcacacagacacacaaaatgctgatcaaaacaccagatatgatttccattttaggagttctaattgttcatagttatttgtagtctgccctaaatctcatgatctaatagaagttagttacttttgatctacttttcaaaatagaacaaatctaaaagttttgaagcataaagtaaaaaatgaaacttgaaaaagtgttccctgtttttcccttgctttaaaaacacaactaaataacccattaagataagggtttttaaaaaaattctgacagaaacaatacaaaatggaaatttagattgtgtactaaattgtatgtgaacctttttaaggtcatcaaatatttacataatgtgtgaagttttgcctttgtatacttaatatgcagagatacagagataagtgtctttatagaatattttgacaccctattagcagtctagaatcatttgaaaaacatattttaatgatgacgggaacagaaacagaaaatagattgtcccaaatgcttaataagaaatatttttaaatttaaattattttgctcacagcatttaattttcaattgccagatatgggccatacatactatagtgttcatactctaacaagtttgcaaattaactttaatgcattatgtgtgtatatatatataaatatataattttttcttttgagagagagtctcactctgtagcccagactggagtgcagtggcacgatcttggctcactgcaacctccaccctccaagttcaagcaattctcctacctcagcctcccgaatagctgggattacaggcacttgccactgcgcccggctaatttttgtatttttagtagagacggggtttcaccgtcttggccaggctggtcttgaactcctgacctcgtgatccaccccctccttggcctcccaaagtgctgggattacaggcgtgagccaccatgcccggcctcatgatatattttttatagggttttcagtgttctattataatactttaaactttacatgtcatgaagaatttgccactggttcatgtattaaagttaagggccactcaatgtttgtacctctgtgtctgttgtcctccttttctctaatattatttattgctctggcagtaacagaaagtttgaatgggacaaaagagcatctaaattagggaaaactacttagcttctcacatatctcttgaacagcacattttgaggtgtaacccatgagcatctgcttatttgcatattcacaatgatattcacaccattatcttaactctcttttaacagactaaaacaatcacttgatagtccattaaaaaaaaaaaaaacacaaactagaaagtcacatcagatggaaagctaattagctatactgttttcacattgcatgtgtactaatcaggcatttatttaatatctccagtgctcaattttttgcattaattatttcagattaattcttttttgttaaaagcagttattaaacgggcacaatgtgggacagatgcactgctgattcctgatttcccgcatttcagtgagccttttcatcttctctgagcatgtgcctatagccagtgttgagcagatgcaaaggttatgtcaggattgttttgcaatgcatttgagatattacacataaaattgataaggcagtatatttcaggtaccaataagaagttcctaaaagccctgatatgctttactgtctcatgaagacccttggagtttagagtcatattacctgattatgatagcatgagagataatattagtagataaccttaaaggagggacttcatttggaaatgtgtaaaatttaaagagcgatcatcatatttgatagcccaaacttgagaacagaggagttatggagagttattcaaagtaagaagtattcactatgtgtatatatattaagtggcaatatatcctctatttacttacagtatgaatcaactaattaaatttcatttattttcacctgtactcaccacaggaaaaaaaatcatagtaaatataatcaaccccttccaaagatagggtttattgggttcacagctgtgaaaatagtattttttttccttcatcccggtgattggtttagccaatccacattaattgtggtcagaattgcaggtttattgcacttttgcaagctgtacacttctaaacaccatgtttctttttaaaaataattttctagttaactaatttaatggcaaaatttgatccaaactaatgtgaagctacttgtagactttatcctactaatcatggatattcacattccactgcagaaaaactaaataactttgaatacagtttactgtctcagaacctctttgtaatatgcaaagtatattacttttctcaattctgaatcattctggagtccagatccatttggctgcaaaggtttgggtaatggatgatggacctgaactgataataacattctttggccagtccttaaaatccactttcatgttgttaggtttgtaggcttgaaactatcggctggagagagtggcttcactggctgtggctctggtggatgcttattggtgttgctaataagttccatagttacatggaggattcaacttttctgatcactacatacaattaggaatatattcagtatcaattatttgaaaatttcattttcatgagcatgttattctctattaattatagttcacacctgttgtaattatcactgtttatgagggtcataaaaggatttgtgatggtgaaaaatctgtagtcaataagtatttgtttttcttgtttcattagaacgacgtaacatgttggaactttcctgtttcaatttatattatgagtgttttgtcttatgccttctaattaggacacctttgttttaaaattaaaaatcttgatttgataaattcacaataatgctacgttgatcttgcaataccactatatatactaattgtaacaggtttgacatttaaatacaaattagttctttaacttaaccatggatttggcttaaagaatttgaaaatgtcctattaaaattggagcaaatgatggctttgccttgggccaaaccactgcttgttactctctgtacaatgatgttaattatattttgttaaaattcccagaggcctcagctctaaactaagggccaatatgtagttgttattaattgtaattaatattgactacttgtgtgtgcatgtcttcctttttttcttttttcatagttacgtttcaaagaggagatggaggactaatgagcaatggaaggtatgctacggagattgtttcattattatttttatttttaatcaggactggggaaactctatagtaagagcctattattgtaataaatgatcacttaaaagtctgagaattctaggaggaattaaatggcttaccacaaagtttaatgatctatctgttgtgcactttagaggaatcaagtccagatgtttcataactcccagatgcccctgaagaaattagtagtaaatatcacatggaatgtgttcatttgttagcaggatgtttattgcattaattagacattagcaaatgaagttgctgttgtttaagactccttataggctctcactaaattgctgtgagtgaacaattacacataatcgatcacaaagtaaatgattcatggatgatgaataggctatagattgataggactggattccacaactttggatattcaattgaaattgataaaagctgataacaaactcatatatcctcatctattttccctttgccaatatggagattgtaattaggctctggtaataacttccaatctcccatttaatcaatattttagcaaaaagagattaagtctaatgagagtttgtggatgtagcaagaaagcggttgggtcttcttattgcagtttccatagaaacacatgtttctcttagggattgtaccagaaggggtctatcaaaagaaaagtgcaatgattatagatgttctatttctgtgtaaatatgctagtaatctggaaaggaatcagaatctcatcttttatattaaagaaggaagttctttactaaatatgacgtgaaggaaattttacttatagactatactcacatgctggatcagatcacagtgtatcttttattacctttaaaaaaaacccttaatatacccctgatattttgcaatttagaacttggaaatgtgctatttatggagcagtataaatactgttcattaatttcacttcagttccttgcctccaaatcaagcatgagggctcataacaagggttacagcctagagggaacagatacgtaaggtagctgcaggaattgaggaaggaatagcccaaagtcttagaaatggctgacatagagcagtcactttgagcagttgttcccttgtggtgccaatgtatcatcaaaccttgttttgggatcctagtatgttactgatttctaccagtttcagggcagacacctgaattcatctggacattgacaaaatcccgggcaaggactccctgcgtccactgttaatgtatgtatagccttaatgaattgctggagttctttaattccagggagtctacttatattaatttgaagtcaatgaaaatcttccatttcttaacgctttatattgcatgagacgagtgtcaaaatcttgcattgagctccatgtgttgatttccttgtaatttctgttttagccgtccaggtcttctcaatgctggtgatcccagctatccatggcttgctgattcttggccagccacgagcttgccagtaaataatagcaacagtggcccaaatgagattggaaattttggccgtggaggtaagttgtgttttttaaaatagtgttatttgagttctctctctctttttttttttttgaccttcctggatttttttaaagaaacatatcagagagtatttactcccataattaaaatcaatgaaacatatgcactaacagtgttgtacatttgctaaatattttaatataaaacgattgtatcttcattaccttgagtaaaaccaaacttttaaggaagctattactaaccaagatgataaatatttataatatatatgctttcaggattactagtacaagattactgaactcagagactattttgttaactagggcttatggttttggactagaggtttcccttctccatctcatttaacatgtatttattgagcatctcctgtgtacttggcactatggaagaccataagaatataataatgatataaaaaagatggttcttgccctcatataatatgtcatgtaagaaatagacaattaagtcaatataacatgttgagagagaacttttctgtagttccacaactagtaactgttatccaaaaataaataaataaataaataaataaataaaaaagacaaaaaagtgctaagtagccacatgcaagccttcaaaatttggtgccagagtcctctccctgtgggtttgtaaggagacacaagtaacctactgtaaataactaccacctcccctgacttcaccttttcatccagtcaataggagagagctgggtttagagaatgatgagaggagtagggaactctctgatctcagtgtggcttggcaggttcatgtgagttttccgttggtggaagattgtacagacattaaatgtgcttaaactgccttgccagaaccccatgtggcatgtctaccaattgggagtaagaaagctctatgaacagaatattatttaagttgatacctgaagcaaatttaaaaatgagtcaaaagtatggaaaaaaaaaagtgtttagaaaagaagttgctgtattttaagttccacaaataaaagagacattgacctacttgagaaatggaggaatttcctaatgacttgagtataaaatacgaggaagcagaaatggtaagaaatatagaaggatagataacaaaggaccttttaagccacatagagaatttagacttcgttcagagggtaatcagaagctgttgatggatttttaagaggagaatgctgggatccaagtactccaagtactgttttaagtcatccagcctgctgctggatgaagaatggagtaacggtagaaaattggagtgattaattagaatagtgctgtaatccaagcaaagctgtatgaattctctgtaagatttctgcacttttagaattaatgaaggaggcccagggctctgttaaatttttctgagtccactataagccttgatgggttaatttcatatgtatgagtatataaccagattgactgagaactgagaaggatattcatagcatgttctctttaagaatggattaccactatgtttgactatatttgaagttgtatttcaaataatgaagctactgattattgcataagtctgcattctgtcagtaccaactatgagaaggggaactcccttcccttctgcaaataaaatacagaaaataaccattcctacttcataggtgtgtaatgaggattaaatagatgaatatatatatatatttatttatatagaatatatatatttatttatatagtgtgtatatatatatatatacgcacacacatatatatatatgtgtatatatatatatatcccaaagcttggcataccatcaatcatcaggcatcagtgcagtgagtgagagaatggaaagtaagttatatgactcctcagcttcctcttccgcttctgcaagccaacacaccccacttaggactctcacttgcccagatactctggtagtggcttcctcccctaagtgacccgactgtgagcaactgtcagctatcactttgccatgggtagtttctgtgcctgagcacctgctcatcaggaaacaagaatgtccctccccctgctatgtcgactgattttgtcaaaaggaattctgttcccacagcttttgtcaatgaaggaatagctgactcttttacctcttgtatttttattgaaataatatgacatgctattgttacatgaaaaagtgaatgcttacagatggagaaaatgaatattcagtttccacaggctaccttaacgtctaaaatatctcagtcaaatttaacaaaagggtacacctggagatttgcaaggtttttcttccattttcccttaattttcatgatgtgaaatatctcatagatgaacagcaaggccaagacaacgtttttgtagagttgactgtatcccttatccatgtgatagtcattttaagcatttactatgtgccagaaatactgttaaaattttttgtatattttaattcattttgcttgcatagtaatatatgaaatagtcatatttccattttaaggatcaagaaactaagttttctcaagataaataatttgagatctggttgtagaaaactctgctttgtattgtaaaggcagattcacatgtatgactatataaccatattcacttggaagaataagaatggatactgacattttcccacaccacatgttctcactcataggtgggaattgaacaatgagaacacatggacacaggaaggggaacatcacacaccggggcctgttgtggggtggggggaggggggagggatagcattaggagatatacctaatgttaaatgacgagttaatgggtgcagcacaccaacatggcacatgtatacatatgtaactaacctgcacgttgtgcccatgtaccctaaaacttagagtataataaaaaaataaataaaaaataaataaaatttggcaaaaaaaagaatgaaatgacaatacgtttgaatgtaataaaaatagtacttagaataataaagttactaattatagcataaatccatattttatcaaaggaaaccataaaaaaaattatttaaccattcaagtcagcaagtgcttactctcttcaaaacactgggtgagcaactatgaaaatgcagacataaatcccatatgctcctgtcttcaaatgacttcgtgatacagtgaaggagacagtcatttgtacagataattatataaaacaaaaggaaataaatgtgagtacaagtataaccaaggtgctgaaaaactacagaatgaattaccaattccaagtagaggaagcatttccataactcataggtttcaaacataagtgttaacaagcaccagtcagacagcctaaaacattaaggactggtaggtggggactgctataaatggaaatggaaaaaagacctgctaaatatgacatcacctatttaggtctagcctgttgggaggaaggctagcccagagttccaaatcatctggtattataggactctccttaacatccaaatattcatgtgcaatattccaatatttcgatgctagaatacaattcagtttattttttgaaaatgtagggatgatcaaatcatatttgaagacaatatgcagcctaaaaatcaatacagaagcacttagacttaaaggctgactataattttatctagcagggagaggagagattcaatttccagagccatagcattagttgtatagcaatattatgtaggattagattcttggaccacttttcttcattgtttaacatttgagcacacagccatttgaaaagcttgccatcgaagtggcttgcaatccacatctaaagctttggagaactttaaattcaaggtgtgtgaaattggagctcaagttggggaatcaagtatattcacttaatattcatcagtgaaggacatggtagaagcggcagaaacaaaagtctgaaaaatcacccagaatgaaggatctattgtgaccaatttggatatactacatattaaaagtttttgagaaataaaaataatactaacacttgagaatgcagtatgcttaacatcaaattttgtaattaggacatagctcaaagaaagaagggcaagaaagtagttgtgaagttctgaaatttaaaaataatgttatttgcttatacaacctggtgaaatatgataagttaaaatatgtttaacaacttcactgatacacatttaagatatttacttcaatatcttaagtacatatccgctcagctgtaaaacaagctccaaacttcaaaaccttcataaagacttaagttatgcagtgtacaaaatatagtatacatttctttctacacttgctaaagaagacaatttttagcttatgtaaaattcaaaagcaaaagtaatatttctataagaatttttatttcaggtactattgagtatcagctaatctaaaagttttaagatagttgaaaatgtcctataatgaaagaatgcagtgatttgatggcctcaagtcccatgaaatgaagctttcagaagatagcttattttaaaatgtactatataataattagattcattttaacgctacaggattaaaaacagtgttatttagtgatttctattttagattcacttagtatctttcttccaaaaagggaaaataagagctcaggagagaggcagcagttctgaattataaagcatcatgtaaaaataattcagcataccaaaatgaaaaatggactgattgatattcagtgttgctcctggagtttaattttactctagctgtattacaacatgaaactgtaattctctagttcggagttgatagcataaattaaactcaccgatcactgagattgctttttctatagttaaattctgctatattgtgaaaatggcttacacctgaaaattttcctttgttatacaagaaaaaaaatgcactctccttttctggagcaattaaatcacacaataagtggcaagttatagcttcaaaaaatatacttcatagtcggtatagtataatttttgaaatgttagcatgtatttagcagttgtagtccatgtctcttgggataaagtggaaagagatgtttttcatctgtgagttgtggattcagtatcattgcaactgtaaagtgctaacactttcattggctctaaaacagagtgaacaactgaaagcatttttctgtagtgaagtatgccaaccgtctcattcatggttaaagaaaatagggggaagggtgttttaagcagtgagacgtgaagggcgagcagtaggcctgcctgtcactgaggctgatagcttggcgatggttgtatatcatctacccttcagtggctcatgaagcccatctcagctgaaatgcaaacgtgcagtgtgacacacttatttttcatcttcagtcctgatagttttgggcttccggtgcctcattaaattgtttcatttccctatgttcaccacagatgtgctgccaccagttccaggccaaggggataaaacagcaacgatgctctcagatggagccatttatagtagcattgacttcactaccaaaaccagttacaacagttccagccaaataacacaggctaccccatatgccacgacacagatcttgcattccaacagcatacatgaattggctgtcgatctgcctgatccacaatggaaaagctcaattcagcaaaaaacagatctgatgggatttggttattctctacctgatcagaacaaaggtaacaatggtgagtcaggttcttgtgtcctgaggaggtattttcatatcatttgtgcatgagatagaaattagtatttgttgtttgacttagtgattcattaccaggtttactacctaaactaaaaaaagataccagcatgtttccagtaacttgagtaattcctaccaccaccaccgccaccaccaccaccaccaccaccaccaccgccgccgccaccaccacctcctccaccaccaccacacaccagtgccaatcggtttcatcttttagctctttttcaacctaatgatcaacaatccatctctacttccattagggcagggtagacaaaacattcctccactctcccacaacatctgcttctgagttgctaactgcatgttctgcatgggcttgtgctgtgaactaatcacatgatgccactatgacctctgccctttaacccttagccttactttacattcctgactaccgattggctgagggattgtctaatagaatgccacacaaccagtctcaggatttcagcaccaccagctctcacaacagctcagaaaggagtggcagtctctcaggttggtctcatcacagtaaggagaaatatttgtttgtcaccagcgtatgacctgtgttcctaacaaccatgaagatatactgaatcacagctcactgtcaggcatttatctgtcaaatgacaacagtttatgctaatgaaatcatgccttggtgggataaaagggaagagaaaaatcactgtccccttttatatactaactctatgaggaaatatttaaagaaaaattatgccattctactaaatactattcattaaagaacgagtaaagagaattttataataaaaagatcatacatgaaagtcaattccatgttatagataccaaaagatgaattcaactaaaatgaaaatgattttggagtagttcataatattagtatatcattgatgtgacctcctatttttggacaagatttcgaaataccatataataggattttttatctattgaatgatattctactgcactatacaagaaagttaatatgggaaattaatatttaatttccaaaaaaccatataatctttgatattgctaattcttttatggtataaattttaatatgtatttgagatatatcagctaaactgacaatctataatgtcagtatcatatagcacaaatggaaagaaacaccctttactggacaaaaatatatacctattgtaatgacttatgaatgaaattttcctggcccaaagatccttacctgtaaaatgaggaggttgtagtagacacactctaactttcaaccatgacatatacattgtatggctgatgactttgtgcatttctaatttattccatgaccccacttgtttaatttgtttggattaactatatgctatttgtttgtactgagattttgttttatttttttaattacaggttatttgtaaaagactatagtgtattatggcatgtcacaggctaccaagcatcaaagccataaagagttaaactttttacatcattagggtaacattttctaaattacttttcctcaggagatggaaccctttcagtctgaaaatgttaatgctccctcttcccttcaaaatgggtcatttgctcttcttgcctattggtagaattagctatattatagaatccagaaaattttaaacatctgttatgaatttaaacaggtttaataatataggagaactttttgaataaccttatatgtcatttagactgccatttatttataataagtctcacaattgttctgaataattaaaaagtaatttatcctgggcttcctttttatttcattaaagatatgcaaagtcacatgcagtatgtaaaaataaatctatatactataatccatggattacttaagacttttaaaaatctttctttaagtattctatatgtgttgattgccaccaccaagttttaaaagttgtcttttgagtaactgtaagcagaacacaattcacaatagtacttagtgcttttttgaatccattaatctcctgagtgacatttatatatatctatgaattatattaactacttcatctacatttgaatacaaaattacttaaattgatgatagaaagcattctttagtaggtgagagtgattattctctttttagtttagttcaattgagtttaatattagagttttgtcttatgcttataatcataggtatctttcctaagacttaaatttaagatcaaaccaccttgtggataactaatcatatggtattataagattttcttaatttgtggatagcaatgtaagcaatttaaaataatcacagtgataaaagtggacatttcagaattatttgagtgtattaccctctttgaaacacttaatatttattcaatatataagttctgagcacttccattaaaaatctaaccattaaaaatataaaatcaccagcctgagcaacatggtgaaaccccatctctgaaaaaaatacaaaaattagccaagcatggtggcactcgactgtattcccagctacttgagagtctggggtagaaggatgcttgagcctgagaagttgagcctgcagtggatgtgatcgcaccactgcactccagcctgggtgacagactgagaccctgtctcaaggaaaaaaaaaaagtatatatatagtatatatatacatatatattaatatacacacaaattaaagagtttatatatgtaagtcattaaaatatgctcccttaaaagataatataagaaattctcaccttaaagtgattgaaggttctttgtttgcaagtaacagcaacagactgtggcttacttcactcaaggttcagatctcagagaatgtaagtggctttggttctatgtatgctctccaccatgctatgaacctaccattgctcactgctaaaagaagtcaggtgtgttgatttgtaatcctacacgtactgcccataatgagagagcagaaatttcctcaaaagaagagaaagtgattgttggatagaaagccctcacatatttcttctatgaatcacccgtttcccaaatagatttttaaatctgtttggaagagtaggtaatgaatggctttcttgaactttggacaatgacttcaacagaattcagggctctggaagtagtaatttccagtaaagaaagctgctacattctgaattctgatttttctcttactgggtgaatgtggaccacgtaacactcagaatgaacctcagttgcttcatctataaaatggagatgcaagaacttgtctatttctgttactcagttctggtggtgaccacctaacatttctaaaagtaccatggaaaacgaaaagcactctctctatatataaataaataaggaataaaggaggtgaaactagagagaaagctatggaagacaagtagctcagtctgttccccttttaatcattgaaaccgagttctgatactacaacagaagaaatggttcctgtctgataattttgctgactcatcaggaaacaaaggattaaggttcatctaccttaaagacaaacattacagatgtatattcaagcaagtttattgttattctgagtcaggctgtttgtgggatactcatagggcctggagaagttgggagtaaagaaagctttagaaatcaagaggagctgggtttgctctaagatagaggatatgggggaaaaaaaagaacacaaatgagtggcatttattgaatgttctgtccattctgagtagttgatatgcattgtctcttgtaattctcaaaataactgaaaaaagtagtaactttatatctgttttacatgtgcaaaaatgtaggcagtaactattgagtaacttatccagtaagtgggaaactggtctgtaaacccagatacgaaactcttgtcctctaagcaaaagatgtctgctctccttcctcttaaaatcttttattctaccaaacaagtatactacaaggcaagatgaaagcaatttgtgtgcagggatgttctttgaaatatgtgtgaaggtgtgcatgctatgtggaaaacacacactattttataactggcaataaagtatatatccagtttaacagttttatcacttcctggtgctcaaatatgttcctattaaattacataatattcaacgtggctgatgcagatgagtaattggtagaagtaaggggaatagtaggcttctagtgatattataatacattgctaaatagccctgctacaaatagtttttgctcacaacttgcggttccagaaagatgaagtcgaaagaatcagtaagatttttggcagatattgctgtaggctgtggtgggagccacagaagttatatagtgtcccctgaaatgtcctttgttattctgctccaagaagtactcattcctcatttaactgtagtccacttttaaggaagaagctttatctacttaattttggaagagtaaaaaccatggcactgtccaaatgataaattgtattttttatatttcattaagctccatgtaatcctagatatggctcatatgctgctagcttactttcttctcatattttgtgcatgaattcatttgtattagaatgccactgaaactgattactgtattaatttttcctcctttttggaatattatatgatgttatgcttaaaatagctaagaactattcacatatgcaaaaataattgtgccattcattagttaaaaagtctataaaacgtatcttcgcaaaatatttacaggtattttcctgattgtagctgattgatttttatcagttacttttgggataaaaattgttacccttcctggattaattaaattgaataaattctaatggaaaagtttagcctatatccttagaccttgcattttccactgagagagattatgcaaaagagcattataagtgtactaaaatttgacatttaaaagaatttgttatggcccattatttcctctaacaatgaaaacatgaaggcaccagacgggaataaatcaataagcatgcttttgatacagcagccatgtttttggttcattcagctctgctgttaatgcactggggaaaaaaaaacagtatcattttgagtgatttataaaaatgtttttctgattatatcatttcattgtttatagcttttaacaactccaacatactgattctggtgttttgaaacataaatacaccttgccatctgatgtattctctttattctgctatttggcatctctgaataaatacgttattactttcaggtgggaaaggtggaaaaaagaagaaaaataaaaactcttctaaaccacagaaaaacaatggatccacttgggccaatgtccctctacctccccccccagtccagccccttcctggcacggagctggaacactatgcagtggaacaacaagaaaatgggtaaagatattttatatactagcaaaatggccagggctctcctctcctctctgttgttcatttttgccatcatcttatgttctctcactgtttcctttgccccccaccaccatgttcattgcatttccccctctttcattgtttgcactgtctatatatttttagctgataaatacaaaacagcacatattgaggactgagaatccttggccttcaagtgccttagattgtctgcaatcatgataatgcagcctccatttataatattgcttgttagtttgaaagcaagtacccacagctctgtgaactaaagagccactcctgagaagggctgaaaagggaattaaaataaccttcttcatcatcccttgcagttctctaatgacttgatgtctggccatagcagggcgccactgtagagcaccatcacaatgggataattgtagggacctggccagtgggtagaactttaatcatcagctctgatgggaatttaggggccagaacaataatagagccaatgcatactctgtaatgaaacctttttaagatacaaaattttcttcgagggtctttaaatgggaccagtttccttattctttcccaaatgtctcacaagagttagttttcctctgttactttaagctttaattgattttaaatacaaagacactgatattttttatcctctaattccaagaaaaacaaaaattggtcaaaaaatcatactgtttccttttctagtttaataattctgaatgctttgtcttccttataattcccaggtcactatttattttgactgggcctttatgtaagctaaaaatacagaaaaaaagcagtttttcttttcacaggattttttttcacttagaaatagttagatattaaaataaatctatttatttctataatggttgtttatttattatcttggcttaaaaaatcacatatacatgtttataaatttcttcttcatcctcttttctttgtacataactcctgtctttgaagtcttcagattaatttttctaactagaattttctatgtcataacattggcttcctttaatgatatcatttgcctttttttataaaataaaatatatatacatatatgctctatatatgcattatatatgtatacacacatacgcgaatattttttgtctatgtcttcctttccctccaaaagccttcatttgtctctctgagactgtagcacttattatatatgcatatattgttattttacttcttttaagttcacatttgaaatgggaaactaaaagtatatcctgtgtcctccttctctaacataaaaaataaaattctgtatatgatcttaatttatattaatgttataaatgtgtcagtgtcacataaatcatgagcaaagaaaaaccaaagatgtgtattccacaagagattaatacagagcttagaaacctgcattttaaaagctatagtcagagactacagacatggggacttgtaaaacaggaagagaaagtagtgctgttaaagctttatatgcataaagtcttgaactcatatcacatgaaaactgtggataatttggagggttttttttcccattgagtctactaaaatatacatagactatgataattcctgtaaccccctgcaataaaaccaattaaatcaaaatcaatgctaaacttctcactttattttattatcttgcagtagaattgaaaatattcatgaaatagtagatggtgcaaatttttattatttaacacaaattattttcagtataattaagatataaaacacaaaattgtttctacatatttggaaactttatatatacatatatatatatatatatatttatatgtatgtatgtagtttgagttaccttcaagtttttgtttgtcttaaatacctagtatttgctaaaaaaagaagttatcattcttactaaaaatagtggttagatcttagccagtcagtaatattgacaacaaaattcaatttccttatttttttgagctcagtttttaaaaggctaacacttgaaaattattattttaattatttgtaataaaaacatatttaaagttaatataaaaacaaataaaaattaatagattgggcatgattttgtccattttttgatattctttatacttttatattttctaatcggtaaaccatatgatactgaaaaagaaagattattgaacacagtagagtattctactattcataatattaagtaagtcaaaaaagaaatcttcagaattgatcttctagaaaatttttctataatttagaaccttcataattcaggtttaagcttttcttggcatacaaaatataaaaacttcagatacttttttgctctccatacttattagagaccagacactaacattatcctgttcctgacacacacacatgcacacacacaaacacacacaattttgtatgataagccctagctgagcaatgtggaagaactaataatctccccacagaaaggggcaatcatatataccagggaagccaggggaaagcttgtagaagttaagttttgaggtgaatctagaatcatttactcacaaataatagaaaaacatttggtggctgttggatgccaggcactgagccaaaaataaggacaaagatagcaagaaaacgtctctgtccaaaagtggtctagcattagaatagattgttagtcaacaactataacaaaattttactattgttgtgattttctgtgcaaatggagacaaatttccctggccaaagaccaaaaaaaaaaaaaaaaaaaaaaaaaagaaaataaatataatacaatgaaagacgagaaaacaggaaatagcagatagtcccattagtcttcctttggaaaccccaccctcttttctttaaggttatctgccttaactaaactgttgttttggttattcctaaagcttgctcctctattgtagtactcctcatattgcacttaactgcttgtctgtgccctttatcaatttgtacctgatgtatgaggcttgttgagtttgaaaactgcatagggtggctgggcgcggtggctcacacctgtaatctcagcactttgggaggccaaggtgggcggatcacgaggtcaagagatcgagaccatcctggctaacacggtgaaaccccgtctctactaaaaatacaaaaaattagctgggcgaggtggcggccgcctgtagtcccagctacttgggaggctgaggcaggagaatggcgtgaacctgggaggcggaattcgcagtgagccgagattgggccactgcactccagcctgggcgacagagcgagactctgtctcaaaaaaaaaaaaaagaaaactgcatagggtaggagataatctaagaagacgttttgaagccaattgtgaagccttgtatgtcatattggagttctgatgtttgagtacagatgatggattggaggatgtgaggctgaggcaggtagataaagcatggaatattgcagcagaatggctagcagaatggctaatatcatgtaaatgataagggaataaaacaaagcaaggtcaatgggttggaggaaaggtaagtatttaggagatatacccagctaatggtaatcatcaccctgaaaatattgtctctagttttttgttacaatatttagtattatttctaaaagcttagctatcatcagttttcattctaagcctttccccacaatatcaaaataaatatcaaaatcaaataaaaagtatcagaatatcaaaagttatcaaacaattgcccaaagaagaaaagtatttgttaattcaggaatataacaatgatggcaatgttttctcctatcattattcttctctcagcttgacaaaaatatgtcaaaatgtattaatccctagctataaatacagtgcattttattatactcatatgattccaggaagaattctatggtaattaaattgaaaagtggggcttttctttgctactgcagttagagattggcaagcttctgccagtgttgaactttattgtatttttattagtaatttggtatttgtatctggcctttacaagttaattcacatgaaacattgatttgttgtcatctttatcattagttgccaggcaagacagataatatgatgcctcatagttcactgacaataagtcaaagaacaaaaccttctccaggaaaggttgaccaaaagatctttggtttggcattagcagcattttcacagtctttttcaatgttactacaagaaaaagttgaaattctgtcactcaaataagatgtatatctgtaaaatgtgaaggaaactataaaaacagggctacacttcataaaatttgtagagtcatctgttactttctcatccttcttcggtaactgcatgaaacctaagtatttgttgcttgcaatggattaagacgtgaacaccatagagataacagaccattcttctccttcatatgatatacaccatgccccaactttccttcatttattcttccaggttcttctagtcttttcttttatctcattttccatttttcctcttttggtacatggtaggtagatggatctgtggacatttttcagtttcgctatcccaaaggggtaaagaatttgctccttcttgttctaaattatcttcacacacacacacaaaatgacacagaaaaattggtgataactggctaggcgcggtagctcactcttgtaatcccagcacgttgggaggccaagatgggcagatcacgaggttaggagatcgtgaccatcctggctaacatggtgaaaccccgtctctactaaaaatgcaaaaaattagctgggcatggtgatgggtgcctgtagtcccagctaccagctactcgggaggctgaggcaggagaatggcgtgaacttgggaggtggagcttgcagtgagccgagatcgcgccactgcactccagcctgggtgacagagcgagactccgtctcaaaaaaaaagaaaaaaaatagaaaaattggtgataacattaattctagttaatgggaatagctaatgaaatatgttttagttaattaatgcattaagcaatgtatttgactaatgccaaatacaatatttatatggttaggctctccttggcctgacattatttgattaataaaaatgaattgagtacaccaaattataacttttcttatgttttcttagcacatgatgcatataacacatatttcttctaatatattctctatgaattttttttttttttaaatttcatgtgtatatccccattagattttcaaaagtaaggatatcttactacctatggagtttcagaaaaatcttaggaaataacagactatttccatttgaaaaattgaatatgtgaacattttcgttcttttttccaaggtatgatatccttggcaacgaacgagtgtaagtaaggaaagtccacccattactttttggcagaaaaaaggactcttttgtagtaagagttacaaagtaaatttaattatatctagttatgaagcagaacagcacatttcatattgaaaatagatagttctcttttgattagcctcctcttacgtatttctgtttaacttaataatgtggcttaagtcagataaataaattaggaaaaaagaacaaagcattctaattagtggaatgatatgtgtgttttcaaatcaaatcaatacatacgcgtatgacttactctttttaaggtgttatattagatgtaacaaaacaagaacagttcaatgtcataactataatgcacttgaggaaaaggtattataaacatgtgaaaagttaaatactaaaataaattagtcaagagttacagaaaccagcactggaaatgacataagactgcatataatcaattttcaaagaaatgtacatcaaggaaaccttcatacaagatatgggatttagcctgcatcttgatggatttataagattaagataggtaaaactggaggagtacagcttattggaaataagttggttcttataaataaatgcaccaggatgggaagaaagtacaaagaaagatgaaaacaaattaatttatttgagcaggagattcttgttgtaaaaactgtctgaaaaggtagattgcggcttagacatattcaatggatggaataaagagaagtaaatcttcttattcagaccattctgatattttcatagatgaatttgtaagtggtgggcaggattggttagaggatgcgaaaaactgaaagcagaaaatcccaccaggacagtgagttacaatattttaaagcaataggatcttttttccacatgaaatttaattgtgatctccaacatataaaacagataaaaatggcatcaattttttagagcaatatgttctttaaattcagattagcactcattatatagtcaattaaatgggaatacagtttaaatgatggtattttctagtataaaaattgctatttgtaacacactagtgtgtgtctgttgtttataatgtctaatattatagtagatatttaggaggaaatattcctatcaaaccatacagggcttctgaaacagggtcttgcaactcacttaggtagcctcagcaagagaataaaatggccatggaaatgaaaataaaggagttacaattataactaactttgaaggaagaatctttggaattcgggaaaaagcatttaggggtctaaggaaattgaacatccaaagatgatattattcccccaaaaaaccaaccaaccaaccaaccaaccaaccaaccaaacaaacaaacaaacaaaaaccctttctgtaactatctctcacccacaggaaaatttcaaactccttgtaggggctgataaggccttcagtgaccagcctatccctaactctcttgcctcttccgtggccaattttcttctttctttgccagctcttggcatttagggaagtatttgaactcttcaaattcctttctcttcctccgggcttccacacgtgttgtttaaaatgttccttttactggtggtcaacatagccctgcccaactccaaaactagtttagacctcctgctttctacttttatggcatcttgcatcactgattatttgtttaatatcagctttccccactgaattgtatgctctgtgaaatagattcaggaccctgacacataactgtccaaaaaaataaattaagagtttttttttaaataaagtttatttttacatctgttttaggcttacagcaaaattgagcagaaggtacagatttatcccagcccccacatattgatagcctccccaactatcaaggttctccaccagagtggtacatttgttacaattgatgcgcctacactgacacatcatcatcacctagagtccatagtttacattagggttctctctgtgttgcacagtctatggatttggacaaatgtaatacatgtatccaccattattttataatacagagtggtttcactgtcctaaaattcctctgtgctctgcctgtccatggtttcctctcatctagcctctggaaactactcatctttttcctgtctccgtagcgttgacttttccagggtgtcaagtagttggaatcttattgtgtgtaccttttttagacctttcacttggtgatatgcgttcaagtttctgccatgtctttttatggcttgacagctcatttctttttagcaacgaataatattccattgcatggatgtaatgcagtttatttatccatctacctactgggagacatgttggttgcttccaaattttggcaagtatgaataacaccaataaaaatatacacgttcaagttttatgataaattcagcttttaaacaaaataaatggaaaggcattcaagtgaaaatattcaagaatcatccggacatttataagttactctttgtaagagagatcaagactagagatgtacatttctgatatttactcatatcacagtttccctaatgaatatctcccatgtaccagaaactgtatgaggtgcaagaagtagataagaatgacagctttcttgaatttaagaatctcacaaaatagtgggagaaaagaaacacagaaacaaataatctcaatataatatgaggagtaccacaatataagtattatggaattgcaattaattccatttggagtggggaagagaagacttcacaaaactgatgacgtttgaagtgactggttgaaggaagagtaggcagttacaagcaagtgatttgagaacagtcataaacagatgcagactttagagaaaaatatagtatatggatgttgaggaaatagtgcgagattaagctggaaagatgagtttatcagactaggatgggttttttagacctagctaatgagttggaaaggtttttttttaatactagttataatcactgaataattttaggcttaagcgtgatgtgaatgaagattttagagatataattctgttgcacgtgtttaacaaagggtggaagagaagatgatgataccggaagagtaggaaagctaatgagcttgtttacagcaggaaagtgatgtgtgattgtgggagtgggggtgaagtttggagaaagattcactaggtatttaagaggctgaatgtataagaccactatatccaataatattatttatcttttccttgtctgtgtttaaaaggatgttataatccatttgatttatgaaagtattcagactacagagaattgaaataaaaaagctattgattttgtctcatggttaaaactttttggattaattttctatattcacagaccacagtccctaaaaaaatatggttttaaaataattgtcatattttatactcaaaattttttaaaaggatagatctcgtgttaaagttttttactacaataaaagtattatttttattttatagggcaaggttttgaactcctgttttgtgatttgcatttggatgacaagataaagaggacattagtttctactgagaaaattaagagaatcaaagagatactgaatgcatttatatgatagtcttaatgacatatggaatgaaaggttgtcagatatctagaacaagaacaagtaaaattctccaatacttcttagataatcaatcagcgatattggcatgtaatggtgcacaagtatgaacaggagaaggaagcagttaaatctacaagcactaaattcattaattgtctttaattagcaatttggtttttccacatgagtaagtttgttgggaagttattgcctcttgtaactgtggggtaacaattagctaaaaaggtcttttaagaataaattgagatattgagataacagatgtaattacaattagaaattaagataacagccaggtgatttactgtggtgacaccaacagcttcaggaagaaataaaccgagagaacatttcagataccatgtggttgctacttattgccagtataattgtgtgcatgtatgtgtatatgtatttgtgtcaatgtgcatatttttctcatttaatttcagctatgacagtgatagctggtgcccaccattgccagtacaaacttacttacaccaaggtctggaagatgaactggaagaagatgatgatagggtcccaacacctcctgttcgaggcgtggcttcttctcctgctatctcctttggacagcagtccactgcaactcttactccatccccacgggaagagatgcaacccatgctgcaggctcacctggatgagttgacaagagcctatcagtttgatatagcaaaacaaacatggtaaatatcttcattaagtcaagagacccatgctttcaacacatggaaatttttttcagaataaattcacaagagattctgatagaactacacagctagggttaaaagtgattttgtatgactccttaatcatttagataaatgtatccactgagaaatgttaaataatttggccaaaactagaactagaactagaactagaactggaactggagctgtaactgtaactgtaactagaactagaactaaaactagaactagagcaagaattcaaatctgctgtatttcaggctaaagtgctcttggctacaccagaatcttttctaatttatggtttatcttcaattagcttatcattgaactcacatcccatgatgtaataaaagactccttttagattcctcaaagtgcctgtgattaattctgtatgtggttgtcaatatgtaaatgtgagcttctgcaaatcacatatggtcagtattagttattaaaagactctctttacctgagttaagtgcaacagaaaaaaaaagacaatactagtatcagtaagtgcataaaaagcaggagtaaatcaaaaatttcacatttctttttctaatctataaacttttgtaaactacaggtgtcagtttacctaggtatcctgtggaattaacacagatatataaatgggactaacgctaacagttttatacaggatttttgttattcaatctttctattttaattttcaaaagcccaggcttttatatcactattttaaagctccatgtcatactccaattttcttctgttgatttaccctttgtgcttgaagtctgagtaaattttttaaatagtatttgttttgttttttaaattgttctagtcatggggataaataattcttattctcattattaatgaagtatgtattattaaaatacagctaactatacatagaaagagataccaaaaggaagagtattacttaaagattattacaaacagcctcttttcttaagatattcttgaacattttccaacagtcatcagatgctttctcaaaggtcaaagacaacttaccgttaaacgctgttatttttcatcaatctgcttttaataaaacatcactatgtaagttgaagccagctgcttcaagagccacagggcttccttcacgttaactaatgaagcaatgcagtttggtcatctaaagcacagactcaagctgaagggttctcaaatttgccacattttagaaccatttggataaccttaaaatatattggtacctgggctccactcccagagaaagattctgactgccatgatctggaatttgatccagatcatgggacagccaaggttgggaccactgccgtggagatgaacctgtcttactagctgcatgactttgggcaacttgctcaacatttatatgctatagtttccccatgtgtaaaatgatggtgatgataatagtaattagctcatataggaaattagagggcagtccccaagacaacctatatttctgataccaagtacaagtttcaagggtccccaagaccaccctgaagtttcagaattctctatagtaagtcatagaactcaccaaaagattttacactcaaagctacagtctattacagtgaaaagatacgcattaaaatcagccaaaagaagaaatgcatgggacaaggtccaggaaaattccaaaagtagagcttccagttgtcctctcagtggaatcatagcgttactttcccaacaaagggtgtgacattacacaccatggagaattgccagccagggatgggcacaccttccttgaggtcctgcgacttcattttggctctgtcacacagacattgttgactacccatatggctgacctcaatttccagcccctccagaggctgaggtgacaccatgcaactccaagcccccccataatcatattgcgatgctttttggagtagcctaaggcctctaggtaagcagagagacttttatccacaggacattctaagggcttacagattacctcccaggagtagagggcaaaggcctaacctctcttgggtcgaggttcaattctttgttacatatcctagtttttgtgagaatgaaatgagtatgaacttatatactactgtccctggctgtatattagctgttattagttagaaaggcctaggttttcacccctgagttgttcacttctgtcttcccacacttagaagagtgtcccacttagtaaatgcttgatagatatttggtaaaagaatgaacaaattagttcatctccacctgctgcaaatacccatagaggacaccctgtttcttcttctgagtgtgttcctactcaaccagcaatctttcagaatgccttggctgactccacatctgggagttatgagcttgcatgtgcttctggtttggaagtgactcaccatctgggtagcacatcaacatcataggactgtttaacaaataataattcccaggctccacctcccaggatctgtttctattgattcgtgaagtaaacagcacagtgcctgtcactagaagatatttataaatgttatgtgtcctcttcctgtatttcaatttacctcttaattttgcttaaataggagtacattttttattccatcaaggtatatttgttttatcaagaggtatcaattcataagcatattgatggcaacatttatagcaagatgtgctcatctatcctcaagcttttctgtactaatacttaggaaacttgctatttcttcctatttttcaactagcaggctgtgaggaatgctgaatactaacttggggcctgaactttctaatctgttaaagattgaagattgggatctgatgatattgaggtagcttccagaattagaaatttttttaacattgaaacatctagaatcctgttaacattgaggttggttacaagttcaagaagccagttgggagaggaatattaaacaaattcgggaagattaaaatattttccccaaatcatgcaaatgacaaagaaaagtaatctaatgtctttcattcaccagccaacaataaaaatgcatagtactttttaagatctcacctaaatagcacagccttttaaataccttttatatgaaggcaaagaaaatacttactatgttaaaacatgtagtacactcactttttaatgctggtaacaaataacaataaattcatttcatttagcattttatggtttagaagaaaatctgagtagactcaaagcaaatcaactggaccctactgcccagcttcacactttgttagctacctgatttgaaacaagtcacttaaatttgaccttcactttaataaattctaaagaaggttgggccaagcatgatagctcatgcctgtaatcccagcactttgggttgctgaggcaggacgcttgcttaagcccaggagtttcagaccaacctagacaacatagtgagaatcccactctacaaaacatttaaaaactaattgggcatggtgaagcacacctgtaatgccagctacttgggagaccaaggcaggaggatcgcttacgcctgggaagtcagggctgtagtgagccatgatcgcatcactgcactccatcctgggtggcagaacaagaccccttctctccaaaaaattaaataaataaataaataaataaatgagggttgataatgcatgatctatttatttcataaggttgagattagaattatttattcattgcaaaaggtttatttaacacactagtgttccaaacacagagaatccttagatgaattgtttatgcctttgaggagtttaagactttgttgggtgagacagatacataaatagctactagagcacaaattagttgtgcctaccctaaactgggttatagtgaaagtggaaatagccttccagccttgatgtgagagagatcgtgtggggaggaagccttctagggtgggaaatgtgttcagggttgggaggtaggggatattaggtcctcatgtgacatcttttcttcataagggccagcaggcagcatgggttacacagactgagtagaattttgacactaaactgagaacaaaagtataatatttttggagaaaaatattcactttaaatagttactcgtggcgaatattcctagtcccctctagataacttcttttcacaaaaatactgggcccgtatttttttttctccgtgtgttatcctataaataccaagtgaagagtttaatggtttatgttttccttgtttggtgaggctcgtattcgtagccattgtttctgctgaaagcattatgaactcctaaattagttaatggaaaggaagaagacagtatgagttactatagcatgcatttaattaaaattatgattttgttgcatgttaataagttgcttttcttttttaaatttcatttgaattctaggcacattcaaagcaataatcaacctccacagcctccagttccaccgttaggttatgtgtctggagccttgatttctgatttggaaacggatgttgcagatgatgatgccgacgacgaagaggaagctttagaaatccccaggcccctgagagcactggaccagactcctggatccagcatggacaatctagacagctctgtgacaggtaacggaaccaatttaataggaaaaactgacctattggtaacattaaaatgcatcaaaagtcaactacttccttattgtaagatttattccactccatctatttctgtaacattttaaatgtgttaatattaaatacaaaattcaaaaaggatttggaaatacttttgctttgctgcaaaaatgataagaaaattcatgaattttaaaaagctttaaagacatgaaagaaaactcaattatatctagggctttcatgagaagttcactctactaggaaaccaagtctattacattaaaaaccttgacttttagaaatgatcttttttatatatatcaggaataacatatgaagtgaatgcaatcttaaaatgcttcttgatatttcactctgtaaaatcattcactgatggaaagtaagcacgtctcctgaataagccactttaaggttgcacaaggtattatttttagaatgaagaaaatgtgtagtgagataaaccatatgtttatgcatttcacattgctgcatctagtaaatgcttctcttccaagaaatgcagttattttttctgtttatttctttggcttcctcttgccttgttcatcaaacgaaagagttgcattggtactcttctatgatgatcccaggactaaggtataacctattttcagggatttaaatgtaccaatttttttaaagaaaactttaaatcctaaaatggacacaatgaatttggagaaaactaaaaattcagtctttctattcaaatagatatacactgttggacacacaagaaaatgcctcttacatgactgtgtagaccgagctactacaaactgaagtctggtctctgcatttcactgggtcttctcagaagaccactcatatctgtatttaccgtgatgacatctttcatcctaggagatattttaccacaatcccgcttaattcatttttatgccaacagcttccaaactttcacagattttacacaatgtgttagagttctacaaacactgatgggaactggtttatgacaggataaagcagcatcagcgcctatgattttcctctgtattcctccctgaattactcaatgtgtgatgcatgagcccatttttcagtttttcttcttatccaggggctggtctgcttgccagcctaattaagatttaagagctgcagatacaccgctgtgatttgaaatccagatccaaccgaaggtgacagagcacaagttaaaatcttcaaatgcagagagctgacttattagtgcactattatgttaagcccctttgcctgaatttccagcataatctccttcagggtaaaattctgcatatttttgcatatttcactaatgatactgaactcttttccattaggaatgcagtaacaaattgcaataatgatgaaaaacagtcagctatagtctgtgtagttcttttattaaatattataatgtcaaagatgataaatacgtctataaatcaagagaatgccattttgcacttttacatgctcacctgtgacatgttaggctgcctgatgtgactgcagctcaagcagtctgtatttctcctgtagctagtgtaatgttcattccaaatgaagcttttattgctgagaaaaaaagtctggttttctccttgaattcactgcttaattactgccatatataaaaacctcagggtgtttaagtttgtattccatgatgagtttatcctatgaataatacatctctttagtaaaagaagttgtgttctacacaaaagtagccaaatacaaactcactttttttttcctttctcttccacaataactttgtggagaaggtgtgatcaaagatttaatttgctttctatggtatgtgagtaagtgcttataagtgtgtgtgtgagagagtatgtgttagatgtgtgagtgtattagaacgtgggtgtgggtgcttgtgtagggagtgagtacgtgtataaatgtgtgagagtgtagataaggttgtaagtgtgatatagtgtgtgtgcatgcatgcatgcagacatgtatgagaatagccctgaggtagatgtatatagagactgaatattagagaaatcagcatgccaatgaatgttgttctaacatgcttatgttttcctcagacacttaatgctagtttaatggcgctgaatgaggtggacaataaaacaggcattatttctatgagctttttatgtttttaacatggtaagtgcccatacagtggatgcggatcataccaccagttactttgggttctaaatatatttgtggtgtgaataaattagtcattacctccccctgaaatgctgttagttattttcactttcatgaaactaatgaccattttattaaagagatctaacagttacaggaggcagcatgggttacacagtccctgaaaccctgaaaccaatcagaatattgggttccagtccctgcaactctgaagccaatcagaatattagttcaataacaacactgggatgggctggtaagcctgtatgtaaaattatgcaggattttacttggatatattgcacttcacagctgccacattagggaatatatcagcagttatccagggacagagcccatttttttgtaaagaaataagcatgttaactacaattagttgtttttataacaactaatttgtgagggatctcttaaattttgaaatgatgttctatgagtggaaaaggctaaaaaaaagaagaaaatatcagcagttccatatcccataatctcagtactggataatatgtatatttgcaggtctgctgttaatatttctttcttcctacaacaaacacctatcgaatgcctattacttctaatcacttggctaaaaatttagattcagtaataataataataataggtaacacatatacaacctttacgaagtgcaagccatctttctttctttcttcttttttttttttgtcggagtctcactctatcgccaggctggagtgcagtggcacgatctcggctcactgcaacctatccctctcgggttcaagcgattctcgtgcctcagcctcctgagtaactgggactacagacgcccaccaccatgcccagctgatttttgtatttttagtagagacggggtttcaccatgttgaccaagagggtcttgatctcttgacctcgtgatccatctgcctcggcctcccaaagtgctgggattacaggcgtgagccactgcggccggcccatgcaaggcatctttctaagcagtagcctgtattttgtgtggtctcattagctaagaatggtttttcacatttttgaaagggttgtaggaaaacaagaaactaactaacaaacaaaaactaagaagaatgtatgacagagacagcaaagcctaaaatatttactatctgtcattttacagaaaaaagtttgctgatccctattataaagttttaatgtatattaattcatttgatcctcacaaccctattaatagtattattttcatttaatagattaaaaacagagggttttaaagcctttgtccaggttacccacctgataaatggaagaagaatgttcaaaatcaatcagtcttactctaaagacaaattatcatgatccctgctctggaaacacacaactttcttctaatctgaggaataggtatatttaagaggaaaataatatgctggtttgttgcttcatatgtggaactgagtgtgtgtgtatataaacacacatgaataaatatgtatacaagcacaacatataattttctctctcgaaacattagtcctttttccttatgcatttaatcaagatcaagatattaattttagatgtgacttttgtgattcatttttttcacattcagttctatgtttatttaaagtgacccatgctaacaaaattcaactgtatcagcactttttgcaatgaacctcattttaataattttcattgtaatctatgctcataatgcacacctatttgattgtaataaaatacaacatatttatttattgcagctcattgcactctgtttgggctagaaagtaaacataaaggcttgtttctgtcttcaggaataagcctgtaatttcttcctaaatgccaaaccgttgggtaacggggagggagagggctacaatacttctttctgtaatttccatggcaggagtcaatggtaattgtttcccaaatttcatgacaccaccaggaaaaaagaaacagaaggcagtaggagagagtgcagggggaaaatgccctcaacgtgtagcaaagattctaactgcctcagtgatcacaaaaaggaagactgagattgtgtgctgttcagtgaaacaagtaaaaagtttccttgactgctggaccccacatgaatatcacagctgaaaggaaatcatggctctatattttgtgttacgtttttggaggtttgttgtggaactcccacaacagatcagtatggaaacaatgaaacctggtggcctcaccatctgactcgaccacacagcttttagagcctcggccactaaaatatttgacctgaaactttgcttttctacaaaacttaaaggaaaataagtttagtattagggaaaagttcagggataatgctacagtaatcaaattaatttcttagactacttttacaggtttgatgcctttaaagaacaattaaatgtgtatttcaaaattgaacagataaaaaggggaagtgggatattacacgtgtaatttttatctgagtgaaacaaggtatcaagcatcgtatgtcctaatgaagatatttttaattgcttattttgctttccatatatattacacattccttttctttctttctttttttttctgagatgttgtctcgctctgtcacccaggttggtgtgcagtggcactatctctgttcactgcaacctccgcctcccagattcaagagattctcctgcctcagcctcctgagtagctgggattgcaggctcgggccaccacgctaagctatttttttttttgtatttttagtagatacggggtttcaccatgttggccaagctgttctcaaactcgtgacctcaggtgatctgcccattttagcctcccagagtgctgggattacagatgattacacatccctttctctctgaggcacgcaggtggaattgttgcacattcaatatgtttgagtgaaagaagaagttctgtagatttgacatgtttttctacgtgtaggcaaaggtcaatatttggattaatttgtctaaagacatttgtagctgcagcttttacttaataggtagacaaataacatttaataggaaaagttcatagattaaatattggttgaaaaaatggagaatggctagtttttgtatctcataaaaatggtaatgcaacaattagcagggtcatcttataaagcacagactttagcttaatggatctaaggataagcatttatcagcaaggaaagatttagcataaaatgacatgtaaatgaattgatgactgatcataaattaattttagtgctgaagatgtaatagagacacagcaagatgccactttatcatgatattttactgctcagtaacatctgagcaacaacttaatgtcctatgtgcagtactactttaacagcttgaatacatttgagatttttttttgccttttctgcaatttaaatcagggaaatttggaaagattgaaaatgtaaacacaaataaatttggctatctaacataaattcattgttcattaaatgtttaaatatgtattgattatgtttggggctgaaacatgtcaaattggtatggagtgcttattaatttgtaagaagcctctagccgaattggttttacctggtgttcattttaattttcgtgtttatacttatgtttgtgaaagaaaatcagttatcacaaaagtgacttacttttaaatttgtagattaatgtttttattttcattcattcattatcttttcttctctctctctctttttgtggggggggggtaattgtttacctaaatcttcagctcattgctcttgtttaaatctcaacatttttccttttttcagaaaggccactagacgtaaaatcagtagatgttcaatacattttagccattttacagaaggaattctaacatcttatatactatttgattcatggaatgtggccaaatgtcttttaaaaatatttaccataaatatgcccattccatacatcttaaccaaactgtagaggaagggatgtcgaaaatcccagacagagaggcagagagacaaagagaaggagagagaaaatttctttctatgttccttgccctccgttttgaaggcaaacacaactacactaacgtgagacacttccctctcttcagattgggtcatgagatttcctgttgcccaatatggccaagtatctgtggtcacatatctttaattctgaagtcatctatctagtctctttgctcttacaagaagtacaaaagaaagaatagctgacgttctttctgtatttaccaatactcacttgaagccctggcttccatgtgactctctcttcccagagggagacaaaaagcagcagggaaaacttcatgaataattgggagttttaaggacatacaaggagcattaaaggctgggagaaaggcagagcaaagacacaaaggctggaagtagtccatttgtttagagtatcacaagtgtgtgtgtggaaatgctcggatgaagaactgtcaagttaccacagggagataaacagggttatctgaggcggaaagttaggctgattctctgctaggaggtctcacaggatatcatttctttagtgatgctaccgtggtgtaggatttactggtttcacctgtcaatagctacaccacagtcagttttataggttcagagactaaatgtgtcactatgctagatcctcaggctggaattacacagcaagcagacatagacaggaaacgaaagaaactcaactatttttaggctggttatagtggaaaaagaaaaattttagaaaacaaatcactgggccaagtgcattaagatggataaatgaggatggaaaagttacactccaaagaaacttagctgccacttaatgtaaattttttatcttaatttgaataagatattgctaaatatcaatattcaagtatatcaaagcataaccaatacacatgcatatatatcacatatatgtatactatttatatagtgtcatcatattccttatttaataaactttctaagagttcttataagaaaattctttctatagttaaaataaggacattgctaagaaattacacatcaaataatgtcatacacagaattatagaataatgaaaacgttgaatgcatttaattccatatgcctactgtttattgaatttctaatgtacaatgtcactggacaataaatatgaaaataaacatgaaatagttcctaatctccagaattccattgtctaggagaggaaacacatgtgcagtagaccataatatatagagagaactgatatgcgagtttatgtgtagtgtttggaaaccaaaggaggtagagagattgattctcgctgtaataggacagaatcatggtgataacagaaatggcatttaatttagactttaaagtttgtcagtggttaatagtgttagtggcaatatctctgtctaaagaatgaaggatgatgttacataaatgagcaaggagacacacaggctgtaagagtgaatgaggactaatacacagcaggtatattagtctgttttcacactactgtaaagatattaccggagactgggtaatctacaaacaaaagaggtttaactgactcacagttccacacggctggagaggcctcaggaaacttacaatcatggcagaagacaaaggggcatgtcttacaaggtagcaggagagagagagcaggggaaatgccagagatttatcgaacaaccagttctcatgagaactccctcactatcatgagaacagcatgagggaaaccgcccccatgatccaatcaccccccacaaagtcccccccttgacacatggggattacaattcgagatgaaatttgggtggggatgcagagccaaatcatatcagtaggctagcctagatatggaagggttgcaaatatttaattagaagtttagatatggcattggctagctgggtaaggctttaaacagaggaacacatgtatgtaagtgcttcacaaaaataatgtagaaagcaatgaggaagatagaagagactagagggaaatcaggtaggaggggtttaggagtaaaacaagatgaagattaaagagatgcttatttggaaagtaagagcaggtatttagaaatacaagagcaggcatttagaaatacagaaaacagcacagggaagggactgggagtgaactttcaaatgtttttaaactatcctccgttccagagtttcatattcttttgtgaccccctcactgaatttctttgatttttttcttatctagtatagcattatattgcaaagcctactgcattatttcttctttcattttggatcgttggtccttgacttgtggttattaacccagaaatgattctctcagaagaggctcagtttctggtgttatctcggcttccttgcagtggcctgtgtcaagggaatttgtttgaaaagtaaaaagtgtatctctgtgcttttggcaaccagaatcaaaactctatctttctttgctacacttaacacccttttaacttctccgatcattctaaccagttcagcttctgttttctctgtattgaaagtgcatgaatccgtgtcattgtatcctggcctcttgactaaaattacaaatacagcatcaaggcaacactcctaactattctgttgttgcttaaatattacagaaaaaaattaaatggtctatagcatttgactttcatctcttttatgtaaatatgtatttggtttatttagaaatcttaaattagtttcttacaaatattttttgcccctcttctaacaaatttaggataagcaatacttggtagttttttgtgtcatgaattaatggtataccaacataaatcttgtaatattaattttattaagtaggaggttatgttctcagtctgtttttgtctaagaaaacatataaaattgtaaatgacttgctagaaaattaagaaaaaatgtttctgagtatcctcacaacttacagctctttaaacgtaaaattaaaattattttcctctattctcatgttgcattttgcagaaaaaattcatattaatgctgatgatagtccttataagtgttactttttaatataaatatcagtattaaagagaaaactggagttcttaaataacttaaaaggcaaagtaagcagaaagagcatttaaattaatagaacttctttaaaatacattttttcttatgttctaagttcatttgctttgatattgtttatacattttttgtttgtgaatttttgttgttatttgtaattaagtttaaattttaaaatcttgaaataatttttgcccttttatgatatacagtgtagtttctatgcagattatcattggagtctgcgttaaattcaaaatatattcacactatttcttcaactgagtctttgataagtttaagtacactaagtttgttttactaaaagtgttaatttctgaattatagtaacttaaaatacacatcgcagctctcttttggaaaacgattgtgtaataatttaaacaatgtaagagttgaacagtgcagcacatgctttgcttatgtgctgcaaacagatacaggtttcaaatgagcttcattcttctgcacaaaaaatgtttaaaatgtacatgatacttgcatttggctaaagaaatcatgatgaaacttcaaggaagaagcatggacaacttacttgctcattagtatagtgtgtacaagcagatgagattttcaatatatacaactcactagacaactacatttgtttttaggttcaatggtaaatggatggggctctgcatctgatgaggatcgtaacttttctagtcatagatctagtgtaggtagctcctcagatggctctatctttgccagcggcagttttgcacaagcactggtggcagcagcagataaagctggttttaggctggatggaaccagccttacaagaacaggttggtagactccaagtcaacactctttgcatgagagaatcttgtccttggacactgtcctcttttctcctgttctttctccttagtgagtctgactgtagggctttctttaatacgcatgaatacagtttggatgctccattacccaaactctcttctgatgctagttttgcagagccaagaatagactcctcctcaacactttctcttattttcctttctcttcacggctttactgattaattggaatatgcttcctttttatattacggcaaagcagcaactaagattgccattaaattttcaataacacattttgcaaaatcctcatacaattaataatgtacccagtgattaaaattactcagcttttatctccattactttcctttgcctcatctctttctgcaaatgcattttctgggaaggtttccttagcatggggtgaatgggtctaaggttgtcggtcttaccagttcaaatagcttatgatctttttaattgtttggctagtaagattttaatacaataatttattatttgtcttaaaggatgctaattaaagatacacccactgcatttgcaagttgaataaaataatgactacatgtgtatttctctttagaataatttaattttgatttctgagagtgataagtaatcatataaaagaacaattatataatttttcaagtgctgctcattccacaaaaaagaatgtgggattaataatagatcagtaatttgtaaacttttgcaacaaaataacttaggcatgatgcgtgcttttacatttgtatgtataattcttaactatacatataagaatattctaatatatgaattaaactgaattaccttgcaaagcaaactaataaaacattaagtacatttgcaaaatcttaactgtaatcaaatagtaaagaaaaaagatttttacccttcactaaactctcaggttataaaaatgagtcttggaagttttcttggaattataccatcaatatttcttttaagcatacattagctatctttaagtgaaataaaaaagatcttctaagcattgcagaggtttatttttcaaatagcatccaaactaaaatacgttgtaatagaactgttatttgaattgtcttgcattataaggcataagtctgaaactttatgttgcttgagtgctttttgcagcattagctgtaaacagagcagtgagaacgtgcaaggaaactaatacattagaaggcacaagtgcatttcctgcatgtatgctaatagctaacacagcattaagtaatatcatatcacgtcgtcgtaagaaaatgtaactacatataataatgttgtatgaaatgaaaacatacacaggagaataaatgcatgcacataaaccaggcctctgttactacaataaacatggtattgaaatcataagttgttgaaaatttattagctaaccttttcccagaataaatttccccgtatacctactctaaaccacaagaaaaggacacagcacatatcatttttcaatgagaatttggagcctgctcagatacaataatattaatcagaaaatacctattgcatgctggatatacaaggtgattttaacctgctatcctctacacagatgttgttgagtttctgccaaaagagatagaattcattgtgtatgtggataagtggtaaggtcaatttaatatatgtgtctgagcagacctttcatgtaaaatttcagatgtaattactatatgacatttttctgtgttcagagagattttgtaagtttccaaggatgaaattttattaaacaaatacaacagtatatacttcataaatagcttctttaattttaagaaataaaaactgcatgaatttgcatatatctttgacaatatcaataatattgtcaaggttaaataaaagtataatcatgcaatattgagttgtggattggtggatctgttttatgttcatttgtttgattttgagggggccagtgggggtgttgttagcttattaaaaattgaacaaaatatgtgcagctgagaatgtagaaaatacatttttctacagagatgcaccaatatttggtatcttcatatgttatctctaggtagatttacaggttagtcatagtgcagaaatataggacagaatcagtgtgctataatgtcattctctagaacccattccctttattttcattttaggaaaagcctttacctcctctcaaagacctcgacctaccagcccattttctactgacagtaacaccagtgcagccctgagtcaaagtcagaggcctcggcccactaaaaaacacaagggagggcggatggaccaacaaccagcattgcctcatcgaagggaaggaatgacagatggtaggtttcttccctttactcttgtttcctcgctgaagagacgtgctccatgcaatcatttacttagattaatgtagtcatggtagattagccattgcttcattacataacaagacaaaaacctggcaatatggccttgtttaaataaaacaccatttttaaaaacaatctagaattatttctatattattaagcctcaagaaatacattccatgcaattttttgaggttgatttttttttttttgccattctggcatatttcataaatgctttttagtgagcatttaagagtagggaagaacataagctgcatgtgcacttatatgatcagaacttttatcatattaaattacaatatcttagctgctatttcacttttggaaaaaaagacttttgaaatgatttagtaattttttagtcacaaatttcagagccaaaatcaggctacagtagttgaagagtgtcttagtctgtctgggctgctataaaaaaatagagtcatgcattgtatgacaatgtttcagtcaatgacagactgcatataagacagtggtgccataaggatgtcatactgtatttatgttgtaccttttttgtttaaatatgcaaatatttaccattgtgttataactgcctataacattcggtacagaaacacgctgcacagatttttaccccagatcaatggtatgtagtcagctataccatctatgttcgtgtaaatatactacgtgacacttgcataacaacgaaatcacctaacaccacatttctcagaacttatctccatcattaagtgacatgtgactgtaccataagctggtagattccaaacaacataaattttctccacaaatctggactctgcaaagtccaagatcaaggcattggcagatttggtgtctggtgaggacccactttctggttcatagagggtgccttttcattgtatgatcacatagcggaagggacaaggttctctctggggtgtgttttatagggtgctcatcccttcatgaggactccaccctcatcatcgaatcacctgccaaaggccccacctcccaatatcatcacattggggattaggattttaacgttgaattttgggggtacacaaacatccagactctagaaaagggtcagcaaacttcttctattaaagtctagatagtaaatatctttggcttttgggacatagggtctctgtcacaactactcaacactgccattgttgtatgactgcagctataagaaaagtagaataggccaagcacggtggctcaggcctgtaatcccagcactgtaggaggctgaggcgggcagatcacagggtcagaagatcaaaaccatcctggtcaacatggtgaaaccccctctctactaaaagtacaaaaattagctgggcgtggttgcacgtgcctgtaatcccagctactgaggaggctgaggcaggagaattgcttgaaccagggagtcagaggttgcggtgagctgagatcacaccactgcactccagcctgggcaacagagcaagactccttcttaaaaaaaaaaagaaaaggaagaaggaaaataaaagtagaatgatggaaatgattgacttccaataaaacatcattcacaaaatgggcagtggctggatttggcccatgggccatagtttgctgatctagctcaatatttttatttatatatagcatccaacatttgaatacttgcttaaacactgttagtttcaggaaacacaatattactggaagatatccatgttcgataatgagtatttcattagctttacagaatatagtctatttcccgtatttttaatttaattcttataacttttaaagaatgaattaaaatatgtatcctgaagttatattctaaggatatgtaacacatatttaaagtgtgtagtacaatgtcagattgaaaggtgaatttctttttccttttcagcactgtaccctataagcacacaaacattatcctaacatagttcaattaaacaccaaaaggataaacttttaaaaactgcacattagaaccatctggaaagctcttaaaatataccctagatattcagatttaattattctggggtgaaacccagttacaggtaattttaaagctccacaagtgaatctaaagtataactaccttagagaagctatgacttagtccttagcacacttacacttatcattataggacagaatgaagcttagttgaaaaagaagaaaagcattggttttttattagtttggggaagggagtatccaatcctgcagccctatttgtgctttcttttgtcatcttgcaaaggtaagaggacttaaaaagccaaatatattgttctacatactttccggtttacttatctttcctgcttcctttgttttcaatagaatatgaaggttaagggtagaattgagatttttgagtctctataaatgtgtatcctgtggtgagtaaaaatggtcaccactgcctttctgccttatatgttcagaagattagctgagcatttaaaactattcgtagtgttcatctaattcttcgtaaataaaaaaggactactttcactgaattgctaggtataaatctagtaattgataattttgtatattttttctgttgtgaatattgtggagagagaaaaatgtctaggtatagaattttctgtggtttttcagaaatgtttgaagataatattcagaatatgtggaagatataaaatataaatcaacaaaatacagatctctttttttctaagacacttttattgcaagcttttttagaatgtttccttaaagcaagctacctcctagtttaaagtatgatcaatatattgcttatctttctaaaaaataaatgtttctaaattttcaaaattgccagcatttcaaaaaggggttatggattatgtgttattagaaaatgatacattttagaagtagtgatatagcaaaggaaatttcagcccacatatcttcccaagtgcttaatccaaagccattttaattatgatacagtgcaaagacatttattttggatggtgctctacaggttatccttaagaacattgttattttgcagcaaatgcatatgccatagcatttatatggtatggatccatatgtcagaaataatttcataactttttatgtaaaaatcaagttgttctttttgggaaggctgatacttagcagcattgattgtacagacattttacaataaaccttttgcattatagattttacaacagtgtttgctgttttctaagcagtattgtaaagatgtaggcctttttagcactgggataccatcatttctggatcagacctttatggtttctgaggggaagacagaacatgagtggttgttgggaggttgtaatggcaagtggcacacatcacttctatttcattgaaaacaactctgccacgtggtgtcaaactaactactggggtgagaaagctgccttccctgtgtcccataagagagattatgaatggtgggaaatgtcagtctgtatcccaaagactgaaaaacccacacacatcttaaagagtgttcttctcccttttgtaaagtttctccaaagcaggcattgctgagtccaaatcttgtattccatttgtcttataaatcaaagaatacccttggaagccaatatattaaccaatgctaaaaaagatagatctgtctatccatcaacctgtttctcctagataatttatttccagcctattctccctttcacctagctttttttttttttttttttttttttgagagggagttttgttcctgtcacccaggctggagtgcaatggtgcgatctcagctcactgtaactcccaccttccgggttcaagcgattctcctgcctcagtctcccaagtagctgggattacaggcatccaccaccacacccagcaaattttgtatttttggtaggtagggacagggtttcaccatgagggccaggctagtcttgaacttctgacctgaggctctctgcccacctccacctcccaaagtgccaggattataggcatgagccaccatgcccggcccctttcccctagttcttaatgtcctgttcagagaaggggctctttctcagctctgccacatactagctttggcctttgagcaaataaatttacatattaattaatctattcactcaaatacttattaagtatataacatataatagacaatgggagccaaacagacaaaatcccctgcctttttatattttagttggggaagatagataaagaccaacctaagtacatacatgaacatataagtaagatggtgataaatgttatggggaaaaaacaaagggaagggagttgagaagtataggtgtagggaggaagtatttttaagtagagtgactggggaagtcctcaccaggaagtcagcatttcagaaaagactggaataacataagcaaaaaagtaatgctgatatctgaggaaaggttattccaggaaatgagaatggcaagtgaagcttgagacttatttgataaaaaggaaagggaacgatatgactggagcagagagagaaacaagatagagtacgaagtcaggcaagcaaacaagggctagtgtttgtgagacctttaagctaccataatgacattggctcttactttgaatggtaaaccactggacggggtgtgtatatgtgtgcatgcatgtgtgtgtgtgtaaggcagggaagtgacatgatcttatttgtatattttttaaaaagtcattctattctagctgctgtgttgagatgtactaaatgaggcaaggtggagattgtggaagctacctagggaatagatgacggtggttcataccaaaggagaatcaatggcagtgttaacaaaggttggattttggaggtagagctaacgggagttgttatgaaattaacataggccataaagaaagcaaaccacattactctgaaattttggctaacttgtagaatgtaactgtgaccaactgagagaagaaacactgcagaggaagcattttttttttttttttttttttttttttttttgagacggagtctcgctctatccgccaggctggagtacagtggggcgatctcggctcactgcaagatccgcctcccgggttcacgccattctcctgcctcagcctcccgagtagctgggactaaaggcgcccgccaccacactcgggtaattgtttttgtatttttagtagagacggggtttcactgtgttagccaggatggtctcgatctcttgacctcgtgatccgcccgccttggcctcccaaagtgctgcgatttacaggcgtgagccactgcgcccggccgcatattttatataggatgatctagagctgagttctcatacatgaaatttgagaagctttctgaacacctaagtggaactgtccagtgtagctctggttacatgagtctggagttcatgggaggaaagatccaagctggagatttttaattactttgtgccttcattttcttgtctaaaaacagaaggtaataatggcacctatctcattggactgttgtgtgcctgaaaagagctaatcctcggtaggccagtaagagactttatagtgaattgatttagtggaaatgaatcaacatagaaatgaataataaatttaatttaagtaaatgtatttgattacatacttttatttttcaaaaaaccattcttaatcccatgtctttttccaattagtttatttcagtgtgcatgtaatgtcctttcttaaaatatacaaactccaaggatattacttatgaagctatataattttaggttaaattaaataataatcagaattttagctgcataagcagatgccgttttggccattttaaaaattaagctgctctgatgcagaataaaaatcaatgacaagataagttattttggaagaaaatacaataatttctcctcactggcagtctaagttcaatcaatcaaatgaaataattaatttgcatttataataacatatagtgaaggaagtcagtactatcgaatataaaggaaacaccaaactcattggattatccaacaaacagatatctcaatattggattagctcttcattttggaaaaatattccaaatgcaactttatcctccgaaacagagaccctgttcccttcagttattagcaattcataatttaacatgaggacatacgtaagaactggcaatgctgctccaacttaggaactcagaggagatgctccagagaccaacattatcagtccaatgcagattagtatcactttgctcataaaagagagtataaaggttcttgaagtttttgaaaggagcggcttagctgactgttaaggaagctatcttttgtctacaagaaatttatactttttccttctaaatttcacaaacagaatattattagagacaacagaatacatttacaaaaatggcatcagaaataattgaatacattgtgtacaatatcttctattaatgaaataaatgtatattttatatgatatttggtctttatgaaaaaataatataattaccaatattctaaggatgaacaaagaagtttacaatagcatgcaagaaaaatgagaagaaaatgatacaaattgatgttcagaagatttcaaaatcttcagcaaagtaatttcagaactaatacatacttaaaagagaaagaaagaactgtgatttcacagtcgaaggcatacaaaatataaaggtattatgatctgaagagttaataaaagagagatgaaaagggagttgatattggaaccttaaattttttcctatctgatatttactttaaagagcttttctgaaaaattatctcttctactctatctcaaatttctgtgaggcattgtcttctctagcaccataaaacacattcagtctttactctgaacattggttattacttattaaaattaatacatcggaagattgtaatatattagttgtaactcattagctaactcatgaaacgaacagccagaattggttgtcaagcagaatattaattgcatttaataaatgttagtttaatgttgttaaatgtgccacatacatgggtaaaggcagtcatatgttgcatatgacacggcatacagttctaaatttcccgagggtgacattccctttggagattggcaggagagcttttgttcttggggccttttgttagtacagcttcaggaatttctagtgatcttattttgtgtcatggtatttctactttggggaaggagggttggacaatggatggaatataaacaatgaactgccctttacaccttgaatgatagcctcaatatgtaactgaaaacactttccacatttaactgttgaataaaactagtcaattttgtttcaatgatgctatggccaaaagacagcagagagagcaataatatgagctttggaaataaataattgacttttattttccccaaattttttttgtatgggtaatacctgtataagggcaaagattttcttcaacttgaactaaaacctgtatttttcattaaattttagtccattctaaacattattcaaaatttttagatcttccaccaccaccagatcccccgccaggtcagggtttaaggcagcaaataggcccgagccagcaggctggtaacgtggaaaactcagcagagagaaaaggaagctctctagagagacaacatgcatccagcttagaagacacaaagagctcattggattgtccagctagaacctccctagagtggcagcgacaaacccaggaatggataagctccacagaacgacaagaagatatacggaaagccccacacaaacaaggtgtcggatcaggtgtgttctgcacagtcccaagaaagtgtggactgttaccatttcttttcctaccaggtattctagaaatggcagttgtttaagggcatctgaaaaacatttgccttcaatcgtaatggaatttggaattccttaggagattttaccagtacatgccttaaggctgattccaacgggcattgctcctcagtcagcctctccacagggtctttgatcccaagagacttccaggcttcatctaaacggctcagtagaaaattttattttttggcctattaatgtttatattgagtactttaaagatcgctaaatttaatcttttctgtcagtttaatctctgccttcagcaagtttgttcattttggctgaaataaccagtcattcgaaaggagaactcacatcaaatatgtgaattcattaaaattacaaagttgcagaaaaatgcccaatcacagatcctcaaattagataaggttatactgggcttgcactttctccaactgttaatcagttgattgatttagttggttgttaatctgtctatgggaaatgctcttttttataaatcaagcttcctggaaatgtcacagaaataaatttcattgtttgtagttagatttttttggggggagaggtgtggcgcgggaggtggggagcctgctttataaacgcattttctgagacatctcatgtcaggattcattgagtactgaaacacacacatacacatacacacaatctttgaaaaaatgtcttttcacttattcatttggacttaatgtgttgtagataggcctctccatgcatttcccataactacattttgtcacaacttggtgctcaagtttttggaaaatgtcatttgtgcaagggccagtagatgacaattttaatatctaggtttagtgaaacatttagaaaggttacaccattcaggctgtgagagaaaaatcatgtggttcttgtcattgaagactatgtaaggggagaaatagtaaattcagtgagcattaatcacaaaataatagcccatacatagaaagaacgtgaaagacagaggggatggggtgtggagagggagcaatgagaatagagagggaaagaaaaaacaatttttgaactattgagtgattatttgtaacatatgtcatgagttatttgtagagagacaatctgtaaaaaaaaaaaattagcatattatttatttaaatgtgtgagtttctcttttacttttaaggaaatacatagccctttaaataatgtatttctgtctcaaaaagcaacataaattttaaaagcttatttaactaatatatagttctttatctaaatcaattgagaaaatgttgccataatttaagctgaaacaaaaaacatgtttctttaatcttaatgggaaaattaaattggagcctcattgaactttagaaattattctcagatatgcttttgttaaactgtagttcattgtatgcagctctcttttataatgaatttaaattttgcaaataatatataacattgtgtacttatcccaagatctcttttaatttaattctgctttggttcctattgtaggaaatgttgcttgcacatagaaatttctttaatatccggtcctgattaaacttcataattttaattttattaaagaatgaaatggtaaagtaggccattcacagtgttatattcaagagttaagtttagtttgcctccatgtttctgttcaatttagcctttgggttttttttctttttcagaggaggccttggtgccctatagcaagcccagtttcccatctccaggtggccacagctcatcaggaacagcttcttctaagggatccactggacctaggaaaaccgaggtgttgagagcaggccaccagcgcaatgccagcgaccttcttgacataggatatatgggctccaacagtcaaggacagtttacaggtgaattatgtaagtgcttaggtcatttaaaaggctatcgtgattcagaaagaatcttgggttaataacattgccacattaaacaaatttcagattaatagaaaacttgctctgttacaaaaacaatcaattgcaattttcaacaagtttggtcataacttaggccattgctatatttattgaagtccatttttataaatgtttctgctatttcacgttggatttatgctataaaaattgttttaagttaggcaagtagtcttaacacttatacatgaaattaaatatagagtgtttatcattttctttgcctttttaactgaacacaataaagaaatggagacactggccttttggtagttttaaagaaactcctaaggaatgcttcattttcaagttactctatatttattttttaaatttgggtagtcacccttgaagagttgatctttgattgttaattaaattgtaatgttttgactacaataacattttataaataaatttccatttatgaatgaaaactggcataggtagttagtacaattaattttctaaatgtaaaatactaggtaatagggaaaattaagaatgtcacagcaaaaaatgttgaactccttgtgttaatttcctcaggaaagttaccaatacagctttgcattatcagaaacatatttgctgaatatttttaactgcctcatcagaaaaatagcattaccattatcttcacatcacagattgtttggaagattctgtgagatgatgaaaagagaaataatttcaaaattataaatttctttattgatctcagttgtcattgttgttgactattgctaatctattattaagattcatttataattttaatttgattcataactacttgaatttttctttaacttttttttgaagtaatgacagactcacaggagtaccaaaatagttctactgggtgtttacatttccaaattctatagtgttttctttccttttactctttgatcatctccttcaagtaaaattacttaaattcacaaactcatctatctgaagaccttattttcattgattatctgttggctttgctttttgttatgctggtcagaaaagcagaatgcttaatttatattttatttctacttttttctctttctttagagtaaatgagaggagacatacaaagctgctctgaaggaccatcaggtccggactcatggaagtgatgactctaaacagtgcaatgaacaatttatttatgtactattaaaagaactgtaaatgcaatgtaaagacacacagccacacatatcccacagatattttcattgtgttcttctcttaagtacaccacccaccttaactctttcttgtcaggagtatataaaaaagaaagaaaacaaaactcgccctacaggaagaaaaggattctcctctgtatataatttcttttgtgcattgctatgcaagctcactctttttagctctgctcatattattgtctgttcttattggtctgttgtactatatgtgaattaataggctgtggtgccatatattaacttttaattgtgtaacttttatgtttaaattttgcactgcaattttatttggtgataagcacaaatctctactcctcatgacatgaagaaaaagactgaatgtgaagggagtttctgtactgtaagctagattggataatgatggctgtaacaaatcatgttagatggttttcagttggggtgtagaaataggaagatgcaaaggaacaatggtgttggcaaagtcttctttgaatatcagggactgagtcaataaaaaaaatagtagaaaggtggcttttactattgacaaaagccggggtcaaaaaaagtagtttaagtcttaagactgaatatgcattaaagtatgcaggtagcaaagatgtaataaatttgcttaaaaaaagaaattaaagttttatttagaatcaattttacctgtcattgtaattgacccatctgagaattacaataagcaagaggaaattaaggtgttttgcaagagctgtatttatattacagttttttaaaaacattttctgaattatcgtaattaagctctccaactcgttaagtcagaatataatatgaagttccccaaggaaacgaacaaaatgaactctagaatatctagcaaatagttaaagaagcaatttattattagggcatactcgggctgtttccaaatataaactctattgcaatatcttatttcatctttctaatacatgtacagtgcacactagaggatagagctgcatcacttaaattcatgacttaaaaaataatacagtttatatacaacttgttttttatttgattaagaagtgaagtttacgccacccaatgtatagccaaattgtacgtgcttaaaaaacagtgccgagagtatgttcagttcgcagtaagtagatttattggaataaatattctatggtacattctcagaaattggcttccaactaaaatacgtttgacccattttgaataaggaaattgaaaagaaaaatttaaaaggagaaaaaaatgcatgtttataaactttttaaataaaaccagaccttgtaagtggacattaataattgtcctgcctcatttgttttcacgactttgacaacaagaagttcctgaacattagtcatgtatgctcagaataaatgtgactttgaaatatatgttagctactgtacatgtatagtcagtcaagtagaagaggaccttcctgaaattcccacttgtgacattttcccatgggtttcctacacaatcttaaattttatttctgtctatactttctcaaatttttcctatgataagttcagttgttggtactcttctaaaaatattcaacgtgattaggatcagttctaaaatacgggacccctttgagtgacaattcgcactccatgcattattggctcagtagccaatttttgtcacgtcgttataacaaggagatgacataattaaacatttccatcctttctattccctgagactgcatcagcacaggcaagtatagaatgtaatgttcttcatgggccccaccagctttttggtgccatgtaatttatttcttcgctgaagagaaaaagaattctgagacacagttattaaaccctttatcaactttctaccatcagtgcctgaattctaatgcagtgtgatttctctgggacaaagagactgaggaagatgaaaagtttcttcaaagagtgaatacatacttattcacaactctaggatgtgaggactttaaatatctctttatgaagttccctgcctaacctctttctatttaaaggcaaacaaatttcgaagaggttttgtgttccctctttatgtttctctatgacccagtttagtctaaaaccttagttcattacatatacaacacatagcctttgatccctggtaactggcaggtgttggtgattaataaaccaaggcttcaaagtgaagtatgtgtgtgcagatgacttttggaataacgtgggcatagcatcataccttcctgattgtcttcagcatataaaaattaactgttgtagttaaaattatgtcagtgcagagcttgtggttacttggaatgttctttcagaatagtccatgttgcctattaaacctagttttaaacacattgggcagtcaatttatgcacccaaaatatcaccctcaggtagattgagggcaagataaaatgctgtatgtagctatacaaaggaattcagaaacattactggaaagcaaagcctttgtcagcttgctactgacaaagtagtaaaaagctactaatcagtgttgagtcagatgtcaacagaaaaatacaaatacctatgagagccacagcagtttctcgtttcatagccgattcaatgaatatgattagaaattcactgagctcactcttgcaggtttaaatggaggcctgcataaggactgcaagaggaaatctgggtgggagagaatgtaatctgatcttgcactcataggcaatgctgcaatgcaatcatgtccaatacaagcacagcttcattcataacaggaaacgtcttctttgggaaaatagctctattggtgcccaaactcaggtatgccagtgtatgcaggtggagtcgccctacccctcttccaaacatgtcctgtgagatttttaaaataagatgggatagtacaggggcatgaaaagaattgattccttcacaggatttgaatccagttcaagggagaatgtagaaaattcaaaaccaacatataaggtatcacacaaccaagaaaagtaaaaccattgcaagtttacttgcgttgagtacaaaacagatttaatggtgttctatgtcatagtttaatgctctgggtatttaaatatgttttcaacaggatttgagttgaaagtttgtaatgtgctttgatggaacacctctcaatttctattcaataaacttatgtaattgtccattgacaatataatgataacagtaccattgaactctaaactgtggtttatcttcactactgggaagcaactgtgcatcagtattaaagatatgcagaaacataatattcactaatttgttcatctgcttctgtatattgtttatggaattacatggcaagaactgttctaaagcaacatgtctttccacattattttagaggtgaaattacttttgttttgcttctctataatgtgtacttcaaatgaaacaccatacttttttctaaaaaaagatgttcaatttactaatttttttaaatctcataatttaaaaagcatttgttgtgattttaaagtgttgcaagaaaagggattttgtggccgtgggtagactttttatactttgttttatagatggattttttttaactgtagtttgtttaagtcaccaagcagcatccaaaatcttaatgtgtttcatttgatgttgttagatcagagaagaaattggcataaaatcggttaatagtattgtcaaagaattgtgtattgtgtactcactgggaaaaaataaaatatattcacatttcaa

SEQ ID NO: 2591 - DNA, 95539 bp, Homo sapiens
cccgcgggggaatcgcagtgagcagcgcggggcgaggccgccgcggacgccccgtcggatgtgcccttcgctgggccgagcggcgcagggttggagagggaagcgctcgtgcccaccttgctcgcaggtgcccttgctgacctgggtgatggccttctccccgcggctctcggccctctggctggcggcgcgcagctggcagccgctcgggtaggtggtgccgtcgctgccgcacaccgggtagcggctcttgcacacgcacacgccgcttacacccggaccgccggctgctgccccggctttacccttccgcctcttgcggctcttcacgcactccatgcccggcgcgcagtaccccctgccggcgccgccacccccgcacggctcgccctcgccgcgggcgcacatagggcagcagccgcacgcgtcgcgggtctcgcccagcaggcagcccagcgggggcaggggcgggcaggaggccggctcgcaggggccgcaggtgtccgaagaggaggaagaggagaggggcaggagcaggagcagcagcccagcggcgccgaggagcagggcgcgcagcgacggccgctccatggcggggtgcggtggcagcggcaagggcgcgagtgagccgtgtcgggccggccggcgccttaaacccgccgccccgcccggcctgtccgcgggaaccacaccccggggcggtgagagcacgggggccccgcccgtgccgccctcccggccccgcggggcctgcgcgcgcgctcctgctggcgtcggggggtgagcgggcacccggcgtgaccggcccatgggcgctcggtctcacgcccgcttcgcagagctcaccccgccagctcctgctcggtccccagtcccctgccccgagccctcagggatcgcaccgcagtgcgagcggctcttccaccctctggtttctccccgtttccggtcaatatatttaaacttcttaacaaccacggcttcgagacgatccagggtttcatctattaaatcctccgtgggcctgagacacctgagtgctcattactctgtggtttgggaagctctcttaagaacaagctgttaaaaacccccacttgtggactgtgtccccgctggccacaggcctgctgtggtcttgggtgtcaagcactaaaaggacaaaccgttgccaaccacttccctttctggaacctcttaactgcctgcacctccctccccgctttgtctcccagtggcattcaacaagactctgtgctttttttgtgctgagccgttttcagtgagtactggaatccgtgtgagagctgtgcccttgttttgagttcttgctgaactgctcgccctccagcaagcctctcgggagaacagagcgcagctgagaggagcaggggtcccagctccttcctcgttggagctgccacggaggcacctaaagcgcccccagtcttcaccagcattccaggaggtttttgatataaacggtggactcttcctcagtctttctgcgaagtgctctgcaaactcaacttgaaagcctctcttcccaggaacactggcctctccaatgcagacatggaagttgctttcactttttaactgaatgtgtaacattgcagcgtgcattattctgcatgtcacattgtggttcttttgtgttcttttttcttagcataaatccagggatttacagggttgctgactgaaagccagcagttcagttcataatcccattagcagtgtaaagaactcattctcaacagactcttacaaggataattattgcaaattttttgaaaattaaatgaccacaaaatcggggggtggagagtggggaaacatcctccaatccagaaaaacctagcactgctttttggcctctccttagtgtattatagacaagtggagcattttttttcccctcaaaggtcatatgttgacctgacagttgtttaaaaaacaatgaaaaatctttacagcagagtttccctaaatatttttgtctttgttccatcctaagagatgcagtttacatgacccatttgttttcttgaaaaggaaacaaatgcagagtgcactctatttcctattgtatttaatttctttctttctttcttttcttttctttctttttcttttttttatttttttgagatgaagtctccctgtgtcgcctagtctggagtgcagtggtgagattttggctcactgcaacctctgcctcccagcttcaaacaatccttctgcctcagcctcccgagtagctggtattacaggcatgcaccaacatgcccggctaatttttgtatttttactagagacagggtttcaccatgttgcccaggctggtctcaaactcctgacctcaagtgatccacctgcctcggcctccgaaagtgttgggattacaggtgtgagccactatgcccggccctgatttcctttttattaattcactggtcaagagccactaaattggttccatgatctagtatgacgatctgtcatagttttagattctccagaagctttctctgagacaaggattccagtgcaagtaggtcacctgagaagccacatcaggacacagagattgagggttggggcaggcaggtgagcaagcaggaagggaagacagccaataaaggtgcttatctccgcagccagaagaagccctcaggctctacaaactgtgtgtgtgtgtgtgtgtgtgtgtgtgtgtgtgtgtgtgtttgcgtgtgtagggcatgtgggtgggcagtggcagcagctgtacactaagagctgtcacccacagtgtgtggaggtcctgcatcagagccaacagtgagaatgcaagcatgtgctacagcggagtccctttgaggaacctcctcactgcccagcaagcaaagaaaacaagcaagtttctggtcactgaaaggggaacccgagctctgtgatagtgccagtcgagctggaggacctgaaaacaagaagagatgttagaaaaaaggcaggtgaatggagcctttaaagagcaagttgacaactccacccttccaataacagatatattgtcacctgttcagcttcagttttagtgaggtggagaggctggatgtggagatggagatatttttacttcttcctgtttaattggtgccttttgtttctttttcttgcttaattgccctggttagaacctccagtataatgttgaatagaagaggtgagtggacacccttgtcccagtcctcaccttagagggaaagttgttagtttttcaccactaagtatgaagttagctgtgggcatttcatagacagtcttaccaggttgaggaaattcctttctattctgttgattgtttttcatcatgaagtggtgttgaattttcttttcttttcttttctttctttttttttgagacggtgtctcgctctgttgcccaggctggagtgcagtggcgcaatcttggctcactgcaacctccacctcccgggttcaagccattctcctgcctcagcctcctgagtagctgggattacaggcacatactaccccgctcagctaatttttgtatttttaggaaagactgggtttcatcatgttggtcaggctggtctcgaactcttgacctcgtgatccgcctgcctcagccttcccagagtgctggaattacaggtgtgagccatcacgcctgacagagagtacattttaaatgttcttgcctcaaaaatgataagtatgtgaggtaaagaatatgttacttagcttaatctagtcattccacaatacatacatatataaaaacatcatgtacactgtaaatatacacaattttttgtgaattaaaatttttttaatgtttaaaaagaatcattcctgctttctgagagcaccccatccatagcaacctcctgcttccttagaccttcccctaaattactcaaccaaagtccaaatcctataataggctctttctaacacccccttactgagacccccatagttccatatggtgtctatcctcccttgctacaatgagtgataaactcaacttattcaactacaggtgcattcctgtgatctttggctgaagggtaatgatgcaagagatatatgtccccctcccttctacactacttcagctcaatattcccccagcccacaggacactcccaaaccctttgccgatgggtccttgtacctggcgagcacccttcttggtggagtatctctaagactactcagtctggcaagtttcttgatatctgtgggaaacccgtggtgctgtgcagcctgcccctgtgaagtccctctatgtccagccagtacagggccagaagccagcctgcctattcaggagacatctaattggacaacggaatgcttgtctctttttcttgcaaacatcacagacctcttggctccgttatccttgtcttcttaggagttgggggtggggcggtgattaaggggaggagaaacctgctttctccagtaagctctcaccccaaacctgtttatatgtgcctgtgtgtgtgggggggtggggggatggtgtgtggggcttgtggtgcttgtggcagggacatgtagcattgaggagcattctggttcaattttttttttttttgagacaaggtcttgctctgtcacctaggctagagtgcagtggtacaatcatagctcactgcagcctcaaattcctgggcccaagcgatccccctattcagcctcctaaataactgagattacaggtgcataccaccatacctgactattaataatttttctttgcttttgtagagacagagtctcattatattgctcaggctggtctccaactcctgatgtcaagtaatcctcctgccttggccccccaaagtgctgggattataggcatgagccaccacacctggccctggtccaatttttggtggctctgctttagaatgtggggacacgcagaacctatagttttgggttgtagatcctagtgccattttttaggcaaaggaagagttgttctattcaacagtctgttacaatagttatctatcatctttattatttcatttttttctcctttctctccttcatcgttatcaccattagtaagtcagagattgtcaggtgatggggtagggtgtatctgatcacccaaactcggataaacagtgcatgaaaaggggctaagccagtggaaaccactttggcatgttccagctgccacaagaagttcagcttagctgaagcaaggtgagtatgtggagaagtgggaagaaatgagtctggagagagggcagatgacagataatgaagggccttgcacactgcacccagagctttggactgcatcttatagatgactgtgaactgttgaggggtgcaggggagaggcaaggtcaggttgtggtgttggaaggtcattacagaagtaagagggaaatgaatcataacagggacagacttgaagaaggaatgcagtttccacaatgcaggggctacagtcagcctatgctgttcctttatggtaattaaaaaaaaccacctctactgggcagatgcagcactgagggttcaagacttggcaagcaggtggttgctttgtgtgaagaaaaaggcgtccctttctccgatgaagcagacccagtccacatgaagatgcgtggcccagcaggtggagaactgaattatagttttccttgctccctgggctgggtgcccttgtgcagtatgcaaattgcatgcccctaccggggagcgtggcctcatgctaatagtgtgtctggtacagaattggcaatcaattaaaattttttttcttttttttttttttttttttgagttggtgttttgctcttgtcacccaagctggagtgcagtggtgcaatctcgtctcactgcaacttctgcctcccaggttcaagcgattctcctgcctcagcctcctgagtagctggggttacaggtgcccaccaccatgcctggctagtttttgtatttttagtagagatggggtttcaccatattggccaagctggtctcgaactcctgacctcaggtgatccaccaacctcagcctccctgatggtattacaagcatgagccatggcgcccggccgattaaaaaattttaaaagtaaatggaccaaagggaaaatcaattggcagctcctactgccaactactactaccatccaggtaggaattagcaagggcctgaagtcagttgtggcaatgggagtcgaagtagagacagtatcatttgtctatacctggactcttgtgagtgaaagggagcactgttcatgattatgctgggacaatgggcataaatcaagactgtcctggacaatagagacatattgttacccgaaatagagatgaagagatggacaagagatcttaaagaagtagaatatgcaggtcctgtaaagaaactgactggaggaaagtcaagagaaaccccaacatttctcccttgggggactcggtgccagtctctgccacagccagtttgtgttgggggaagaggatgagcttgattttggactcgttctttacaaatcaagactgccttttgtggacagttctggagaggaaggaggggggctccctagcgatcatatcacattgtatcagaggcattgcagggcatttggctgagagtaagcccttgaggtaaagtccctcactgataacatctcactgtgtaataaaggacataaactgatttcttatcagtattctgcatctcatctcttaaaagaggtactgccatgcaggaaaatagctaattatataattgaaaaggcattaatagcctgtaaaattcaatattagagacacagaacttgaaggactcgctagaggtcatttaaagccaggtgactggatccattagccctgatcctaagtcatcaggggcacagaaatatctaaagaaccctcagaaatcatcaaggaagatttttttttttgtgtggtcagtcttgtgttctgctctgttatttaactgcctttcacatcaggaagatttgaggtcactgcataatagccaacttccaaatatacacagttgaaaagaaaatttagattttaaactgtgatcctgactatattgcatatatcatgagaggcttttgaacccagaatagcctcatttcctgtcttaaaattcattatcttaacactttaactttgcattaacacagacttttacatttacatttccctgtaaaataaattagaaaacatttctttttgtgacaacaagtagaaaaaaatgtctttgggttattccataattaggcttcatctttcttttgttatggggaaatgatatgatcatttggtggcaaatgatgcagtgccccatattaatctcccagtggcccgatttcataattcaacttggcaaagtagacaaataaaaaataaaaatctctcctcatcatcgtaagaggctcgggagaaagtcaaatcaggaaaaataaaatattttcagtggttttttcagacttcactatgaataaaactttgtgcccaggaaggagtttcttgggtgtttttgaatgtttaggaggatatttatcctgcaagcattgattcctttccttctgaacagatgatcagctgggatgttaagatgttaacaacatttctttcatgcatgctagtttgttttattttgttttagcttgttaagatgttagaataactacattcctttcaccgatgctgaagattcacctttttaagaaagagtcactgatcacatgaatgacatagatgttgctttatctgcctctgcagtgcagctacctggctggtgtcagcctcttgggtgaataacaggcgaatttcaatattgtcagagtctatagctgtcaagcttcagatctaacttccttaatgctaagccacttccctgtgtagtgtcttctcataacatcattgcttattggtaatgcttgctttaaaagagaaatgtggatgtgtccgaatagaggaaatcctggaaaactttaagtccctcttctttttgattcttgttgagtggcattctctcaggccatttgagtatattcccatgccttattgagaaatagcatttttaggttttccctgaggttcaaaggttaaatatttgtcctcatgttacataaaattgggtcctggaagcccatgtgacacagtagagatggtgattggcttgaatgtcagggtcttcaggagcagggcaggttccctgtggctttcttacagcagggcaagtgatttgggaatgagatattcaagagacaggagggaagatacaatttcaagaggaaggaacaagtgtctttgggctgcagtaaaatctctagcgttctgtgtgtggttcctggtttcaggaaggaatggggcaggttagggcatagctgaggagtgtagtgggggcttgcatggcctcaaagggtcagaagtagacccaactgaaggtcctgttatcctggtagatcttcagtgagaggtttaggaggggctatgtggtggcaatgatgcctgtgtaggaaaacctcctacctctttagccattgaaatgaagagatggacatccagaagtctaggaaaattggcttaatgcaagaaagcaacactttccagctttatgtgcctctcagaactcatcttgctaaatctttttgggtcacttgcaaacacaattggtaattctataccaattgtgtttgcaagaagaggataattcgtgactgaataaaagctattctcaggcataaggccgagtgtggtggcttacacctgtaatcccagcactttgggaggccaaggcaggtggatcacctgaggtcaggagtttgagaccagctttgccaacatggtgaaaccctgtctctattaaaatacaaaaattagccgggctcgttggcacgcacctgtagtcccagctacttgagaggctgaggcaggagaattgcttgaaccctggaggtggaggttgcagcgagcagagagcacaccactgcactccagcctgggtgacagagtgagattctgtctcaaaaaaataaaaaagtattcctaggtgtgaatgcaccaaaccaattagaacatacatcattcttaatctgggcctcttgcagcagctctggtcaattgagggtttatactcagataaatatcattgagttatcacgccctgtttaatgagaagaatgccagacttcttataattcttcataaagccattaccaacctgccctctgtgtgcctcactcgatccctgtctttgacctcctgatgtgccaagttgaatgactttcggtctcccagaatagccgtcctctttagatgtctcacatgtgatttcttctttctggaattccctgggaagacagcttttacctcatcccaagcctctgttttctttaggaatacagccttgcctcctctgcccacttcccttctgggagttgtcttgctattgagttccagccaagtctagaatcctgtctgacgccactcctctctgtgtagacgtctgcccagtgtctgccccggaagtgcagctccctctctctgagccgctctgagtttggttgctgtcttggactgctttcacttgtccctgttgtattctccacaaacatgtccacatgccaggctgagctctttcttccactgctgtagcgggctcgtcccacagagctttattcctcccagtgagcccctcacatcctagcttcaggcctttcccagcccatctggccacccactgcctttgctaagccctttctctttccctgagggcttttagggtaggaagaaaaataaactctatgactggattcatttggaatttggctgtcagagtcatgttctcttcttttgggtctatttaaaaagcatccagcgcccatgggaagcaataacccttcccaaagggctaaggcaatctgctccgacccccggagcatccttcctcatccttcacatctcagagcagacatcggtctctgctggaagagtctttctaaccttcaggtctcacagaggtctcccatgcccctcactcagtgcattctccattttagctttactgcactgtatataaccaccagatctcaaggacaatgatagctttaaaaactgatttgccattgccgtatctccagcactcagctcaataggtgcatgagtgaatgaatgaatgaatgatttctctgcacatcttccactgattagctctctgttgcctaagacatctcagttaccattcattcttcagactttgttttttattcctttcttctcttattccagtttctagcacttgttagctatatgaccttgggtaagtgactaaacctctttgtgcctcagttttatctgtaacatggagtaatagtattacccatctcatgaggttgtggggagattgaatggagcagtgcttggcacataataaaccctcaataaatatgatgattgaattatttcctgtgctttccttgatgttttcacaggattattaaccatgattttgttaaaattgactaatagaatagaataattacttgttgcaacttctcttgctctcttgctaaattgaggagaattatatagttttattttccttttcctttgctcctccacttgatccctcccatatttttggagggactcaggcttttgggtggggaggtggtgagtagttcctcctagggctgaattactttgcaggtaacacttggaatattagagatacctaatgttggacttaagtttgaaagtctttcaatagttttataaggtcaaaacaaacttttttaaagcaaccctacgtgaacactgataaagttaaaatgatgactgagaaaaagtggtgtcaacttaaataacagagagatgccgtctaaaagaaataatatttacttgggaacaggcattgcaataggaatacatgtgccaataggaatacatgtgaactatgtgtgtattcaggaaggtaaaagaagacaatggcttttaaaggaaaatgagagggttgcatagttgttttgagataattatcctgggttataaggatcaataacaagggtggtgccggttcaaggttggacaaatcttctgggcagatgtccttgccgaagtattgtttttatataagattgtgatggtctttgtgcaaggttgtggtttttgctgaatctttagtgatagttcttgttattaggcgtttgtgtgtgataaccttcttttcatggccttccctggcttcttttgttagggtttttaacacaagcgtctccattttgattccaacaactttcacagtggaaacttgtatgtgtagggctggtcattccagcccaacttgcaaagactttcaagctggacctctgtgcatccgctaatggggagtctgtgggaggatagtacctcttgaagagtgcagcctcctgtgtgcccatggggttcttcgtgaagagtttcatggttgctgcttcagaactactgagatttgggaattctcctttcttgttcttttaaaataagcaataagtcaaaggggtttttgactgcccttttttttttttctgggggagagtcttgctatgtcacccaggctggagtgcaatggcacgatctcagctcactgcaacctccacctcctggggttcaagcgattctcctgcctcagcctcctgagtagctgtttacaggtgcatgccaccatgtctggctactttttgtatttttagtagagacgcggttttatcatgttggccaggctggccttggccaggaggccttggcctcccaaagtgctgggattacaggtgtgagccactgcacccaggcttgactgctttttaaattctcaatctcaaagaataataaataatatttgaatagtaaccatactagttttagccctgtgttggttaattttatgtgtcaacttgattgagctaagagatgcccagatagctggtaaagctttatttctgggtgtctatggggctgtttctggaagagattagcatttgaatgagtagactgagtacagaagatcttcctcgctaatatgggtaggcatcatccaatcccctgagggataaaatagaacaaagaggcagaagaaaggcaaattctctttttctctgtctttgagctgggatatccatctggcctttggacaatggagtgcctagtttttgggcctttggactctgggacttaaactgattactgcacccccttcccacctgctgtccaacctcctccaggttctcataccttctgcttcagttttgccatcagctccctcccctggtcctctggtctttgtactctgactgcattacgccaccagtttttctgggtctcttgcttgcagacagcatatcatgggacttcttggcctccataatcacatgagccaattgtcctaataagccaattgtcctctttatctctatctctatctctgtcttatctccaactatatctctcttattggttctatttctttggcaaaccctgactaatccaagccctctgatgatgagacacattttttgtttttcaaaagtagttctggtccttcactttaaagggcaaagtggacctatgtccactttggttctgctcacaaacaggggttgattccaaggggctggagtagggctgttttatccatctttattatcttccatggagcagaagtgatggcagttatcaatatccagtctgcatttaatcaccccatttgaagcaggtttatggcaagtctgcctttgctctataggaacaacagtaaacagctgactggcccaattttttggaagatgagtgtctcctacgaatctcacaagcattgcatgttctacctgttgcaatattcgtctttttggaaaaagtgcctgcagatttcaatgtaacttgcttaatattcatagattcttactctcttctcttccaggaaaatattgttaattttaaggtgagtatcagggaggttgtaggaatttgatcaagcagaaccatgataagaaaagccaacagatgctttggaaattccttataattctggccttaataatggaaggaatgacagttttattagttttctattgttgcttaacaaatcactacaaagttttcagcttgtaggcttgactgggttctctgcctaggctgaaatgaaagtgtgggctgggttgggcttttatttggtggctctgggaagaattcacttctaagatcattcaggtttttggcagaattcagttccttgtggttgtaggactgagttccctgcttccttgctggatgttgttggacagctctctggtcctccttgcacatggcccctccatcttcaaagccagcaatatggcatattcagtctttctagtgcttcagatctctctgacttcctcttctgctactacccagagaaaattgtgctttcaaagggttcatgtgattagagaagacttacttggatcatttcccttttgatgaattcagagtctactgatcagtaataatgtaattatttttgcaaaatcccgtttgccaggtaatgtaacatagccacagacatgatatcacatcctattcctagtcctggagattagggcaggaaatcttgggtggtcagtttagagttctgcccaccacagttgtcaaatattgttttctcaaactaactctttgctgaaactgagctctgggatttcccttgcttgtttttgtttgcctgtgaaccatacagttggttatgctatatatctttttttttttttttttgagaaagaatttcattctgtcaccaaggctagggtgtagtggcatgatcttggctcattgcaatgcccacctcctgggctcacgtgatcctcctgcctcagcctcccaagtagctgggactacaggtgtatattaccatgcccagctaattttttgtagagacctgtttttggcatgttgcccaggctggtcttgaactcctggactcaagcaattcacccacctcagactcccacagtgctgggattataggtgtgagccaccacacctggcctatatcttatcaatggaattgtattctctggctcaaacaagatgccattctccagggcacttattcctggggttcatctattggttttggactttgaggtttggtgtcctccttgcacatggcccctccatcttcaaagccagcaatggcatattcagtctttctagtgcttcagatttctctgacgtcctcttctgttactacccagagaaaactttgcttcaaagggttcatgtgattagagtaggctcacttggattgtttcccttttgattaactcaaagtctaatggtcagtaataatttaattattttgacaaaataatgattttaaaatagaattattttaatttaaccaaagcaccaaagcaccatttttgcttggaccacacaagggagagataagagaagcagaaagcagccaacacaaccttggctagcttccaaacctgtgtcttttagtgttacaagtacatatagaattgctgctgtattcacagaccaacaattatctcattaaataacttcccaagccttgatttagccattatgaaagatgttttgataaagaacatctggtgttgttttcaattaaatattgcaccactaaactttgattaaaaactgatttaaaattttaatagtccctcctttagaagatggcaaaatgcaaaaaagaaaaatgtcactcatttaaattgtttttttctctcctttgttgctctattttaactggattcccattaatgactgtttaaaacccacacaattttggatgcagtaaatagagatacataaataagattaccataccaatactgctgttctcactcttttactactgatacttcattttgtttttatgctttaattaaattgagtatattttatgtttcagtttgctttaaaacaacggcagtgcacataattgacactatttcatcccatgatagaaagtgctgaattgaattaaacataccagttccatttccctttacatttaatctgtggcaaaactaaggcagaaataatatgaactatatttcttctccaagttgccgtggtaggtgaaaataactaaccatctaataattactaataaaggctgaaatgaaatctttactgttagtgtaactcttatctatataaaaatagatatttagtggtataagctaattttacttagtaattttccccaagtggcatgtaacaaataataaacacataattgctattccatgtactccatatcaagcataaatcttcaagcacaaattttaatatatttttactcagactatcaggtttagcctaagtatttatagtagggaaatgatattatgcaatgtttctatagaatagggattgatgaacttttgtaaagggccagatagtagatattttcaactttttgtgggccatactatctcacaactacataactcagctgttacaatatgaatacagccatagacgatatgtaaacaaatgagtatagctgtgttccataaaattttatttacaaaaactggtgatgggccaggtttgacctgtgggctgtggtttaataggctgacccctattattgaggataatgaccaagtgctagctaatgttcacagctgagaaaaatcaataggtcagttcatgaattaaggtcccgcatatacttttgttatcgtaggtatttttttgtttttcttgcaatagtttgtcttaatttaatctgttgattcccatgtgggaatttcctccccaatcttgtattttaaaatagggacctatgctcatccacatttccgcaagtctaaattaagtcatcatataattaccgtgattaaaattacctatcttctcttctgcagtggttcaggcaacaattgtaacatgtttatcttacacaaacttggattaagtcaggccagactttgcaagctcttggcttcataccatttgatatgatttttctctgcatccccacccaaatttcatctcgagttgtgatccttggtgttggaggaggggccttgtgggaggtgattggatcatgggagtggattcccccgatgctgttcttgtgatagtgagttctcaagagctgatagtataaaagtatgtggcacttacccttttgatctctcctaccaccatgtgaaggtgtttgcttcctcttctgctatgattgtaagtttcctgaggctcccagtcatgcttcctgtgaagcctgaggaattgtgagtcaatgaaatctcttttctttataaattacccagtcttaggtagttctttatagcagtgtgaaaatggactaatacaccactgcactctgttgcccaggctggagtgcagtggtgccatcatcactcactgcagccttgaactcctgggctgaggtgattctcccacatcagcctcccaagtagctgcagctatgggtatgcaccatgatgcctggctaatttttaaattttttgtagagatgggggggtctatctatgttgcccagactggtcttgaactcctagcctcaagtgaccttggcctcccaaagtgtgaggattatgggtatgagctatggtgccagcccccattgtattttagatatcattttggttttgggaggcaagagggtcaagtacagtgatacggtttggctgtgtctccacccaaatgtcaccttgaattgtaataatccccacatgtcaagggtggggccaggtgaagatcaatgaatcatgggtgtggtttctctcatactgttctcatgttagtgaataagtctcatgagatctgatggttttataaatgggagttcccctgcacaagctctcttgcctgccaccatctaagatgcacctttgcttctcccttatcttctgccgtgattgtgaggcctcctcagccatgctgaactgtgaattcattaaacctcttttcttcataaattacccagtcccagatatgtctttattagcagcatgagaacaaactaatacagtaattggtactggtagagtggggtgctgctgtaaagatacctgaaaatgtggaagtgactttgatactgggtaacaggcagaggttggaacagtttggagggctcagaagaggataggaagatgtgggaaagttttaaacttcctagagacttttgaatggctttggccaaaatgctgatagtgatatggacaatgaagtccaggttgaggtggtctcagatggagatgacaaactgttgggaaatggaacaaaggtgactgttgccatgttttaacaaagagactgatggcattttgcccctgccctagagatctgcggaaatttgaatttgagagagatgatttagggtatctggcaaatgaaatttctaagcagcaaagtgttcaagaggtgacttgggtgctgttaaaagcattcagctttatgtattcacaaagatatggtttggaattggaacttatgtttaaaagggaagaagagcagaaaatgtgcagcctaatgatgtggtagaaaagaaaaacccattttctgaggagaaattcaagctggctctagaaatatacgtaagtaatgaggagccaaatgttaactgccaagacaatggggaaaatgtctacaggggatgtcagaggtcttcatggcatcccctcccatcacaggtccagaggctaaggaggaaaaaatggtttcctgggctgggcccagtgccttgctgctttgtgcaatcttgggacttggtgccctatgtcccagccagggctaaaaggggccaccgtaaaggtcaggctgctgctttagagggtacaagccccaagctttggtggctcacacgtggggttgggcctgtgggtgcacagaagtcaagaattgaggtttgggaaatactgcctggatttcagaggatgtatggaaatacctgaatgtccaggcagaggtgtgctgcaggggcaaagccctcatttagaacctctgctagggcagtgcagaaaggaaatatggggtgtgagctcccacacagagtccccactggggcactgcctagtggagctgtaagaagagggccatcatcctccagatcccagaatggtagatacattgacagtttgcactgtgtgcctgaaaaagccacagacactcaatgccagcctgcgaaaacagccaggagcggggctgtacccctcaaagccacagggtagaagctgctcaagaccatgagaacccacctttttcattggtgtgacctggatctgagacatggagttcaaaggagatcattttggagctttaagatttaactgccctgctggattttggacttgtatggggcctatagccccttaattttggcaaatttctcccatttggaatgggtgcatttatccaacgcctgtaccccaattgtatctaggaagtaacttacttgcttttgattttacaggctcctaggcggaagggacttgccttatctcagatgagactgtggacttttgagttaatgctgaaatgagttaagactttggggaactgctgggaaggcatgattggttttgaaatgtgaggacatgagattttggaggggccaggggtggaatgatgtggtttggctctgtgtcccccccaaaatcttaccttgaattgtcaagagaagggccaggtggagataattgaatcatgggggtggtttccctcatactgttctcatggtagtgaatacgtttcatgagatctgatggttttataaatgggagttcccttgcacaagctctcttgcctgctaccatgtaagatgtgcctttgcttctcctttgtcttctgccatgattgtgaggcctccccagacatgctgaactgtgggtccaataaacctctttcctttataaattaccatgtcttgggtatgtctttattagcagcatgagaacagactaatacacacagtgagaaagtcaagaagcatttctttaatggactttgaaaactagatactatgattttgccaataagcaggaaagacatttttctttctttttgattttgtgcatgatggttgttttccatatacaaaatgtagtatatgcctgtctcacattcatgtcatattcgcatagtgactttgccacccatagctttctataggtgcagtatttgtattcaagaacagttactgacttccacatcaattgctttgtagcggaatagctgcctcctggtctatagtggctgacatgaattcactttttaagggggctattgcctcaataaaaagttagaatctggagatgttgatttgcagaggagtgtacacacctggcctgccaaacaactttcatcatatgaataggctgaggtggcttacacaaaaacaaaaaaaaaggacctctttttcttaaagcactaatattttgttgtgtaggcaacattgccttacatgtttaaaacatattgtttttgggaggaattaataatatgtattattgggttgttgggaggaattaataatatgtatacataattttattgagggtttattatgtacctggaattttgcacatgttttctctaatctttacaataatcatatgcagtaggaattactggcactttacttgcacagaaaggaagccttaactgacttgtggaagatggcaaaggtggtaaagaggagttgggattcctgcttaggcctctttggaagcaaagctcttgtctgtctttctcttatgatactttctgtttttttaggagacagggtcttgctctgttgtccaggctggagtgtagtggcacaatcatagctcacagtatccttgaattcctgggctcaagcaatcctcctgtttcagcctcttgtgtagctaggaccacaggtgtgtgccactcacctgatggggtcttgctacgttgcccaggctggtctcaaactcctagcctcaagtgatcctcctgcttctgactcccaaaatgctgggattacaggtgtgagccatcatacccagacagatatgttttgatatagctccaggccagtggttctcaaagcctgggccccaccctggagtaatttatttacaatatctagggcaggatctgggtgtgtagatatatttatagattttattttttagagcagttttaagttctcagcaagattgagcagcaagtacagagagtacttatataccctcttccccacacaggcattagcctcctctgcatttatagaaagctatgagtggcaaaggcactatgatgatggcaatatgacatgaatgtgggccaggcatatattatatttttcatcccccagcaaagtggtacatttgttagaattgatgaacctccatcgacacatcattatcactcagaatccatagtttacattagggtccactcttggtgttttatattctatgggcttgggaaaatatataatgacatgtatgcaccattatagtatcatacaaactctttccactgccctaaaaatgccctgtgcctgcttatttatctttccttccccactaacccctggcaactgctaatccgttttgctgtctccatagtttttccttttcctgaatattacagagttggaatcacagcacatgtacctttacaggttggcttctttcacttagcagtatgcatttaaggtttctctcaggatgtggagagttttaaaaagcaccccagggaatgttaacatgcagccagttttgtgaaccactggtctcaggggtgaaatctagaaacagccagcatttaggtaaagactgggcttctccttgccgctaagagggcaaagttgatcttcatcgcccttgctgtgtttccccatgttgctgagctgcccagtggccttcagcaggaagtcataccctcgctaggaacacagctcgtcatggcctcttgtacctggaatgggtgtcagattctggccccattcttgtaaataaatctctgggttatccctgctaaggatctttgggtggcattttattatctgattcttacctttctcttgcaaagaagcctggagcaagtccttagcagaggttgaaccaaggtgtttccgactttgggaaaaggagtggttaatttagaatgacaggatctgggaatgagatgaaatctgagttgaattctgaaataaggctataacatctatagcatgacagtggggtagggctgtttgggatgaggctttctggaaaggagggaacagtttgagacaagatctgaagcagggaagacagggtgacttaacaaaaatgtgagtgcctatcagagccaggggttttgagtagcccacaggaatggggtagtgatgtgttgtacatgcacttgcgggagataactctgcaaaggctgatgagtcctctctgaggcatgttttagtgtcttcttcacctgtagatccctggagactcaccacctctcataacctttggaaagggtagcttctgactcttcttccttgacatggcagattggaccaaggctgaatgctagaactagttttcagtttagttttagcattcagccttggttcaatttctgtatttgttggttcagatgcccaggggagatcatctagctggcaagagaaccaatcagatggtctcatgtgagcatttgaaccaacaaatatagaaatttcatagtagagggccctgattgtgaaccatcatgcatttaataagtgctgattatctgcctcatgctgttctagggcctattgatacagggatgtacaaggcaaagtccttctttcacagacattaggtttaaatgggaaaatgcacaagtaaataaataagaaaatgtcaggtcataacaaaggcaatggatgaaacagggtcctttgaccgagtgtaatcaggagaaacagatgtcatcaaatggtgggcttggggggagatcagagaagacccttgaaagaatgtgacagggattaatagatatggagtccaaggcaaaaattaggaaaagagttgactagagcatgtgtgtctcatgacagaactagagttggggggagctttgtggtccctcgagatttagggagccacaggtgattcctggttaatttttggttcctttgagccatttcctcccttgcattcttttaataacatctctacacacacacacatacacacatacacacacacacacgcacctacacacaccctctcctgagctcgcttaagtggatcttgcatcttgcatgccaaagtgcttaaaaacagggataaattgaggaagattctgaatggtagtctgtggttttggactttgttctgtctcagaaagggcttttgagcgctatagagtgtctttatgcagtggtgtcagggagaacacattcctttttcgaggatggaaagctactgattgtactgaagctcgcattcctctgccaactgctggaacaggaaaaacaaccatcatcctgactgccagcagtctggccagacaccacctgttctcagtgcctgtgtggggtgtttagcttagctaggcagctccaacagcacctggaatgcaaaaacatcctgaatttctccaaacaccacagcaggactgtttaaacagcaagacattcaggaaatagtcattatctccacacctcctgcattcaatagggtggattgttggatgagcttcagagggcagctccagtgagtgccaagtcctcccggaccagatctcccatccacatgcatgtgccacctgtgggccaatgggtctgggcttctcaggttattggagaggaagttgggcttgattctgtctccctgtgtggagtcctttctgtataccaaatgaactgtcagcatcagcacaaaaaatgggtgcagacttgtgcagggaagaggaagactgctgctgttgcacatattttctatagggagcattttggactattattagggggaaaaggtggaggtgggtgggcgagtctcatctgtctcatttgccttgggatagagaaaggatgtactggtagtcatcagccagtgtcttccttcccttcatttgccccatttttttccccatatttggcaggagtccaaagcaaaccattgatgatcaagcactggatgacagcagtttggtctggttaatattctcatcaaggaatgaggttggtaattaacaactatatgagacttccaaaatactttcattttacaactgcctattgtaaccctctagtgtaccctgatgtgcatacctgttcttttgcggttttaaaactttactgaaaagccaaacactttattcaagtgaattttacagatctggattaggaagcagatcaactgagcttcttcctaggaagaagctaaaagatgctggaataaatcagaaatatggcacttttaaaactcaggtttccacctactattattttaaaaagcatcaaaatgtatatcatttttggtcctaatgaagtagagccccttatgtgaaaataaaaacaaaagcaaaacactcttcgatggtgggggccaatttggtctgaatgttttgatgactccagcatgcctgcagttcatttggccccaaccagtcccagcaaggtagctgacagaggcctgaagttggcagttgcagtcagctgaaattctgaaacccagcaacacatcacttagtcccacttactgagaaaaaatgatttactctatcatatgcactgtaatcccttaatgcctcccaaaatgtatctggtttggaaaatctcacacaacctggataataacacatatttcagaaaagagaatgttttgttaacaagaaaggcaaaacaaaacacagtaaaatcaccctgaaaaagccatgtaagctgcttctattcctagtgactctgagggacttggtataacggaacagtgctttgtagctaggaaaaatggaaaatcagtgaaatggaagacaattgcaaataagtcaaaatattatgttaatgataagtgtatgtaattgtctcttgttctgaacataaaggagaaggtatatattttttttcaagtgaagttagttggtttctccctactctcactaaaaatgtgttgagtcaatatttgaagaattggcacaaaccattagccagcccagagaacccatgtgcctcagtgagtctgataaggtggtatcccaatatacgtcaaataagagtaaggcctctctgactgaagaggaaggctggagacccacagcttcgccccttgctagctgcttttgagtatcttctgtgaagcaacttgcaaaccatggctctactggatcattgtttgatgactcctaatctttatttctttttctgtcttcaccagtctactctcactccatttttgtcttttctaccacccctaagctggtgttttccaaagctagtgctcacagcagtgctggtccctgatgaagttcacactactatctgaagagtggtggaagaaaggcacaatttagtgagtttttgcaaagccaaattgttctatttaagacttttttttcattatgagataatatctgcttattttttggttgttaaaatgttcttttttaatgaaatgatgagaatagcagatttttaaaaattcttttttttgggcaaaatagaaaattactagccctatattagtccccaggttttttttttttaattaaaatcacactttttgggtaaaattccaaaatctaggcatcattattttaaggtacatttaaaaaatttaatggatacataatattttacatatttatggggtgatattttgttacatgcatagaaagtgtaatgataagtctgggtatttggtgtatccatcaccttgaatatttatcatttctttttttttttttttttttttttgagatggaggctggagtgcagtggcatgatctcagctcactgcaacctccacctcctgggttcaagtgattcttgtgcctcagcctcccaagtagctgggattacaggcgtgtgccaccatactcagctaatttttgtatttttagtagagatgggattttacctgtttgccaggctggtcttgaactcctggcttcaagtgatctgaccgacttggactcccaaagtgctgggactataggcgtgagccactgtgcctgaccagtatttatcatttctgtgtgttggtaatatttcaagttatctcttccagctattttgaaatatacaccttgttgctaactatagtcactccactttgctatcaaatattataacttttaacttctatagaactgtaagtttgtacccattaactaaactctctttatccctcctcacccccacataaccttctcagtctctggtacctattattctactctctacttccatgagatcaactttttttagctcccaggtatgagtgagaacgtgtgatatttgtctttctgtgcctggcttattccatttaacataatgacctccagttccatccaagttgctgcaaatgacatgatttcattctttttatggctgaatggaactccatcgcgaatataccacgttttcttttctttctttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgtgcccggctaattttttgtatttttagtagagacggggtttcaccttgttagccaggatggtctcgatctcctgacctcatgatccacccgcctcggcctcccaaagtgctgggattacaggcgtgagccaccgcgcccggccatataccacgttttctttctttagtttaaaaatgaaagcaaatttgttaagaaagtaaagaaataaaagaatggctaccccatacgcagagcagtagcatgggctgctagactgagtatacttgtagttatttcttgattgcatgctaaacaaggggtggattattcaccagtttttaaggaaaggggtggagatttcctggaatgagggttcctccatttttttaaagactatatagggtaacttctggacgttgctattgcatttgtaaactgtcatggcgctggtgggagtgccttttagcattgctaacgcattcataataagcatataatggctgggtgtggtggctcatacctgtaattccagcacgttgggaggcccaggcaggtagattgcttgaggccaggagttcgataccagcctggccaacatggagaaaccctgtctctattaaaaatacaaaaaattagccaaacatgtggtgtgcacctggattcccaactacttggctgaggcacgagaattgcttgaacccaggaggtggaggctgcagtgagctgagatcatgccactgcactccagcctgggcaacacagtgagactctgtctcaaaagaaaaaatagcatataatgagcagtgagaatggctagaggtcactttcattgccatcttggttttggtgggttttagccagcttctttaccacatcctattttatcagcagggtttttgtaagctgtatcctgtgataccagtcctgtccacctcttatttcatctgtgactaagaatgcctaacctcctaggaatgcagcagctcttagccttttttatccagcccctattcaagatggagtcactgcctctgacatatttccccccttccttttacaagggaaccctcaatcctaagggttgtagagggatgaaaactcatcttctgtaacttcttcaggctaaataggggcaatgataatcctgcctaactattagggtatttgtatctaggacagagaagaactcaatcagaaagtgtcaatatgctgagggtcattcataactctgagttccaacaaaaggtgatatctggaagattaataagtgttcaatttaagaaaatgttgagtaagcttatcctacattcctacaaagggtacaacagcaatatatgccacaacagcaaagcaaaataagtaaaattatcccaagtaaactaaatagctttccatgaactgggcaattgtgggaaccaagctgatatggagttgctagctggttccagtgtgtgccagaattagaatactgatctagatttttacattacccatcccttttgtttcttctgagctgcagccagagatcactggttgattcacaggaataatcagggttagtctaaattgcaggaaaaaacttaaaaacaactgatgagattagaatctaataacaagtgtaccatggtttttgaaacatactttttctcttcccagttctcattttgattaaaaacaaatcatgatagcactgaattgtttgcaaaataagctttagtcttagacttggcctgattatttatataaagtgtaggaagaataactatttttcacatagactttttaagttggccctgatggaactctgttccataaggaatctcagataagcctttttttttttttaaagccttgagcccagccatggctttgtgccattaaatacctatatgagttgggtacattcctctctcttgaggtctccagacaacttggggctcctaagtctgtcaggaagtgacattctttacttaccacaggtcaggaactctgtacagggactgtgtagacaaagaatgagaccagttttctcaaggggcttttattggctctataagtcaactttgattctttaaacaagtctgtctgtacctgaaagcataccattccagtaaaagccttaataaaataatcagcatttccaattgtgtcctgttacaaaagaaaacagatcattattacacctatgcaaataacgatattgctataaattaagaatacttacaaataggccaggcatggtggctcatacctataatcccagcattttgggaggctgaggtgggcagatcacttgagatcaggagttcgagaccaggctggctaacatggctaaaaatacaaaaattagcctggtgtggtggcgggcacctgtaattccagctacttgggaggctgaggcaagagaatggcttgaacctgggaggtggagattgcagtgagccaagatcatgccactgcactccagcctgggtggcagagcaagactctgtctcaagaaactaaaaaaaaaaaaaaaaaaaggaatactttacaaatagtttccagattctggagaaatcaggtagagagaaacaaatacgcttccaattttgtttatagaagtatactttactcaattgttaaaagctgtaaatagctcaaaagaaaacttttcttctctctgaaaacaaaacaaagaatcagtaacattttaagcaaaaaattataaagggattatttcagtcttctattagttaagttcatgcagttaacctccgttctgcttgatattcatgaacatttcagctttccatgagagtcctgaaagatttttctctattctaatgtcacaatctccaaagttatcagaaacctgcattcaagagcacctgtcagagtcccatagctgattataaaactgccttttaaagaggatcaaaacaagataacaattgtctgtggatgacaaagtcttagggcagccactattaaagccacaattgactagaaattttggttacttctttggcatacaacaactttacataacaattataattgtaaataatgtacactaagtcagaattataggagtttcccataattttggaatatataccaatagcatatttaatgaatacagaccaaagaaagccaaacaccattttatatttgacaatgcttcttttatgattttataccaaataaaccaaaaatagtaagtcatttttggactttaggggacttaatatctaaaagattatttatttggtcagaaaaagacataatttacaatatgattttggaaagtttgtcaaatatcaaaggtttagaagacttggtactataaaatagaatttcaggtcactgtaagtcattcatttagccaaaatgataactcaacaattttaaaaaggcaataacctttactcattattagagaaaagacttagctttccaaacaatctcttttctttcctttctttttcctatagtttatttaaaaggcaaataaaatcttttattatttttaatattacatgaaaattttgttcaagagaaaaagggggatgtttccataccttccaggtggccaagagcacgtgtctctgatctaaaagtgcaaagagctgagtattcccccataactgctattaatatcagccatcttcaaaagtatatttcctacctacttattacacaccaaaactctctcataatatgaagtaattcctgatactctccaaagctgaagacgtcagataatgcaatgcaaaacagaacagagccttagattttgagagggatctatccactttcaattcctggggtttcatgaggaaaatggtgttttcctccccggcagagtctgtggtgcctcttctgtttttcccaaggagtttcaggctgttagaaattatctttggataatttctctcatgtgtgcatcaacagtggcaagaagacaaaatggagaaaaacaattaagtcagctgagaagagaaaaactttttcttcagaaaaataagatccagtaagagaaaaaaacataaaggcctttaaaatatatgtatagcatgtatattgcttttaatttagctgacttttaaccaaatatcttattaccaaagtctatccagaataaacagcaagtatttctggcttttgaactttaccaaaggtaacctcccaggtgctcagagaaaggaaaacccaagacaggaagtcagaagttgtatatggaggggaagaggatcagtaaatggcaaaggtcacacaaatatcaaccagaaagttctcattcctaggctgaaaatggaacctgggctgccattgtgaaaagacaaagccttagctcctaagctacaacattgggcagtttcctctgccctgcccagaaggactctagaggcagccaattttgagcctgcaaaggcttttaactgctcaagagaatttttagagctatgacatgaattccaaaattcctgtctctgaattttggcagagaccaagagcaagtactgccatgtggttatgaggacaagctcctaaggacataagacaagatgagagggaaatatcatctaattttttgtttgtttgtttcagggaagcaaaatttggtaactgaccagtttgctgggatggcttggacagtggacttatgggatcctaggcctgtgttctatcctaaggtacccctccttatgacagaatgatacagaaagacaaattcatagcataaagtccaccggatttgttacagtctaacactagactcacagattattttttcccattgttcaaaacgttgcagaggaggtgaacagtgatttctttaccattcacccaaccagtttgcacagagagcgaggccagaaacctgactggtaagaaattcttacccttttgctggcatgctagatttctgggttcccttttcctcagcacctgtagtgaccctttttgccacattatagtcctgggtgccaagccgcaacacaaaggaaaatcatctttttctgtttcatagaaccataggcaaaagcctatcaagtttgcaagatgccacccaaggggttgcatgggttaaccaaattcacatttcccattctggccagagcaaaatacatgtgacaaaacacagacattagccaccctgtttagcacccaatattgaactggtgaggctcaaacttgccccgagttgggccctgttatctttaatccattcaaagtggggtggaatgacctctaaccaggagtttcaaaatgtggcctctgggtaagatggaagagcagatggcctccttgagtaacagaaaagttaggaaaaggaaaggagagaaagagagagagaaaagcattgcttgcagtgtggtgaggaaggtgagcagctcagggaggccagagaaagacccactgttacccattgcagagacggtgaatcaaaagttcaggcagctgcttgtcagtcacaaaggtatcttttccagcagccccataagctctcaagtttcttcctttgtggagagaaaagctccccatgtcctgtgatcctgtacttgcctaattatgtcacccatagccatcagcaaagagagtaaggcagattaattcaaagagaatagtggttaacatcccataatgtcaaatccatttttaaccaagagactttactgagggggacctttaaccccctaaatcttaggaaggactctaaccttcctaagttgggccttgaaaccaagtttggtcaagtgtccttgccttttattaagaggggcctttagccctctctgtcttaggagggattctaaccctcctaaattgggtctctaacccaatcccatcatttaccctggtgaaatgtacccgccctcttacccaaagtcagccaattgatactgcagtccatttcctttgagttgggggtcttctcactatagtctcttcatggttttccaggaagatgttatgggaaaggggtcccaatccagactgcaagagagggttcttggacatcatgcaagaaagaattctgggtgagttcatagagtaaaatgaaagcaagtttattaagaaagtaaaggaataaaagaatggctaccccataggcagagcagcctataccacattttctttatccattcgtcctcttaggtagattccatatcttcgctattgagaacagtgctgaaataaacatacgggcacaggtatacacttgatatgctggtttcttttcctttggataaattcccaagagtgggattgctagatcatgtggtagttctattttcagttttttgagaaatcttcatattattttccatagtggtgggactaatttacattcccaccaatgatctacaaatgttcccttttctctgcagcctcaccagcatctgttattctatgtcttttcagtaagagccattctgactgatgtgagatggcatctcattgtggttttaatttgcatttctctgattattagtgatgttgagcattttttaatatatctattggccatttgtatgtctttttttgcacaatgtctattcatgttctttgcccactttttaatgggattattattattttactgttgagtttttcgagctccttgtgtatcctggatattaatcccctgtcagatgaatagtttgcaaatattttctcccattcaacaggttgtccctttactctgttgattgtttcttttgctgcgcagaaactttttagtttaatatagacccatttgtctattttgtttctgttgcctgtgcttttgaggttttagccataaaatctttgccttcaccaaagtcctgaagggtttcctctacgttttcttcaagtagctttgtagttttgagtcttacatttaagtctttaatctctcttgagttgattttaagttttttttttaattttaagttttggtagagacagggtctcgctatgctgcccaggctagtctcaagctcctgggctcaagcaatcctcctgcctcagcctctcaaggtgctgggattacaggcgtgagccactgtgcctggccttgagatgatcgttggataagatgagagatagaggtctagtttcatttttctgcatatggatattcaattttcccagaaccatttattgaagagactgtccttctcctaatgtatgttcttggtgcctttgttaaaaaccagctgattgtaaatacatggatttatatctaggttatctattttgttccattgttctatgtgtctgtttttataccaatatcttgctgttttggtttctatagccttgtgatatattttgaagtcaggtagtgtaatgcttctagctatgttccttttgttcaggattgctttggttatttgggctccatataaatttcttttggttccacataaattttaggattattttttctgtttttgtgaaaaatgactttggtattttcacagagattgcattgaatctgtagattgctttggggagcatgtttattttaacaatattaacttctaaaattcatgagcaccaggtatctttctatttgtatcctcttcaatttatctcactggtgttttgtggttttctttgtaaaggtctttcacctccttggttaaatttattccttggtattcttttggtagctatgtaaatgagattcttgatttccttctcagctagattgttattggtgtatagaaaggctactgacttttatatattgattttgtatcctgaaactttactgaatttatttatcagatctaagagttttttgttggaatctctaggtttttccagatatctgatcatgtcatctgcaaagggggataatttgagttcctctttacaaatttgaatgcccttaatttctttctcttgctggactgcaatggctaggacttccagtactgtggtgaacaggagtggtgaaagcaggtgatatggtttggctgtgttcccacccaaatctcatcttgaattgtagctcccataatccccacatgttgtgggagggacctggtgggaggtaattgaaccatggaggtgagttttcccatgctgttcttgtgacagtaagtttcatgaaatctgatggttttacaaaagacagttcccctgcacaactctcttgcctgctgccatgtaagacacacctttgctcctccttcacctccaccatggtggtgagtcctccccagccatgtggaactgtgagtctattaaacctctttttctttataaattaccaagtctgggtaatttaatatagccccatattagtcttcgtgagaacagactaatacagtgggcatccttgtcttgcttcagtttttagaggaaaggctttcagcttttctccattcagcatgatgttagtggtggatttgtcatttttggcctttattatgttgaggtatgttccttccatgcctagtttgttgagagtttttattatgaagatattttaaatgttatcaaatgctttttctgcattgattgagatgatcatatggtttttgtccttcttcgatgctctaccctttctcctgttctctaatgatgcactacagaaatgatccttggaagtacagtcttttaaggtacattttaaagaccttctgtgttttattgaaaaaaggaaatatgcctttttaattataatgttatacatattcattaaaaggatttagaaaatacagatatgatagagtctgtaacattaaaaagtatgaatgtgtaagtaatcacaccttttcccattcccttccctgtcaaaggaagacaggatctagtgttctgctgagaaaatgtgaggttgcagaactgtaaggacagaaagactgaaataatttttagtcaaaagagcccagagcaattggaagaacagaacagaccccaaagcagagagctggggtcagatggagagaaagaaggacaaaattttgtatgtatccgcctagctgtgcgctgtgaaactgagaagaaatatatatatatatatatgattttaaagatgttttcacaagtgtcatgccatctagtaactcttcccactctcttcaaaagaattccataaaaatgtacattgctttttaatgttttcttttgggttttggattcttttgaatgcaaaactgtattgtgactcatcatgaaatacccagttttatttgggttacaaaaaaagaaaacattaaaaattcataattccatctttagactctactagggtttaaaacatggtaaagatagtatgtatgcatatgtttatttatttttttgagatagggtctcactctgttacccaggctggagagcagtgtcacgatctcggctcactgcaatctccgcctccggactcaggtgattctcccacctcagcctcctgagtagctgggactacaggtgtgtgccactgcacctggctaatttttgtattgtttgtagagatggggttttaccatattgcccaggctggtttcaaacttgtgggctcaagtgatccatctgcctcccttccaaaaggctgggattacaggcatgagccaccctgcaaggccaagaatttttttttttttttttttttttttttttttttttttttttttagaacatggctcactgcagcctcgacctcctgggtttaagcagtcctcccatctcagcctcccaagtagctggaactataggcatgcaccaccacatgggctaattagtgtttttttttttttttttttttttttttgtggagatgggttttcgctttatttcccaggttgctcttgaatttgtgagctcaagagatcctccatccttggccccccaatgtgctggggttacaggtgagagccaccatacctggtccatttattgtcttttattcctctgaggagagcacacacacagaaaatacatcatggtcttttcaagcacgtagagcttgctagccactggcttcttctcttgataatggctctaatgtcataattagcttggcctcttctagaatgttcctttctgataaaggcattttggctgtaggaacttgtgaccaatgctgtaggtgcaatctcagaggacttgagacatcaaaaccttttgtttcctctgtgagagagaattctcttctgtgtagagaattattgatcaaccatctttagtttaaatgattatgtgtagctgctagttctaaataatacatggattcccttctgtaattctctatacatgctttcaccaaaataaataaataaatgatgaaaactatggaagacaaaatcctacattattttgaaacaacaaaggctaaaataggggcaaaacccccttcaagtcctttcaagagggttgaaaggaaacttcctttccttctgtttggacctcaggggagattcttatcgtttctggaatcccatgcctgcttatgtttcccagatgttctttcagataattaatccctcctccaatttattcctcctcttctccctgcacccaacagaaataggttgaaaattcttgcacctttttgataagagagaatggacataaaaagcatctaatgactaaaaatcctcatataaatgttgtagaatcatttcaatttttaatagaagtgtacctgttaaaaaaggactagagaatccaccaaatatcagagtcccttggtcttgcattccttagtttcttactcttttttctttggtgatcactgtacctccttccttaccctttctctcttgtccatttctggagagttgctcttgacttccaggaatttcttggcatttctgaaaacctagttcccctcgtccccttcttatccccatggtgtctgatattacttttaatatcatcttcagttatctctgttgcatgttggttccattaatatgtgctgaatagctcctttttgccaggcatgtctcttggaactgaagattgatgcaaagataaattgagatcatggtccctgcccttgaaggtaggagaaaggaaagccccacattaattcactatgcagaatctgactgagatgtcaacaacccacactgttatacagatatgacggcaggtgggggagctggggaggacacttttgtctgcatgactctaaagatctgcctgtttcccctccactgtgctgtcctccctcagctatggctggaaggctgagaaacaaatccactacagttggggaaaaggaacgaccacattgtgagcatccgctatgtgcctgtcactctggatatatcgtttaaaggatataaagtagccattgaattagtgtctgcactttctacatggagggagggttgagatgttttaattaggtgacccagatgcatatttagaggctgtgagtgagaacacagaggacaggaagcatttatagggtggcggtttagggttaaaaagttcgtatttcaagatacagcaggaggcaaaatggacaaggccaaggaagagtggaagtggaaatactatgtctcagagagcaaggggtatagtatttttcctgagataggattgaagaaggggcaatggataaagagatacattcaaagatggagagaagagcatttggagaatctatccccagcaggtttttaccaaagccagtgggtccaatgatgaaggttacattagatcatttcaagggtttggtgtcataaaacacaagagacaaactgtttctattagtagtagaaatgggaaggagcaaaacagatacacactaagtaggtgggatgccagcagttcagtattacctttataatagttacataaaacaagccaggaaagaaagttagtgaatatgggctctgggtcattatagaattcatttagagaagaagaatttcagttagtagccttcctgaaaagagatgataaagaggccaggattacgcccagggtctaagtaccggctgagtatgaggaaattgactctcctccaactctggggtagaagaaacatgattggatcagagggagagagatgattgagtcattagttaggcaaagcaagagctgacgacaatgataaagcactaatgcatccaagagattttttttccccactctagtggcaattttttacactttaaaaaaagaaagtgaagtcgactgatttgtcttgctgactttagaaagcatttaaaaatcttttaatgacactcgattatgttaaacggtacatttctcctctttaatttctgcttgcctcaagtgtgtccacccacttgtcctagtttccctgattaggcacctggtggcaaccaatgatgtgagttacaggaatgaaaaggcataaaaacctactttaggttttactgaagttccaggaggctgggcgtggaggctcccacctgtaatcccagcaccctgggaggctgaggtgggaggatcgcttgagctcaggagtttgagatcagcctgggcaacatagtgagactgtctctacaagaaataaaaaaattagccggtgtgatggtgcacttgtgtagtcccagctattcgagaagctgaggtggggaggataacttgagcccaggagttcaaggctgcagtgagctatgattcagccactgtactccagcctgggcaaaagagtgagactctgtctctagaaaaaaaggttccaagaatgtcatggggaattttatcacttctattctctggacatttcactgggactaatttctctcataaattggatgggtgttttccttgaacagattctggactaaattgggaagtggtacctaagtgccttctttgcctcttttctgtgactcatttcctgctcttcatgtctctctccaatctggatgtttcatattctcataaaggcttgtgctcagtgcctgtcaacttagaagacacctccgctaatgtggagataatagctagccctctaagagcttagcttctgggattcttacaagggccattcagagacctcactttgattgaactcaaatgaaacaatgtttttttttttttggagacagggtctcactttgtcacctaggctggagcacagtggcacaaatatacctcgctatgatctcgaactcctgggctctagcgatcctcctgcctcatcctcctgtgtggctggaactacaggcatgcatcatcatgtccagctaatttttttctttttatttttatagagacagggtcttgctatgttgaccctggtctcaaactcctggcttcaagtgttcctcctgcctcagcctcccaggtcctgggattataggcacaatccactgtgcctggcctgaaacaaatctttaatggtaaaattttaggtatcataataggttgctggagaagtgttctggattaaggaaactttgggagtcctttgaattctaccctgtgagaagcttcacacacttagaatttctgagctcaccagactctgatgtcctagttgctaggagtttagagtaacatgaagctgacacttggacactgttcttttcctctgttaatcatctatgactaaccaaccacattctgcaggacttaaaagtattctagtagccaaattagctagtagtccttaatgcttttaagcatcagaaagtgaaaaatatcaaagaactattgctgcatttgaggagctagaatgaagtttggtttggcttgaggagaattgatgacacccaggagtatgtgctggtttccatttggttcccattcacaggcaaacggaaagtacatacagcctggggtaggtcaggccagcagatatttaagttgttcagtagtggctgggcctgggaatatggggtgattttgaagaattaagttctgcaaaagattcaagagtacaaagctgtcttcatcttagtcaaatgcaggcaatcaatctgtcctttgcatgtaataaactgggaccttagaagtgaagattaaataatctgggatggaaaattggttggagaaggtccagcctgacctacatgtagacatttctcctgccttgtcttgtctcttgctacaaatcatcctgcaaggattaggtaacagcaacttcaattcacacacctttgaaggatggtgacttcagcattatccacggtgaaattcacagccaacaatcaatacgtattttcaggcaaagaaccattattcatttctgttatcggacaatctcaggcagaaatcatatcttttgtgactggaatgcacagcattttcaactgctttattactgcagctgagaatagggctttgcgctgactggcatttagctgctgaagttttctggactggcatttgcattggggtatccaggacaagtgtgggttttgaagggaagggaacgagggggagaagaaggaaagaaagagccgtctgcaggtaaaggccatttttgttagcttgaagcagcatgatttgttatcattgacactgagtgcaatgttgatttaacttttgcactgggggtattgactttacattgaaaagacagacaccaaccattgtctgacaatgaccaacacaatcagaatttcagacctagcatgatgtagaggaggaaagtctgccagaagacaaaggatcttgtcctggttctttgaagaattagttgtgtgaagctagccaagttgctttacctctttgggcatcagtttttgcatctgtaagaagatgtagaatacttgacttatgttcccttccagctctgagaggctttgactctatgattggggttctgttttactcttcattaacatcataaattcataaaatgagggagattgctaaaaaatataaacacaaatatgccttaatccacttattgaagtgccaactgctggctgatttttattttcaaaatcatctattaagaagggaatatgatgaagccattacttagaagttaactagtttcctacacacttttcagatcgtggtaatgatattcaccaacatttgtatagttctctaaagtgtgcagaagattccacatgcaccgtctcattttcttcttccttaatctataactctcagttttgtagtgcagctgaggagggagatgaaaacactgtttacattttttacatcggtttacattttttttggcaaaaaagttgtgttttgtctgaagaatgggtttattaatccagcagtgttcattgagcctctatgaagtgtcaagacctgtgctatagatgaggagatcaggatagacatggtgctacccttgtggagttcacagtgcagtaacaagaacataatcaacacatgattggataaattagagagtggtgagaattttgttgcttcatggaaactgggttgtccaggagtggtgatagaacaagggtactataaccttcccatggctggaaggaacacagtgctcactcctcctctgcaaatgctgtttggggatgtaagttggccatctcaggtcaattttcaggggttgcatcagcccggcacacgaggccccactgattttggtttgagatgcccttccaatcgaaagcccattttcctgtttcacagaatgaaagcaaatactcttaatggggccgttgggcttcaagtctgtgccaaacaattggctttcccagcactttcataaccacgcagctctggatttttcaggagcccgtgcaagactagtttgttgtataaaacgcatccaagaatttttcctcatagcactgaatggtaacttggtggcactggctttgccccacattgtgctaaaatccatgggttcactctctcttttttttttgagacggagtcttgttctgtcacccaggctggagtgcagtggcatgctctcggctcactgcaacctctgcctccagggttcaagcaattctcctgcctcagcctcctgagtagctgggattacaggcacatgccaccacacccggtttatttttgtatttttagtagagacagggttttaccctgttggccaggatagtcttgaaatcctgacctcaggtgatccgctcaccttggcctcccaaaatgcttggaatataggcatgagtcaccacacccggctgggttcactcttaagagatgaattcatcctgtcgttcattatggccaagtcttcacaataggaggcggggcacagtgactctagggtgtgtgtggataggctgcccagtgttgtgtttacattgaggctcatctgcgattccccgtgcctggcatacagcctagcatacagtaggtgctgattacacgcttgcttatccaaaacactactcaaatgtattgctttttactgttttttcttttgtccattttttttgttaattaccaaaataatttatatttaattttttttatttcaatagatttttggggaacagacatgaataagttttttagtggtgatttctgagatattgatgcacccatcaccccagcaatgtacactgtacccaatgtgtggtcttttatcgctcaccccctcctaccctttcccctgagttcctacagtctattgtatcattcttatgccaaagtaatttatgtttgaggtaaaaaaaattaaccatataaaaatgatttaaaagtgaatggtccttcatccccttccacagaaattaccactgtaaaccatttgatccttttagaccttttcaacacatgcatgcattcattcttctcacttcaaaaatagtatttaaaacacagcttgaaactggttatttttacttatcaacaaaaatctgacttttttcatctcagttatattgatctatctgaatcgtttcacaatgcttcatggcataatgcaacataatttgtgaataagtttttctattgaatgacactagttgtttccaatcctttcccaaaggatcgtttgtcaaaatgctttaatgaatttcttgattgtatacatatattttgataattgtgagagcatttcttcagaatatatttctggaagtaaaattgttagggcaagaattatgcataagaaactctttttgtagacactgataaattgcctattaaatgctgtatgaatttctactttaaaatgtttttggtgttagtgataagaaagtcaacccagtgcagaaaggaaatttaatggaccttgtactgaaaggttcagagtgtagctggtttcaggcttggtttgatacaggctcagaaatgatgtcatctggctccaggttctctctcctggcctctcagctcttattcctctttggtggcttcatctcaaacaagtttccctcatagtcttaaaacatctctggctgggtactgtggctcatgcctctaattccagaactttgggaggctgaggcaggaggattgcctatgcccaggagtttgagactagcctgggcaatatagcgagaccctgtctttgcaaaaaattaacaaaaaatttagccaggcatggtggtatgcacttgtagtcctagcttctcaggaggctgaggcaagaggatcacttgagcccaggaggtcaaggctgcagtgagctgtgattatgccactgcattccagcctgggagacagagtgaaccttgtctcaaaaagcaaacgaacaaacaaacaaaaatcaaaactccccaaaacctccaaaacccaaaccaaaccaaaagcaaaaaacaaaacagctgtggaactctaggcttcatcatttcaggttttagctcagtgaatacaggtttatttcccagaagttccagtcagtgtctcatttgatttgattggtcacgtgttcgtctctgaaccacgtagagtgtccagggccatgaaggcttttgttggcccagcctggagctgggtgtagagtcagctgcaccagaactacatgggctgagagcagggcaggatggctcaccaatgaaagttggtagctatttctggaggcagggtcagtgtgtagagtgtgaagtcaataaaggtggatggagtactgtggagacagattctttcctgtggacttatgagtgtaagttcagttttatcttggtctttgggaaagctgtcactgaggatcaatttggtgatatgacttaatgacattccttacaccgctaactgggacgacaattatgtactgctgaagtgtgtttaagggttatccttagataagattggatttatagctgaaaaagaaacacagtccctttaaaagaaggaacagatgaattaaagaacaaaaacatcttaatggttttgttaagattgctatggaaataactgaatgcaaatttcattttaagtctcttgaagttagcaatctattgagaggagagaagtttgcagcaggatttttttttttttttttagagagagagagagaaggaggaggaggagggagaggaagaagacttaaagttggggcaaaaactcttatggttagggcaaaaagagtttgaggttttttaatctggaagagacctgtaagattgtttaggcctatggttctcaaatttgagtgagaatcacctggaaatgttcttaaaacacagatttctggggtgcatcctagagattcttccttagttggtctgggaaagggtcaaatattaacatttctgataaattccccagtgatcctcatgccaacattgtggtggtgaaactggtcgaattttcccatagaactgatatttacaggtttttttttttttttttttaaacaaatgtagaaattgaccctccggggttttaaaacttgaaattttcgtttgcctcatctgggttgcttcctcaggaaatgagccctcaggcaagagactaaaagtcaccagatcactgcaactggataatgacagccagacccttcatttgtcatgattgcttgtttatcctgccctaattccttcccgcctatagctacattccttctaccagtacagaaaccccccagttttagttggccagggagacagatttgaggctttgtttcctgttctccttggctgctgagccaagtgaaagccttcttctttggtaatagtcattgtctcagtgattggcattctgcgtggtgaacagcaggacctagactgacctttggcattggggtaacagtggctgatgctactggtggaggaaccacaccttgagaagcactgatctaggcaccttccactcctctcagtctatagatgggaaaatggaaactcggagaggtgaggggctggctcgcggtgactctgggagaaagcagaggagctggggctagaatcacctctcctggctgcttccctgccctccccttctcccctcttctctttcctctccctgcccgccccttcccttgcctcctcctctctcccccattttcctcccctcctctctctctttccctttccttccttctgtaaaggaactgacccctggtctggttaatgtcaaggttacagagtagagtcaggaaagaacccaaacctcttgacttccaggttggtgcttaccccacgtctcaagtttcctgctcctggagaagcaagacaccaggagattatggggtttccctctcagtagctggatctttctgaaagtgtttttctttgaaggtgagaacaaagacagcctgcattattaggcaggatgtccctgagacacatgacagagggaggctgtcagcagtaacaaagaggctctctggtttgggaaaaaaaggtgcttgtagttgttgtgggagacgaaaaagcgtttctttgactttcttatatttagtacctgggggccttcaaattaaactaacaaagacagattaacagcaggaaaagaaaagcatacagttttattcgtattttacgtgcatgggagttcacagaaaagaagtgaaactcaaagaagtggttagttaggctccagggctaatatcgcattttaacaaaagaaagggggtttaggcttcagaggatgagacagggtagggaagtgactgaaaaatatatgggagaactaatggaagataaaaccttattttagtggggtctgtttttgcagactcctcttggtgtcaactctctgtctctggtgatgactgcttttgctccccggtattggggtgaagggtgggacactttcacaaagggaaatttacaccctgcttttaggcagacaagaggagggcagagaactcttcctgcatctgttgattctcaattgccttcagctcaaaataatccttatgccaaagtggcacgttttgaagcggcatattctggatctcttcattggatggaggattcacagacttgccaacatcaagggtggtgaaatgtagatgcatgctaaagcagtgtcccagtgtcacagggtgagggaatcagggccatgctcatccagcccaggggaagctaagcttagattaaagggacttatttaagagcctagtaaaattaaatttcaaatgatttttattaaaaaacttaccttaattgtgtattatattttagagtctagtatttactgatgttgcttaatgaataactctattttggcttttagaaaatatctgtgttatccatacctatgtaaaggatagttatttttaccactagataattagtaagtgactattatctaccttatcttatcccaattacaggcaacataactaggaagaaataaatggcttcgggcatgctggacttgcgaacacaaatttatgaagtgacagctagtgtcatgatgctcctgcctcaagatgacctcccaacccagagcccggctgcttgggtgaaacattttcccctccctgaattgtcttgcaaaatgtaaacacacattgtcactccgaaggagttagtttatcagatttcttcccttggtgataggagggatctagggcaggctgagcagggaggtgaggtggaggatgacagaagcacagacagggatgcctggggcttgtgactcacccacaggagtacagcaagtgcatgtgagacgcttctcaggatttatatgttagcttttctccccaattttggaaggcaaggaattgtagtcagcaatcggccaggtgaggggagtatttttggtgcaagggactgtccaagggatactgactgcagtgtcctcccatcttcactgttttcttaaagggactcactccttccctgattttctggtgtcctccaggttcatcagcagttatttggatggtcttctgatgtgcaagcccagcgtggtaggatgtggtagaaagggcgtatcacacactgatgctgcatcagctcagtttaacctcagttctactgccatgtgacccgagggccagttataaaccctcttagagctttggtttccttagatgcaaaaggggacaaatttatatatatgtacacacacatatatacacacatatatatgcacacacatatatatatatataaaaaatatattagtgcagattaagggggtaacatgtaaagtatctggtacaataaaatctaggccattgcagtgtaggtttttggaagctgatgctgagatggagtttgggttgcaagacatttattagggatcagctcctgcgcttagaaacggggggaagcaagaactgggcagagggacaggttgagctgtaatgtgggccccggagagccttggccaacccgaggagccctgcagtgagtattgtccatctgcattgtcccatgaggggctgagatggccagcccttagagccttgcttcactcagtcaccagacctggctccctgagaaggaggtgttctagggtgaggcaactccagctgcagaggcagcccctgagctgctgtcagaggctgcctgctctggccacctcctgcagctgcacagcaagtgcttcctgaaggatggtctgggtggctcattttcatgcctaccacataggcatccaacagacatgtctcctccctgctgccagaactatcctcttttttttttaaccttttctccaccttctttctgttctccatctgtcctcttctcttgcacctgcttcttccatccatcctctccacagtcctgggagcttgtggctcctctgcaggggccctagaagtggtgcgtgcctttgctactctctctgccagtcccactgcagcaggaagcatccgacacatttttgtctcacgcagataatgtacaagttacccatgacttctcttttactttggtagagggaagaaaagaaccaggctttattctgcagaataaaacaacacagatgctggtgaatgcactgtcagcccatgcctgccagctgggaccaacaataggagaggaggcactggctgcatcgctaacagatttccaagaacgctatgggcagccaaaaaagccatttgggcttgtttctttttcctctgttgcctttctgagagataaagaggctgatggatcataaatggagatatgaatttgataacatttggaaagaggttaatggaaaccaacgtacaaactacagaataggagaacacggcagatttctaaatgccaatagcatttagaagctgctcttaaagaaaatttgaaggtgagcaggcggtgggcagaggatctgaagcagctgcaagggcctcacatgagtttggaaatgtcttcctaatgtgatggatcctggcatcattccacgcagacgccaggtaggtgtccctgtccacagctctctgagctcctgggataatttcaaaacagcagagagtgagggcatgtgcatcatttgagcacatcatagagggcaccactgattcgctgcactggaagtttgtttgctctatgtgaaatctcttatgtctggcctagaagcctgcatcaaggaactgggaaacaccaccggctccctctgtgagtggcaaccatgaaatccaccctccagtggcctcttgtggactgtggactaacttccttcaggggtcccaggaagtcctagggaagtggaaactcccttccatatcccacttcaagactcagccattgtgcagaagaggccaatagcaagaccccaatttagttccatgcctgaggagttcagcctaaaatcctgaagttgcacagggttttactgtcttattccattctctcaacaatgctgtttcattcgcgaggacaatggcacttggagagattgagtgacttcctcaggtctcaccaattgtaaggagcagggtaggtcctgaattctggcctcttctggatccacagggttctggtgcatggttatcctggttctgatttttctcaaatcagagaagacaaggggacaaagacatttaatcccacggaacctcatgtcagtctcactaagtaaccagggcttcagaggatgccactagtccttgcttgcaagtagtcaggcattatgctgctgcctgctagactgtgttggccactagccacacttggctactgagcccttgaaatgtggccagtctaaactgagatgtgtgtgtgaacttcaaaggctttaaaaaagaaggtaaggctgggtgcagtggctcacacctgtaatcccaacaatttaggaagccaaggagggaggattgcttgagcccagacatttaagaccaggctgggcaacatagtaggaccctgtctttacattaaaaaaaaaaaagaaaagaaaggaaaaaaggaggtagatacctcattaataattttgtattgactatatgttgaaataatatttttgatatgttgggtgaaatacttacatttaaaaactataatttatatttataataatgtaaaatataataaaaatttattttacctaccttcttaattttaacaattgtgcctactagaaaatataaaatacccatgtggtttgcattacatttctattggattactctagattcatctgcatccctaaatgtctttagtctatttttagcttctgcttcttcactctatatcactgttactggtagcgagcgactgggtaggtcatctgctttagactttgaaatttaagaggcagttcacagaatgacggctatttcacactcaggtgagcatggtcataattgggtgctcataggggacttggcggtttaatgtcaatgaagaagcctcctaggggtgatgcctcattcattcaacaaatatttatgttaacagcttctttatgatggatgattatgctaggttctgggactatgtctgggagcaagaaatagtcacaggcattggggagcttatcatctggcaggggcagtagacattgtgatggttaattttgtgtgtccacttgactggctacagggtgcctaggcatttggtcaaacatttttctgggtgtgtctgtgagggtgattttggatgagattaaaatttgaattgatagactgagcaaagcagactctcctccctaaacgtgtgtggtgcttgtccaattggttgaaggcctgaagacaacaaaaaaactgactaagagggaacttccttggcctgactgcttgagttgcaacatcaatcttctacccttgggctgtgacttacaccattggctctcctggttctcaggcctttggattcagactggaatcactccagcagctctcctaggtctttagcatggcaactgcaaatcttgagatttctcagcctctatagttattgatatgatttggctctgtgtccccatccaaatctcatctcaaatcataatccccacatgtcaagggagggatgtgattagacatgggggcggttcccccatgctgttcttgtgatagtgagtgagttctcatgagatctgatggttttataagtgtctggcatttcccctgctgaaacttctctcttctgccgccatgtgaagaaggtccttgcttccccttccaccatgattgtaagattcctaaggcctcccagccgcgtggaactgtgagtcaattaaacctctttcctttataaattacccagtctcaggtatttccttatcgtggtatgagaacggattaatacagttgtgtaagccagctccttataataaatctctctccctctctctgcctctcatctatgtatgtatgtatctgtcatctatctcctataagttgtttcttttgagaactctgactaacatagacattaaataaacaatttgtatactgaataattatataactactgcttgggggtgtggttgtgttgtgtggtgagggggtgtagaaatgtctaggggttgatcaaccctaacaccttccagatgaccctaggttctggcctttccccaaagagtcctggtctactcagtcatctcccacaatttggccatcttcttgggtcctcaggacaataaatgacccagccagatctctaccctaagtctgacttaggatggaaaaatgtctccttatgcctttatcagtcttgacttcaggtcagggaggccagaaaaatgaaatctgctctattttgaaagtttccttcatttcctttttatgatttaaatttatttttataaagtgaattgatgaaaacaaacacctttaacacctctacccctcggtattctacagatttcctgtagttttgacagtgaaacaaaaaacgtcataattcttcacatacttcaatactattcttgcagttctagtcttgcattactggtggagagtctgggggttggagatgggggttacattgtaagggaaagcacatagtttggatgtggtgagagtataatgagattagcgtgcatgtccagctgtctatccactgtctatctaaccatgggtaagttattcaaagttacctcactacagcttccttgtttagccagtggggctcataccacatacctggtgggtttctggaagaattagagataaagtgtagaaagcacctagcaccactctggcatataatggatacccagtaagtggtctctattgatatttttccttgttccttggccctagactggtcaggttgtcagaggaacagaatttgaccacttaattagaacaatgtttcagtaatatatgactgcataacatacaattccaaacttcggatcgtaacatattattatgcacataaatcctatgggtcagaaatttgggcagtgcatgcaggggtgactgtctgtgctccaccatgtctgggttctcagtaggaaggcttgaatggttgaggcctggaatcatctagaggcttcttcacatacatctagctgggatgactcaaaggctgggatcagttgggaccactgaacaaagcacctgtacccagcctcaccacatggcttgggaatcttacaacagtgcaactgagctgtgagagggggagtcttgaaaaggggtgtctgaaagtgagcattctaaaggagcaaggcagaggttgcaaggtttctttgatcttgccttggaagccacacagtgtcatgtattctgcttctcttgtgacaggtgaattaccaaagttagcgtagattcaagctgagagcaactagattctagcagcaaggccacattgcagaagagcatgtaggatggaagatattattaagggcatctttgaaaaatggcatcagctacaaagaacaacctacattagactcctttagacttgtttgttgggcttctcaaaaggaaacagtggagcccaggagtttgagatcagcctgagcagcatagtgagacccccatctcaattatatataaaaaaaggaacagggcactgtgcagttcccttctcaaagggaacaatcacattgcttatgtcaatgtatcttcagagaacaagtttcagcaacattgttgaaatttgcctgaggtaacactgtaagttgatagtgaattagaccctgaaatttcagatattgactatattcaaaattacagtgtatttttaaaaaaataacagctttattgagttataatttgtataccatgtaattttttcatttaaagtgtacatttcagtggttttaatatattcacagagatgtgcaaccttcatcacaagcaattttagaacattgtcattacctcacctagaaatgaaatatctagtgtaacaaacagctgtgtttcagccaatcacaagcaactaataggattcagccaatctcagcagccaactcatcacaccatgtccaaataaggcagatgcctacctgtagccaatcaggtgatttctctgctttgcttgcctgttcagcctttaaaatctctctgcccacactactgggcagggctctctgaacctcttctggtttggagtgctgcccaattcatgaatggttctttgctcaaataaactgttaatttgtctaaaagttttttgctaacagcaatactggaagaattgtactcactgcaaaaatgtctagcatatgttttgtttagcttctaaaaataagattgacattttatttcaacttatcaacaaatacaactccaaaacacaaataccctaatcattttctagtagctgttctccaaggacagaggtgagcttttaatgaaactgatttaattcttcacaacatccctgggggtggtatgggagaagccttaaaaaaagtcaggttttattgaaaacactacctggaaaaatagaattgagatacactaatagtcctctcaacaccaaaaaatcctagatgtgggagatcttgcttagtcaaccctaacttggaacaagagtttgcatttgatcacatccagtgatgacatataattttatccttctccaagctcttttcaaggatcattgtatctgatcctcaaaacattcctggaggcccactttactgtgatattacagatgaggaaacaacccaaaggagctgacatatttaagacccaaagtgactttgacccaaagcctgccacccacaccattccagaccccaaagactagtctgctttttattttcacacttattggagactttctttcatttgcccatggtagtgtttctctttctagaagcttctttattgttttaagatgaaaaaattcatgaccaatttccagaacctcaaaacacaaagcaactgcttattttcctgagctgctgcgtgagtcagtgattcccagtgttgctgtgcctgaaaacccaccactaatgtcagcgccttgtgctgttgagttgcacgcggcgcccctgcagtccagggctggggctagcccggcgagcgcgcggcaggcagagcattcccggacgagtccggtagatggtagcattgtgcagccgatgcgtcctctcccagcttgcgtctcatttttccctctccccctttcctgggctcagcggtgaggctcaggtaccggcgccgccctgatgcctactatgccgcgccatctccagatggtccgcacctggcgggtcacgacgagtctcaatccacagcatggggctgactcggactcaggagtttttgtggctccaggcgtaaccgttgctttggataaaattggtccagttcacttgaccaaggagaagtgcagaggaggataaacgtccccatcccagtggtgtcctctcccgactcctttcgtgtagtgagctttatttttagagactcccgcgcctgccagccgctcatgctcgggttccccaagcggaggggctccgcgtgcagtgtgatgcccactgtcgccggcagagggcaccgtcgtcacacactgcgcaggagccggcgcgggaaggcggcggggctgtccttcccggtcagcgtcctacgcgtgaccttgggacccgcaaatgtctgcgccggaggcattgcctcttcccgactatgggggatactgcacggggctcccgatggcctcttccacgcctggcccttcacttcttgaagctcacccttttcttatttgatctttctagaactggcgctctctcccttcaaattctgtcccaccttggctaggttctggttctgagacttctgtctccctggctgttactttccgtttttcaggaattttcttcctttgccaatcctttaaacgtccctgatcccaggattatttgttcttctaagactcactctgcgcaccctcgcaaacccaccgccaccctcttcactgccttgtcttgacgacaaccacattttaatctccagtctaagtttatcttttgagctacagacccatttcttcattttgccaggccaatagggactgcttggaaataatgcttagaaagcagccagtctaagagctgctatttcattgaggatggtagtcaaggttgtcttctgtctagaaatgctttgaataacaagtgctttgctttcagccagctggtgtttctctctgaagccttcttcaaggtaaaaaaaaaaaaaaagaaagtttttagtgcttacctagagatgcagtcaccaaacttaaccttcccccccattcccctcttctgctgaggaaaccatgccaggccacaggaccaaaacctcctttgctagctccctctgtttagacctggacaggatacctaccttaaggcgacaaaaatgcgtgggaatgggccaatcagagtcttttgagattttgggactggaatgttgaaaagaatggtctggtgaaaatatggagagctctgtagcttctctgtagcgaagaatctgtagacaaaggggtgtgtaaaagatgagttgcctgagggagcaggctgaggtaggaggaggacagagcagacagaggtagtggagagggccagagtgccccagaaagctctgtttcgttcctcaagaaactcaacagtctcttaattttggaaggtttttctttttaaactttttaaattattattattattttttttttttagagacagccttgctatgttgtccaggctggtctcgaactcctgacttcaagtgatccttccacctcggcctcccaaagcactgggattgcaggtgtgaaccactgtgcttggcctatgaaggtttttctatattctgtccatagccccttcatcttgagccagtgcagaactgtagctaattcatgaagaagcagaggacatgaaaaggaaggaaagggaagacgggctgctgacagaatcagcaaggtttagcaggcagctccactgggctggcagagttgggaggttagtggctgttgtggtggtcggggaagcagagaggttaaattccacattcccatgaacttaccactccccttcctgaaaatccccacatcccacctattgctggatcttagcaggttggtcagccatgactccaaaagtcaaatgcatttgcaagtgtcactagacttgtggagtgggataataccaaaagacaaaccctgtcaagtatttatggaatgcttattttataagcatttaaggaaagggctgaggtgagaaataaaactgagtaagataagatgcctaccttcaaggagatcctcagggaacacaggcacttgaacatagcacgggcactaacatagaattaagttcaaaatgccacatgaatacatacaggagaagggaaaattaactccgcctttgatgagggtgggaaggagccagggagaacttcaaaaggggaggtgacttttgagctggaccttgaaggatgagtaggagtttgtcagacagagaagagagatttgcattctagggaaagagagcaaagtgtcaaaagaatacaagtgcatggtgtataggaagacttttagtactgtggagtatctttgttgtatgcatatggggttggggttggggttgggggtgtcagtggcagcagatgacagggaaaaaggaggcaagggccagaatgtgaaggaccttgaatgtcaagattaggagcttggacttgatcctgaggacactgtgaagccacagaagcttttaatcagggagtcttatattagctgcctttggaaggacaaccgcagactgaatagaggatgcctggaaagaggagagagcagaggaggtcagtcacatcgcctgaactcagctgcagctgataaactttctagcaatatcctggggcttagagaagaacaggcaggctgtacattttaactgattgaagcattgtcctcaaggagggctgatgaatccgtgcatgctcaccattagcacggagggtcatggttctactactgagccacagggtgctgcattcattcattaattcatccagcaaacattcattaaatgtctccaagggcccagtttagtctgtcctcttcagcctcagggattggttccaccataccgagggtaccaaatccacaaatgctcaagtcccttacataaaatggcatagaacagttggccatttggtagattcaccaaccaagaatggaaaatatgtacgtacagctggccttcggtgtcactgggtctttatcagcagctggttgaatccatgcatgcaaaaccggtagatacagagggccaactgtacagctttggtgctaaggataacatgggcaggaagtaggcatggcccctgctatcatagagtctgttgttgagggagagagacagctattaatcagatgatttcatgacctagtgcataaatttcccatttggaaggaaaagaatatagttcggtgaaagtgtataacaaagaactccccctggcctcagctttggctaagatgcagagcactactgggaatttaccaggtgagagcagggggttgcaggagaaggagcagaatgtgcaaaggccccgtggcctgaaagaacatggtatggttgaggaactggaagactgtgtgatagggcatcaaaagaagactgagatgagctagtgagagagacaggagccaagccattggatcttttcctgtccaggtcaagctttagataaagtatttgtttagaagaataggtcagttaaatctgaatgatgcaaagctgagaggacaagtggaacatttgaattgcagaatcaagatttaagacaatcttgcaggtctaaattaaaagtgatggaattaaacaaatgtaaagttctacatttatgttaaaagttttaattgacttgcaaagctttgtgtataaggatgcttatcactgcatatttatagcagtgaaaacatgggaaagaagaaatatgcaactgtaggaaaatgattaaatatgcgatgtgttaaaaaaaaatgagaacattagcactgaaggttacttgggttcaaatgctagcttcttttactagccgtaggtcattggacaagttacgtaaactttttgtgcctcagttttcttatctagcatatggggttaataatactgcctcacatagtagatactaaataaccgctacatcagttttagctattgtcattacctagtagtattatgtttacaaatatgtttaatgtcattagaaaatgcttgatagataatattaagtggggaaaaacatatagcattatgcagtttaataccattttgttgcaaattgtgtgtatttgtatttttgtgttgcttatgtcttttgcttcaacttggggtgtaagaaatgatcacatgtggccaggcgcggcagctcacgcctgtaaccccagcactttgggagagcgaggcaggtggatcatgaggtcaagagatggaggccattcttgccaacatggtgaaacgctgtctctactaaagatacaaaaaattagctgggaatggtggcatgcacctgtagtcccagctactcgggaggctgaggcagaaaaatcacttgaacctggcaggcggagcttgcagtgagccgagattgcgccactgcactccagcctggtgacagagtgagacgccgtctcaaaaaaaaaaaaaaaaaaaatgaaatggtcacatgtctccactgaactgagtcattgatctcctcttcccagcaccatgagaaccatcccctgaccagctgtgacagcgcagacaggaatggcccaaggctgggtagccaacagctttcaccagtctgcaggatggtagcatgcatagatttatcagcattaacatgctcgtttctctttcccagtgttttcctttctgtgatacatttaaggttccacagtcccagtttattcaggctaaaggatcagtgatactcccaaatcccttgtagagacagcactggaaaatatgatgggtccaccgtgggctgcatttgctgttccctaacaccagtgcctgctaaaagcagctgtccacacagccttgagctatcactgtctgtgctgtcacagctggtcaggggatagttcctacggagctgggaagagacctcttctcactgtcttatgccagcacggctctgggttctcaatgtttcagcctcttagtttgtcctcatatatacgattctcaaaccatgcccatggggctgcagtggctgctgcggtagaaggttccagccttggcaatgtgctatacctacaacacctccccactaacaccaacaatttagtaatccaggctcctgcagaggacccactgagcttatcagagatgtttggaaacgagtgaacctaaggagaagtagttgggagtcttgatttgttttctcctaggaggcttctagcccccctctcaaatgggctcaactatttagtacttcccagtgacatttggccttggtatcctggggaacaaatggggagctgagaaaaaacattgcctgtgactaacattcctgcctttggtcgatgagcgcctctgccttaaatttgcaaagctaaaagaaactgcctgggtgattgtttccagaacaaaaaaatgtgtcccaggatgacttgttagacatggaagtggctggcaacttttaacttgcagattttcttgctaaaagtttaaaattctgtctcattggggatactgctacatattcatgaaaaagaaattgactattaagaactacaccacaatattagccatgcctacctttgagtggtgggattccaatggactgttttattttttattttgttttgttgttcagatttctgacaacaaatatgtattactttcacaattagaactatagatcctgccaataagtttacttagatccgtcctatttgtttcaaatgacaaccccatccctggcaggcagatttggctctcccttggtaccagtgagaggccactgggtctgtaatacaggagttctgtatagccacagagaaggaggtttgcagttaacctccattctgggctctaactctctctgagttctaagtcctccaacaaggctgccattcacagccaccccttcccaaaggctgccattgggaagtgtgtgtagggtccccaagtccaccctcaggtttgatgattcactagaaggagtcagagaacgcagaaaagctgttatactcccagttatggtttatagagcaaaagatacagattaaaatcaacaaagaaaaaagatatacagagtagagtcaaggagaaattagacagaagcttccagatgttgtcacccagtggggtcacatggataccacttaatccccccagcactgatgtgtggcaacatgcataaagtattgccaatttgagtcttggtgttcagggtttctatgaggggtaagtgacataggaaaagaacacttatgtggctgaccttagctgctgaggctgcagcttccccagaggtcaaactgatggagcatggtcgggtgaatcaaaccaaggatttgccacacatcaccttgttagcataaactatctgttgtggcttagggatccaggtatacaaagacacgctttttttcagacaggatattccaaagtctgacaggttatccccgaggagctggtcaagggccagttcctttttttggaatgtgcagagtttgggcactccaagcctccagtgttaatccttttctgcaccacaggtcaggtcttacaagcataggccttgcccttctgtctgtatctttttttttttttttgagatggagtctcgctgtgtcgctcaggctggagtgcagtggtgtgaactcagctcactgcaacctccgcctcccaggttcaagtgattctgatgtctcagactcccaagtagctgggatgacaggcttgcaccaccacacccagttaatttttgtatttttagtagagacggggtttcatcatgttggccaggctggtcttgaacttctgatctcagtgatctgcccgcttctgcctcccaaagtgctgggattacaggcctgagccaccatgcccagcctgtctatatcctttgcatacttacagttttcctgtttttcatccttttctacatcatggggtctgagccaggtaagcaaagactagctttattctcctcgtggttttatacacttgtggagccggggggctggaactccattactattgttaggctgtttgtccccatccaaatctcatctccagttgtaatccccataatccacatgtgtcaagggtgggacctggtgggaggtgattggatcatgggggtggttttccctatgctgttctcgtgatagtgagtgagttctcccgagatctgatggttttgtaagtgtttgacagttcctcctatgcacgatgctctttcacccgctcccggggaagatgtgcctgcttccccttccaccatgattgtaagtttcccaaggcctccccagccatgcagaactgtgagttaattaaacctgttttctggataaattacccatgagaatggactaatacatctatgtagaaacttggattagcttgacattctcatagtcaatattttgtacttctgaggctgtgttcctgctccactctccctatgaggtcttcctgagaccccttgatgatgggctgcattggctgtatggctgctcagattagggtttggagcatggatggcctatcctggggtcacagacctgtacctcacctggcctgggaccagcctctctctcctggcataccttgggatgaatgccactaccttgcaaagtactttactcccctgctgggtacaaagccttaacacctgtgaagacgaaagaagtctggggattttggttgaccatgagtacaaatgaaaaaaacagggaggtagtcattaagaaactattagacggtatgatctactggaagagtgacagctttagtgtcaagacagctgaatttgaatccctgcttagctattttccagctctgtgaccttgagcaagttattttctctgtaaatttcaatattttcatctatatcatgggaatattaaaatgggccatggttaggattagaaataatgtatacaaagtggctagtccagtgtctagcatgcagtcggttgtaataaataatggttattgctaatattatttggctgtatcaacagagtagctgtttctagatcaaataaggtagttgacacacttcttagcttcatctggggaaacatattcaatttgggaccctccactttgtgtgtgtgtgtttgtgtgtgtgtgtgtgcgcacacatgcatgattaaacatttagatatttccaaggatggtggtcggaaaagcagagaatctgaaaaacatgtcgtatgagggaaatgggaatgtttatcttggcaaagagaaagttgagattgaattgcttttaactgtttgttgggtcaccctgtagaagtggaaatagacacatgggttatagctctgaaggacgtaattagactcagtggggaaactgggaggccagatcctgccagaaacaattctagccatctaacaattagagctgtccagcagtagattaggctgcctctgaattgtcctgttcctggaattatcagaagatgtgagactagtgggagcactgggaaggttttggctttggatgggagcctggatgagaatgaactccaaggctcctttgtctgtagtggccatcttgctcgtttttcttgttaagttcctgtaggaggcaccagtcataaaaaccccttgatattaaataccattatagctctccctctccctctccctctccctctccctctccctgtccgtctccccacggtctccctctccctctcttgccacggtctccctctgatgctgagccgaagctgtcctgtactgctgccatctcggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagccttggcctcccgaggtgccgggatggcagacggagttgcgttcactcagtgctcaatggtgcccaggctggagtgcagtggcgtgatctcggctcgctacaacctccacctcccagctgcctgccttggccccccaaagtgccgagattgcagcctctgcccggccgccaccccgtctgggaagtgaggagcgtctctgcctggccgcccatcgtctgggatgtgaggagcgtctctgcctggctgcccagtctggaaagtgaggagcgtctctgcccggccgcccagtctggaaagtgaggagcgtctctgcccggccgccatcccatctaggaagtgaggagcgtctctgcccggccgcccatcgtctgagatgtggggagcgcctctgccctgccgccccgtctgagaagtgaggagaccctctgcctggcaaccaccccgtttgagaagtgagaagcccctccgcccggcagccacaccgtctaagaagtgaggagcccctccgcccggcagccaccccgtctgggaagtgaggagcgtctctgcccggcagccaccccgtccgggagggaggtgggcgtcagccccccgcctggccagcagccccgtccgggagggaggtggggaggtcagccccccacccggccagccaccccgtccgggagggaggtggggggggtcagacccccgcctggccagccgccccatccgggaggtgaggggcgcctctgcccggccgcccctactgggaagtgaggagcccctctgcccggccaccaccccgtctgggaggtgtactcaacagctcattgagaacaggccatgatgacaatggcagctttgtggaatagaaaggggggaaaggtggggaaaagattgagaaatcggatggttgccgtgtctgtgtagaaagaggtagacatgggagacttttcattttgttctgtactaagaaaaattcttctgccttgggatcctgttgatctgtgaccttacccccacccctgtgctctctgaaacatgtgctgtgtccactcagggttgaatggattaagggtggtgcaagatgtgctttgttaaacagatgcttgaaggcagcatgctcgttaagagtcatcgccactccctaatctcaagtacccagggacacaaacactgcggaaggccgcagggtcctctgcctaggaaaaccagagacctttgtttacttgtttatctgctgaccttccctccactattgtcctgtgaccctgccaaatccccctctgcgagaaacacccaagaatgatcaataaaaaaaaaaaaaaaaatacgattataacttccaaggagctgcaaacacccatggaatgtaaaacacgaaggtctcttatcctatacctagctttctccctagaatgaaattttaacttggtttgggagagagagagtcccagccagcatttctctttagaatgattaaagtcttgggatccatctggactcattcattttaactattccatttcccaagaatatcatctcattactttttcaatgacccaatattttcagcacaagtgaatgagtccagaaagtcatttcagccatcgattatttttggtaaccttctgatctgctctgaatcccttttcttttaatttccatttatgtcctcgtgtctcgtcatctgttctaagctgaaaatagtaacttggcttgaccttattatctaccatttaagattttatagtctttggttaaatctcatcttaataagtgttcctaggctatagattgtggtttttcctttactttttttttttttaaaggctgttctttgtcactcctatctatgatgacaggaccaacattatggcccttctctgagtatgccagaatctcacttcatctttttgataagaaccatcctcaacatcagcttagtaagttatacctatttgcttagaaacaaagaacacctcctctttagccttgacctgtgtcccaattctgtttctgaatatacctaaaatcctacttacatgggatttaaaatgccactgggtagggcaacgtaccaagtggtattagttaaatcttaatgtggctgagtttgtcagcttcttagaaataagttttgacaactgagaagagattgggcaatagaactctggatttttttttttttgctagactataactgtaactataactataaaactatatatatacatatacatatttgagacagggtcttgctctgtcacccaagctggagtgcagtggtgcaatcatggttcattgcagccttgacctcctgggctcaagtgatcctccctgcctcatcctcctgagtggctgggactataggtgcatgtcaccatgctaggctaatttcaaaattttttgtagagactgagtcacattaagttgccgaggctgaccttgaactcctgggctcaagtgttctgctcaccttggcctcccacattgttgggattacaggcatgagccactgcgcctgaccaaagaatgtcttttaaagcaaatatttattgaatgcatagatgtgattggcagtataacattgaaaaaatcatgaagaagacacagtagtggacctcaaggacctgctatgcaggagtgtgggggtttgggttaagacctgagaaaacatggaaaggagagtttcagatcattagtgacaaacttcagattttgagagcaggatctgggtggcctaaagtagttttcatactcagaagtggagagaaaggagacagaaggtggtagaaaagagtaattttcttttggctccctggcgtgcttttttttcatggatgaatcagagtttctttagattttcaattatctttctagtgtgtcctgcctagctgggcattactcaaaacccatccagtcctctgaggcttgaagggacttctgatgcatgtccttagggcctgtctttgttggtaaatccaatttgagaggaggcagcaaatcaacaggaaaggaaaatatttccctttcttaatggtaaagccctcctctttgttctttgtgccacaaagtcttttttatgttccaggacccagctcaccttccacgtccactatggaatcttttctgatcacccagctggactcgagctttgggtggctgcagtgctgtctgctgtcaccctgagtgcctgagcactcctatggtgcttaccagtccctggttggcattacaggttttcctttcctgtgtaggacaggaggctggccatagtcatatcaccatcatcaacctcaaatagtcagagaagggcgaccaggtcaaggtgctgaggatgaagtccagtactatgccctgccttcagtccagggcttacaatctgggctggtctttctcaaacgggtttgctggtgttacttgaggtctatgaattctgtgagaactttaaaaaattgtgtttatctgtcaataataataaaacattttatcagttataaatacagaaattatttttttataatgataatttgctatggagaggcattttcttatttatttatttatttatgtaactttaattttaatttttttgagacagggttttgctctgtcacccagactggagtgcagcggtgtgatctctgctcacttcagccttaatcttccaggctcaagcgatcctcccacctcagcctccccagtggctgggaatacaggcgcacaccaccatgcccagctagtttttgtaatttttgtagagatggggttcttccatgttgcctagtggtgaatttacttttttttttatgaccatattattcaggggttttacagacaatttctggtaccgaaagactattatttctccagaagaggttcttatattactcaaatatgagagacattggtttagtcaatttcattctgtcattaacaaattcattcattcatcaataaacatttatggtacgcctatttattagatgccaggccgtttgtcaggcacatgagcaagtggtcaggacctgttctgggctccagaatcctcactgctcttcctgacttaccaggtagcccctaccgcagagttcaggctatcgacttctctatgcctcactttctccaccactaataaaagggtaagagagtatatctatttttgtcttttggaggggtagaaaaacatatcctaggatttatttagttatttattttaattaaaaatttttttaatattgccctgagaaagcagataccttaggatttaaaaaccaaacaaaacccaatcgaagtattacttgtttccaaatttggtgtttttgagtcagagacaagcgctaaattcacatttctttccacctcccactaacctcagtgggagggatccaggacccatggaaggtctcaatcagctctaacagaaatgggtcctacaccgtagagcagatttttcacaagagctgtttttagatttgtttatgccgccaccgacctccaatttcacatttcagaaactcccgtggggctgaggagttactccctgggaatcttctctgcttagcaggagctcaagagcagagtgctgatgggtctcatgtttaaagaacaatctgtcacaaagctaaggggcttattactcatcctaacactgagcactaaataaacactggagtagatagagacataacctgggacctttgagcatagagctgatatgaatagtcattaaagtagcacattggcaaacccactacccactggggccattcttgttggaaaagtctgatcatctggcatccagttgcaatgcaatcagtaagaaccattccatggtgcttaaacatgtcagagtaaatctctaacagggccactaccaccccggaagagtaagtgggatgcactttgctttaaagggataccttcctttctcaatatgctcacagacagacggggagccaggatcacgcaatccagttgggcagatttttttctgattctgagcgtcgcatttagcagggcaagtttttgttcccaaagcttcaaggtctggagccagacctccactggtacatgaatcacactgtgtttgggcatcctagaagacatagggtgggcctaccagtgggccagcttatttaccagggcgtgcttgctctctgtggagcaagaactactagggcttttatggggacatgctgccttcattcatccagcaaaaattattgagtgtctactttgtgccagacaccacactagatatcagagacacagagagagataaggcccagttcctactttttaggtgcttataatccaggtggagacacagacaaataacaacacagagcagtaagagtgatgacaagggaaatggagtccttttcttcttgccagtcttggagggttagaaaagccttgttggaaggtggatgttcaaactgagacccagagaatgtacgagttaataggtaaaggcaagaggatggcaaactgtacaagtcccaaggcgtgggacagcatgtagatctgaaactgcacatatttcaagattggctgctcagagagtgcaagatgatatgttgacaaatgagacagaagaggtaaacttccttgataacattgccccttacttatttttctctgcactccttccccaaagcaggtatggcaggtacatctgtgtgtgcatatgtgtgtgtgtgtttgcattaaaaaacaacaactccagcaaacgtttcaattcaaatatttagtttgcttggctgaaaactatttagaaggtaaagtgtttgctccaggtcgggttggggaaaatatcacatgtgaggctagttatcacaggggctgtgacctggtccttgccaagcttccaaatgttcggaagaagttttagtctttaagaaagcaagctaccagggactctcagtatagaaacagaaaggactgtgccagagggatgctaggaaaaaccctcacagtttgcctcatatgaatgtaagacctctgaatgaatagttgtgtatcctatgggacctacagaaacagaaattgtggtcctgtgaataagatggtgacttctatgtgacaacacagcttgttaaatcaagctggcagatgtaattaacaataagcacagtataaagtcttagcatggcagtttacatagtcatagaatgttgcaatagttaacatattggttagatattacaataaagtaacagtggatttaataaaataagaggattatttcttctctcatagaagtctgagctggtaggtggtccaaaggtggtaggtggtaggcagctctgctttatgagtttgtacaggacccagataccttctatcttgttcaactaccatctagggttgaagatgactcactaccaccatgtccaacctccaatttgaaggaaaatggaaaggggaaagttgaaccaacagtacctttatgaaggcatggcctgaaaatggaagattatcacttctctttgcatcacactggcaggtaattggttgcttggccacatgtagctgcaataaaggctgggaactgcagtctctagttgagcggggtatgtttagctagagtttggggtgttattgccaaggggaagaagagaagaatggatagtggtgaacaattagtcaactgtcatagatgtttatctctatcatttgatcctctcaacaaccttgttagaaagcaggcacagattatttaccatcctcatttttgcagatgagaaaattgaggtggaagattaagggactccatcaatatcatacaacgaagccacatggcatagtgggacaactgcaaaaacttggtcaggaggtgccctggttgggcacagtattaaccactgagttttctgaaatgtattcctcagcctgggaacagaatttcccagtgcttgcagcttctttcaagaaaaagcttcccggtaatcacgggttagaggtcggaggagcacaaattcaagggcattttgaacatggccccacatggatgtgatctggctaacccatctttttttttaaattatttattattattattatactttaagttctaaggtacatgtgcacaacgtgcaggttcgttacatatgtatacatgtgccatgttggtgtgctgcacccgttaactcgtcatttacattaggtatatctcctaatgctatccctcccccttccccccaccccatgacaggccccagtgtgtgatgttccccaccctgtgtccacgtgttctcattgttcaattcccacctatgagtgagaatatgcagtgtttcgctttctgtccttgcgatagtttgcccagaatgatggtttccagcttcatccatgtccctacaaaggacatgaacgcatccctttttatggctgcatagtattccatggtgtatatgtgccacattttcttaatccagtctatcattgttggacatttgggttggttccaagtctttgctattgtgaatagtgccgcaataaacatacgtttacatgtgtctttatagcagcatgatttataatcctttggatatatacccagtaatgggatggctgggtcaaatggtatttctagttctagatccttgaggaatcgccacactgacttccacaatggttgaactagtttacagtcccgccaacagtgtaaaagcattcctatttctccatgtcttctccagcacctgttgtttcctgactttttaaagattgccattctaactggtgtgagatggtatttcattgtgcttttgatttgcatttctctgatggcctgtgatagtgagcattttttcatgtgtctgttggctgcataaatgtcttcttttgagaagtgtctgttcatatcctttgcccactttttgatggggttgtttgattttttcttgtaaatttgtgtaagttctttgtagattctgggtattagccttttgtcagatgggtaggttgtaaaaattttctcccattctgtagtggctaacccatctttgcctcttccagtccaagcacagacaatgagcagagaggaggacaatgtgggttaatggaaagaacactggattggggtcaggagaccccaagaacattgaattggagtcatttttagctcacatcaattgcatgcctgtgaagtgacagctactgagcttgacactggcatgtcttctcatttaatctcagaacaacactgtgaggtagatgttactatgtatatcttacagaagacaaaactgaggcccaaagagctgagtggcccaaagttatatagcttgtgagaggtagggctggaattctaacctagaccttctgactgctaaccccaagcccttctacaaaatcatactgttctttacgccaagtaactgctgggcaagctggaactgaaatgggatatgtcaccagtcacacggatgacccgtaacacgtctacctggggcccaggtacttaggttgtgtactttgtgagtctgctttttgtgtgtgaaggaaacccgtatatcagaggttggatcccctaaattggccttacccacacattctgcttgatctaccttctctgggctatgcttttttctttgttaattttcttctcttttcaaaattgctgaaggaatgtatgttcataaaattcaaataatgtagaaaagtcagagatcaattaggatgcttccctaacctctctaactccttttccagtccctttccagaggagaccactttcagcagtctggggagcacctttggatgtttcttgtctaagcatttatttttgtcaagatttttaaaaagtaaaaatgggaatgtgtgtgctgttttgcagttcactttttccacttcacaataccttgggtttatctttctataccagtatattaaaactgatctcattattgctggtggacatgtgttgcactagacacacacctgacttcaggtcctgctccgtttggtattttatgatgtgtggttaatggtgtggagtttagatccattcaacctccgtcctgaatcctggatccatcacttattagctgcgtgatcctgggaaactgacttaatggctccatgcctcagtttcttcgcctgtaaagtggggttaatatcggtaacctacctcataggatgctaggaggactgagttaacgcatgtaacacatttacaacagagcctgcaacatatgctatatgagtgctagatgaggtttagctattcttttcacacctgaatactatttcataatatatttagtctattacttgacatataagttgtttgtgattcttttttttttttttttttgctaaaacaaacactgttgtgatcagtatacgtttacatatccctttgtgcacatgtggaagtgtttctgtagaataaatttcttggaatagcattagtgggcctgagggtgtggggattttcagtggtaacatcagttggtgggctctgcttgaccatgcttttcttggttcactcatatcagctcacccagtagcagctgttgggcatcctgccagtgtccttccgtcacatgtccagtggttggcagagctatgtggcagtaagcattcctctttgtcttcccagggcctggccctttgtcagcgttcattagactggatggcttggcttcctggtgatcctgatggagattctgaattgctactttatgtaaagcatggtgcccgggggagacatgcccagggccaagaaccttgatcagacccacatgcccagcgtaaggctgaggatgagattgtacaagtggtcaagagaatcaacatggtttcacccttgaatcagtccaggttcactaggggttccatgacatggcactttttaacttggcgatcatgtctttgctcagtgatatggggtaggtgtggatgtgatgattcacacgatgcagggatcgagtgcacctcccaaaaaacaggaagtgaaataaagcggcactgtgtattgctgctatgacatttctcttgatcttattaacacaggaggggctaagcaataaatgtgataatctcacttggggaatttggggttggttgtttatccaatccttgaacatttattgaacagttattttgtgtcagacacggttattgatgttggggtatggaactatggactaaggcataatttcaacctttgaaaactccacagaagctttaagaacccttgaggagacttaatttttcaagaacaatgggaatgaagatataatactgcaggtggggcctgagctccaccctggatgaggctgggggatgggtatgcatgggattattggggtcccttcacacagaaatgctcactggagaggctttcctgtacaaatattagaaatgtaaaattacatgttaatttctttttctgtgcttagaaaaggtgcaggatatataatttagaaaaatgtaaaggaaagttaaagatcacctataactgtctcatcccaatgcaaccattgtggaatgtacgtgtatttatttctttatcatgtttgtatgtaggtgcattttaaaagcaaaattaggaatcatacttcatattctgctttgtgacttgctttgtcactcaaactgcattagaagcatttcacaaatctttgaatattcctttactacatgatatgtaatggattatggtgttctgttatatattatagtcaagttagtcaattaatgatttgaaagggcacactggttaattattgttgtcttttctcctacgcctcctggttttggcttttattattttgtaaagatgcaggagaaatcttgagttctgagtggttatcccatcctttgtgaacactgctgtcaggcacacaaaacaacatgggctgggcatggtggcgggcgcctgcagtcgagaggctgaggcaagagaatctcttgaacctgggaagtggaggttgcagtgagccgagatcgtgccactgcattccagcctgggcgacaagagcaagactccatctcaaaaaacaaacaaacaaacacacacacacacacacacacacacacacacaaacccacaacatgattccagtttctatgctcattttagaatcctgcacctgaccaccacgcaaaaattcctctggataacttcatctgggccttccctccggtggaactggaagattgttttccaaactccactccttttccatttgtgttgtccactcaccgagtgccccttcttctttcatttttagacacctcggctgcagctgactccagaaacatattccctctttaagtctcggctccacaggttgcctcttctcctcatcatttctcgtttctcaccgtgaaaatctttgctttctctctttatggcttcctgagacccgaaaatagaggtaatttaaatttggtaattatgatgacaacaaaacaacttatgttgaaatgcagagtttaaaatgccagagtttcctactgttgagatctctctgccttcattctgtggataccgctgtgggagcttacctgagtctgccccagatcaggaggccaagcatgaggcgatgagaaacagcttctgcacagaggtggtgacttctacctcttgggggatgggggctggtcagccagagctaccacattcaggttcagccccttcagaccttcctaagctccaggtggaatctttgccttcccaccttctggaccctgcacggggagggtctcgggctgtagccacgaggcggcattaggcagctagaatcacagagtggggactgggggatggggtttcttctctgacagtggttaggtgagtcactctctgtgggctgctcatggcagcctcttcctccatccttgaagcgggccttccaaagacttcacctgctccgttataaaaggctttgagttctgcaagaggcagctgtgaatgtattagcatcctgctttctgtatgaacatcctgctttctggcacatggctaggccaccgcttaaacaaccggcgccaattcacagtgaaaaaagatctgctcaaagctggtttcagaaggaggacacgggaggcgtataatatcgagcccgtctcccgacggtgccatctgttctcattaaggcagccacagcgccgaaggaagggcctccaggtgcacacaaggaagcctgctcgccttgttatcctctcagagactttgccttttgttttgtttagttttgtttttgtctggcaggctcaaaaagacactgttctactttccgcagaagaatcactctcacattttaagaaattaagtctctgggaaaaaaaatattgtttgagagggcttgtaatggctccttgaccacatgctgtgcctgccaatttataacagagaaatattacagaagttgggatccaaggttggtgtgcacagccattgcttaaagagggatggatgcttcctggggacaatgatcttcccccgggccccccagcatttattcaatctggagagaattgtctgccaggctcccactcctacatcccaggaagagctgggcacattcatcatcttgtgtattcagaaagtgatgataattcctctgagagccaactgggctggggagggtgtgatcaaacttctgctggcaatcagactgcctttggggaggggagtctccattttgcaggtatgtctctactgccagtctgcagggaagcctacccagtcaacaatatgttaccatgaaaatctccttttgggggtatcttatatcacattatagggaaaggcagaggaaatatcaaaagcatttggccctgaatttaaaatgatctttccgtagatttttatagactttgttttacaagattggtgtaaggcctaaagcatgtcttcaggcctcttacatatcctccttctctctgggggtttccttcctgcctgccctcaacatcccttaccacacacctattctgtttctccccacatgcatggtttgtatattatgtcctgtcagtcaattcctactaaaatgttagctgatgttagggtattctcgtgggaagatatttgcattttaataggtggcttgaatatagaaaagcttcatcctaaagttgcaaaactttaggggaaaaacaggcaattttggatagagtgagggatgaggggatgagaagggggaatgtatgtgaggtcagagacattctcacatctcactgtgcatcatccatagaacttgcctttcttttctctcttttttttctttgtccctgacctcagagtaaatggcacctcacacactcttgtgggccagaaagaaagtctttcataggcagataggaaataagacagcagtttttccaagagtactgaaatgcaacaagtctactggtctgttgagttaaaaaatggtcagtttggttgttcttgttcatctagttcagctgattggttcggtagaagcaatagagtactgtactacagtatagtaaaactgttgcttcacagcagccatccctaaactttttggcaccagggactggtttcatggaagacgtttttttttccacagaaggggcgggagatggttttgggatgaaactgttccacctcagacaagatcatcagctattagcatattagattctcataaggagaacacaaccgaaatcccttgcatgagcaattcacaatagggcttgcacccctatgagaatctaatgcagctgctgatccgacaggaggcggagctcaggtggtaatgctgctcacttcctgctgtggggccctgttcctaactcataccagtttgtggaccaggggctggggacccctgatttacagcactaagttaccagtttccacgtcggtgggattggcggaaacttttcaagctctgtgtgatggagtaacacagggtagaaagagtacccttgtgaaaagcctggctgcatctgcccctttataaaggagacaattgaagctaatttatttttaaaacacaaaatgaaatttggtttgaaatttgaggaggagatacattgatgttgcctctgagaaggagtcaaagaccaataaaaggtggttctttctgttcccaaacccagaagccaataggggccacagaaggagcacagtgccacggtgaccatgctgcagcattgtcagatttagcaagaagaaatacagggtgcccagggaagtttgaatttctgatgaacactgaagactcttttagtatgtatgatttttggaacatatttatagaaaaaaattatttatctgaattcaaactgagtgtcctatatttttgtctggcaatctggtaccatactgcccctttgtaattccttgtatatgttgttaaagaataatttttctgaagggtaaaattataactcttgtatgattataaaatgaacatgtgtcaaagatttttttagttcactgattaatgagcgaatcagtaagatgtcacaactggttagaagaattcagaacacacacacacacacacacacacgcacgcacacacacaatcaggaaaggctgaactgaatttgttaatagttgcaaaactacccaaattcctaggacaataatcaactgcattccactgggcaaaattaatttgcgtttctatggacaagaatcatttgcattactctcagttttctacaacttgcagtagttgtaaaataggccaaagacaatgaacactacagaataaccaggaagggtgtgttagaacatccatgaatcatctttgcctatttcaaagcctttcacaatggaaacatttgacagtgttgtgctctctcctatctcgggcctttgcacctgatggttcctccacttttttagttgtcttgaacttacccttgactgtgggagatcaggatatgccactccaaaatatgcctctttggcatgaggattgttgagctgaccgcaaataaggagaaacacatgcaggaaagcaccctgctctttccctatttgcctcaaatcaggacatacatttatgaagacaaaagacatcccacctcctcttgctccccaggcaaacagagattaaccacttaagacaactttggatccttacatgcctggagagagcaccagaggaacctacattaacaagcttcaccaactagcctttatctgccaattatttgcctttccaaaagttgctgcccctaaggactcaaagttcttttcctttgtgtcacaaatctaaaaacgtactgttccttgttgaagatactatataaattggtattcaaagccacctcttcgaaagtttcttattctctgggtttctcccatgtatgtatgaaatatacgtacatcaaacaaacatctgtttgtttttctctcgttaacctttttttttttgtttgttacaggggactgttctaagaacttataagagttaagaaaaaaaattatcttcaaacatcattacctctggaaagctcttcctgacccacaaactaggttgggttcatgtgctacaagctctcacaggaccatgtttccttcattagggcatttatgtgagtttataattcatcctccttactgaggtttctaagtccttgcatgatctgacccctgcacccatcagcttccctttcaataactgtgctctggtcatacttctctcccttctgttcctcgaccataacaagttcttccctgccttaaggactttgcacctgttgttccctgtgcccggaatattttttctcttggctcttgcaaggcatgtttcttttcatccgtcaggtctcagtttgaatgtcagaaaagcctctcctgattatcttatctaaagatgctcccttctccaccctcactttctattctagtgattcctcagccttagcacagattagaatcacctggcaggcctgataaaacaaaggttgctggggcccatggccagagtttttgattcagcaggtttggaagcagcatgaagttctgtgttttaccaagttctcagttgatgctgatgctgccaggatgggcatcactcttggagaaacactgctctgagtgttttctttcaacacctgacattattttccccctttgctgatttgctttctgtctcccatagagctgaaagttccacacgagcagagatagtgatgctcctattttctgattcatctacggtactaagaacagtgccttatataaaagaagtttaatgattatttgatgaatgaatgaatgaaccattttctatttttttgttttgtattgtaacaaagggtttgcttaccaaattactgttgaactgaggtgccagaaccaagttatagagattggctttcatcactaagatatgtttgtggaagagtagttgtcttaatttaataaaccacaacaatatttgaccagtaacttgaataaagacaagtgcctactgcggcctacactttccattagcacgccttcctgcttagggtcaatgtcattaaccaacagttggttagatgacatcagggctttaggtgctattgacaggtctcaagaagatatgagttttgccaagactggtagctatgatgagcattcagaagacatatatggcaagtggggtgagggaagggcttgtgctttggctttaagcatgcctcatggatgaagcagcttgggtaaaggaagggagagagaggaagcagggagaatccttcctccaagctaggttataggcagtgctctcacatccctggtcttggcaggtcctaactccaggcctcctgatgcccatattctgttccaaagaccacagtccaggctttagggcatagcctcaggctctcctacccactaaccctctaggttctgtttgtttccccccttctactctcttctatgccattcctctaggcttttaccttgccatgtgacaggcttatgtggtaaactaatgggtcctaatgactgccacacacacacacacacacacacacacacacacacacacccctatatataaggccacatgcggtggttcacgcctgtaatcccagcactttgtgaggccgaggcgagtggattgcttgagctcaggagcttgagaccagcctgggcaacatagtgaatccctgtctctacaaaaaagttcaaaaattagccaggcatggcggcgctcacatgtagtcccagctacttgggagtctgaggcaggaggattgcttgagtccaggaggtcgaggctgtagtgagccatgttcatggcctgggtgacaaagtgagaccctgtctcaaaaaaatatttatatatccatatgtatctccttggggtgtgtgtgtgtagtgagacacaatatggcatagtgcctaaaagcatatactctgaagccaatcctatgtttgaatcttttttctgctaaatactgtgtgtccctgagaaagttgcttacccattctgttcttcatattacggggttaacaacagcactaaatcatagggttgttgtagatataaaagcgataataattgtaaagggtttagttcctgtgccttgtagctaccaggataataggcctaatagacagcaccctatggaaacagctttccattttaacaagggactttggtaaacacatgcgctgagtacaacactcttggaagatcagatatttgatggcattcagatgacagcatgtgagcagatgcctattctgtctgggtgttaggggacagagcactaggtgacttggctgctgtctctgatcttaaaaattgctcagaccctggcaattgaggataagacaataatagcaatgttgtattcaggagcgttgctttaaataatccttctccctaatagctttgcccctggcgtgtgacaggtgtttacattattaagtaaaagcatttaaacagcgacctccttggtataagggtgaaggagattaaaatccaagcagtgctccagctatttaaatcaatgagacttgtcagatctgtaacacatgagctacttagagggcgcaggcacctattgttttggagcttcgactaatatctcaatatgctccctccctccaagtctagccaggccctgggatgctcattaaaggctggtctgaccacggcctctttccctgtggaagcagcattaactaactcttggctagatgcgtggcaaatagttatgctattagggaggatcagagcttgagttgattcctgcttagagaaatgaccttgcacggaattccagcggttaagttccttagctaaccagaagcagggaccataaacattgtccccttcttccgctagggggtgctaaaccaggctgcttggctttgcccacagccatcctttcttgagttgtgttttcccagtctttagctatgacattgacaacttcaggtccacctgctgcattgaggaaccaagtttctgaaacttaaatctctctcttttttaaagcttcatgctctcatcatgaacaagaaacctctctcttccttagtaatcaaacttagatccttcatttgtgtcaacggaagggaagtctccacgtaagaagagcagctggaccttaaagatccaactcttattcctcaagatttattgtccccttggaggtctctagctaatttctgcaggtcctacaaggctggcttcagagggagctgattcattattaattctccagttctaagcaggcgaacaaggtgggggacacttgaaccttttaattccttggattcacagctgagccaggctggccacaaaaggaactgcacacaggcagggttacaaggcaaagtttacttttcttcaatttatggcctcatatgtctgcctgtctgactcatggaatgttgccaggtggagggttcctgatgccaagagaccgcttaagcctcatctgtggaagtgctggttcagcagagggtgaagcactttcttcctgggtggtctcaagttctcttttcctggtgattgactttgggaagttcttcctgtcacaggaaagccctacttctatccatagcagcaggtgaggccacagcctttagtctctacatgacttctttgtcaaaatgcaacatcaaagggttcacaaggaaaagagacccatgcaaataatccctggctgctcacagtgtcaggaccagcagcacaagtatcccctgggagcctattagaaatgcagaatctcaggcccccagcccttttgaaacagaatttgcattttaacaagctgcctagatagtttgtgtgcatgctgcagcttgggaaatagtgacagagcagagagacagccttttgtctacactgtctctttccaccacaagaaacaactgcattaaagcttggttcaaggaaaagtcctgtgatgtccctgtcctttggagctgaggaattaacatgggctctgtggggtttttctggaggatggcagaattgttggggatgcttgaacttctgaaaatgtttgaagggagaaggaatgtaacgaaccttctgctcagagcaaagcaatgagaccgcatcatgggttagagaccactgcacaagttgctttgcttatttctataattgtggtcagtacctctgccatctgccatcttcctacagcagtgtgtaggcctctaggaggctttagcaagatcagcacccaggtggaggcctcttagaagaaaaaaccctgtcaaagtgcaggggactcccagacaatgcaacattcatttaggccaatcaattctgtcaaaaattcattcgatgaaaatagtaccaagtgggtactcaactgcttagccaatttagtctccacagcaactctgaggctacaggtaaatacagtctcaggcacggaaggaaatctggtatttattcagagaggcagtagacatccctctgtccctgacttgctagctatgtgacccaaggcaagttacttaccttccccaaccagtagcttctccattttaaaatgggttatcagaaggtattgatcttctgggtgtgttgtaaatgctaagcttactattcattctaggccagccaggcatggtggctcatgcctgtaatcccagcactttgggaggcccaagcgaggggattgcttgagccctggagtttgagaccagcctaggaaacatagtgagacccagtcccagcaaaaaataaaaaaaaattagctgagtgtggtggtgcatgcttgtagtcacagctacttaggaggatgaaataggagaatcacttgagcccaagagctcaaggctgcagtaagccatgattgtgctatttcactccagcctgagtgacagagcaagactctgtttaaaaaaaaaaaagcaccctgtaatgctattactcacacgtaaagtcttctctataggaggtaagaatgatatttcaggagtgtaaagaatcttgatgtcaccttatggaaaggggatgaaaaagaagatgaaaaaggcttgttttcattttgccagagtcatggattccagttccaggtctgttttgcatcaccatagtcccaaacaagtgtaacatccagagcccaggaggaattctggatgaaatatcagccaggagcaggagtgtgacagctgtaggtcacttgggccataaagttagttaatggggaagacagatgaatgagtgtattgtggcaacatatcagaaggtctgaggcataaatagtgttggaaaataataagacagttggttcttgaggatcaacattgcagggaaggagaaatgcacaacaaaagaccatgttgtgtttttggatggtggccggggatgcacattcactgcccctcccctcttcaaccccactctccacatcccgtgacctggtgggatgccagtggtcatgagatcccatcacatacatgagtttcaagagtcactaacaagcttgtaaagaacaggtactttctaaggaatattcactcttgcagctgtattcctagggcttaaatagcacactgttttccactgacaaatgatttcgggtagggtgatctcatgaacttgtactaatggcagacacatttgaatttcttttttattctgaaagttaactgctgaaagcaaatgtgaaaaaaaaattatctccctctgttttatctctgggagaagataaaaatacgaggtgttttaatttggcagtgatctgggcgccttccgctggcctgtttttcttttgcgaagagctcccactttcaggactgccgtttctttgatcttatattctgtctgtgttcaggtacccctttgtgcctacctgaatcgtgtgtaacaaatcatcttaattacttcaggcctggcttcctcctccagttctcattttctgaaattcctgcgatggttaccaaataaatcagtgtggggctccagcccttggaaacagcacggaggcaccagcagcagccagaggaatttcaaagttagttaaaaggcacaggaggagtgagggaattgattgagaacctccctacccaccatgattttcagcctggagagttagtgctgcctgtactccaattccatgtgctttgcggggctcagccctcacacttttccccgtagaagagagaataattaatgccgtgaccccttggcgtggtagctagagccctgctgtcatcagcagtgccccaaacgcagtaggaacacgtaccgtatttcaaagcccaggcaggcagagaagggggaaggaactggtggcgcgctgtgacctgcgggagctccccagcgcagccagcaggaggcccaagctaggcggagagagggtcgtggggaagcgggccgctcccgggactcgtcactgggttggagctggcccgcttgagtggctccagttccaggaaggccgggtggcgtggggctgtgtttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccggggctgtgttttaagtggccgtttgtaagaagaacctctggcggagaggtgctgaggcaggctgggctgtgatcctgcacgccaggcggcctaaggggaggtaattgggaaccgcgagctgacactgcggaaaaaccaaacaccgcatattctcactcataggtgggaattgaacaatgagaacacatggacacaggaaggggaacatcacactctggggactgttgtggggtggggggaggggggagggatagatttaggagatatacctaatgttaaatgacgagttaatgggtgcagcacaccagctagcacatgtatacatatgtaactaacatgcacattgtgcacatgtaccctaaaacttaaagtataataataataataataataaaagaaattggtatttactaagaaaaaaagtgagagttctgtgtaggcctttgaaaaacacaaatctcttacttggggagacattccagtttaagtattatatttgacaaagtcctaaattatgtttaaactatggttatgaattttactaggaaaggaagaatttttatagcaaacaaattacaggaatttcaaagaccaaaaagaaaaaaaagaaaatgtaagccgcgaagccgcatcaacgccttcctgacagcggtgtctgttagtccacggcgtcccctcctaaggggagctgcgaaagacccattccggaggcatttcacggggccccgtaacacccgggcgagtgagctactgagaactgcatggctccttctggggccaggcggtcctaggagagccggctgggaggcggattgcttggacgtcccccgcccgcccccgcaactctgcgtgcggcgacgttgggaggtcccattagaagctccttgggcgggatctgtccaccatgccgcggcgcggagtgggagaggtttcggtctctgccaagggaagttgctgttgagtgcatcgccgtgaacacgacgcagcacatcctacagcccctgtggatatgtggatgctgtgggggcctgttgggtccgatagaagtttcaaaatcaaaatttttcaccatcctcgttgggtgatggtttgtagaatatttttgagggagtcttgtttgaggcggacagactcactcatctggtacactctttttcgagaacatggtgataaaataggttggctctaacgagaaggtgtcattccgccactccctttcccaagagggcttcgagggacactcaagtgaccaggatgtggcttatcctgtgatagccatctgagaacgttgttctctgttctttacttgcttctagtcagaaaacatggcctgtgttaggcaccctaggggataaagtgaattagacctggacctgactccagttttttcttttaaaactcactcgttttttcttcaaaaaataactcccccggtgtttctaatgtacagctgttttttgttgggaattactacattaaattatctctaagactcttctcatttcagatattttttggtttcctaattgtctaaaatttttaattatttttatttttattttttatttttttgcagacgtgaggcctccctatgtcgcccaggctagtctcgaactcctgggcttaagcgatcctgccacttcagcttcccaaagtgttgggattacaggcccgagtcactgtgccagcttcccctagttcttgagctcttctagggccactagattctctttcaccagcatgaagtaggatcattttagttagggtcaaattataaccttaaatcccaagtgacactgttcttttgtgaccactaacccctcaaaagatttttttttttctgatttcaaaacttctcctcctaaatcatcctgcaaattttactgaatctctactgcatgccagaggccccattctaggcattggggaaaaatacagtggtgcagacaaggagcctgttctcatggagcttacattctagaatcggatccagatcgttatgaatttcccctttattttgttttagtctctttcttaaactttcaactgtattcttctggttactcaatcccagttcatcctagggcagaaacataaattaagtccacttttatacttggtattacgcactgaatgtttttgtctctttcaaattcatatgttgaaatcgaatccctaatgtgatggtatttggaggtgaggcctttgggaggtaattaggtcatgaggaaagaaccctcatgaatggaattagtgccttttagaaagaggcaggagagctagctcatttgcttgccaccttgggaggatacaacacgaagttggcagtttgcaacctggaagagagtcctcgccagcacctgaccatgctggcaccctgatcgctgactttcagcctccagaaatatgggaaatttctgttctttataagtcacccagtctatactactttattatagcagctggaactaaggcacttgtttatccttcatctgtaggaaaatgctaaatcagataatggcaaccactgtgaactatattatctctagggtattatggggtctccatggcaggtgagagaaatatctttttataactaaaaatgttgagcactctaaccatttggatgcatattttttactctctgtatttaaaagttaagtctcattttctacttgtagttgacatctgttgttatcatttacttctctgttacatgcagggaggatacattccctagtcttccatttttgtgtgtagggactttttcagaaaacactcctagctccttggtttcctgtatcccccttttcccttcccctcaagggaggaagcgtgagctacttgatgggtgagtttgggtgcagtggctgagcatgtgactctcagcccctttctattttctctttgtcacctacaagtgtgcaaacagctttctatgctcttccatgccatacatgacaggagcaggcccccatgggagactgcatgtccgtgatggggcaggcccatctaattcaggaagcaagctcatttggttaacagacctaaagccatgttgtaaggctgacattttagggcttttctacttggctcctgggtctttctctcaactggctccaaactaaggtggggcattgagctttctcaaaccccaacagtacccatatctcaattccctagagaaccaccttctccagctcatagtaagtttgaattaagtgaaactgactctacacatgagacccacaattagctccccttggctacaagatttgtttaaggatgaacatagggcccagtcagatctaatgaatcacagtgatgttttcctcgttgaggaactcttaattttatctgctggacctaaaggagggtgtagggattacagccattgctgccatcccattacaacatgaagccaagagatgtagaaaaatgctcctgatgccattggttgagttcaggtttcagccacatctgaaatgtattctacccctggacttttcatcttaagtgaaacaataagttccctttgtgcttaagctagtttgggtccgtttcctactgctttcaatggtaaatggatcattctttatattattttcatattgttagttttaattgattttagatcaccacagatcacctcaattactcacgttagatcccaggagctagaagcgattttagaaagtgttaatagcaggaggatacttaggttttaatgttgagatgttaattattttaggcaccttttattacctatttactttgtctatttatttgttattttttggtaaacaaatctgatggggtacttgactatagtaagtctttaatcaaactttaacaatgcaatcagttcattttttccttttgattaactggagaagagcaactcttggtctttaaagtcatagtgatcattataaatatcctcaaggaaacaacaaactcttgaggaaagttatttcagttacatcccaacataagagactggaaattttttaccaagaattctggtagaggtgtaatataaccaggagggtgttgtggtttggatggacaatgagaagagagaagggccttctgggaatggggaagaaaatcagtggagttaagagtgaggcacattcatagctgctgaggtggagatggcaagctgtccaaaaaaaaaaaaaaaaaatgtgagctttccctttcatttttcatagcattgctgctgggaggtggctgctcatccagggactatatttttcaacactctttgcatctagatatggtcatgtgacttgttctcaccagtgaaatgtgagtggaagctacttctatgccaaggcttttaaaaagtagcctactttcctggtacgtttcctcctttcatccctacattgtccttctagtggttagtaggggcataaactcgaagcttggctttctgaatcactgaatgagagaaaacttgctttgattttttttttttttttcaagagacaggttcttgctgtgtcacccaggttggaatgcagtggggtgaccgtagcttactgcagcctcgtactcctgggctcaagtgatccttctgcctaggcctcccaaaggtgctaggattacaggcatgagctatcacgcccagactggactattttgtgaaagggaaataaagttctattgtgtttggccactgtattaggctgttcttacattgccataaagaaatacctgagactgggtaatttataagaaaagagatttaattggctcatggttctgcaggctgtacaggaagtatgacactggcatctgcttctggggaggcctcaggaagctttcccttgtggcaaaaggtgaagcaggagtaggcacttcacatagagaaagcaggagcaagccagaaagagagagaggcagggggagatgccacacacttttaaacaaccagatctcttgaaaactcactcactatcgcacggacagcactaagccatgagggatccacccccatgatccaaacacctcccaccaggccccaacgctagcagtggggattacatttcaacatgagatttgggcagggacaaatatccaaacaatatcggtcagtgtgcatttacagatatatttgatacaaaaagatctcagtgcttctcaaagtgcggtttccagaccaggaacatcagcctcgctggagacttgttagacatgaaaattctcaggccccactcttgacctactgaattagaatctcggatccagagatctgtgtatctgacaagccctccaggtggtcctaatgcacactcaagtttgaggaccactgccttgtgccgtccctaccaacttcatcaccgctctaactgatcagtagacatgggttgtttctctcctcagctttgccttttctggattaaactctcaaagtgtctaaagtttctgagcttcattagcaatggtgctgaaagttaaggataatgttgaaaaatcttgtgcatgagggaagacatttggtgagtttgaagttctgatgaattttgagaaaaagaaacatcctgaaagcttaagatagcttaaaaacaacttttgttcagttctaaatattagcactttttataaaagggcatatatcctacctagaacaggggtcacaacccagatgccccccaggtaatctaatccaggggagtgggccaagtggagggcagcgaacagtatgaagcaacagctgattgttaagagtatgggcccagtgacttcaggtctaaacattattaaaaagaactgcagatttgcattttcattttacatcttctggtttgtaaatgttaactcacattacaaaaaatccaaatccaagaaacaaaaccaaaaattttgtatgggttgaacatgcctgagtgtttaatttggcccctgggctgccagttttacaacctttgtctggaagtaccagggaagcagtcaggttgctaatgtctcctcttactcattaggaggcaaaataacttttacacaatcatgagctccaaaagggagacgaataagagctgtacaaagtagttgccaaggtaacatcttgctgatcagaaaggggcgacaattgggttttatgtagacgcagtgggagaatgaaacataatctttctctgtcttctttctgtttaagatcagtgtggaaatggatgtggacgcggtgctgctgcctgagattagcaggaagcaattcttttcccatttggagagaccccggtgagacctgatcaactagcaacatgcggaagtcacaccattaagtcttccaatttgctagcagcaaatcaatgaactctgatagctgctgccctaagctagcatccagggaactgtggacaagctatttgatacctgaattttagtgaaggaaagttaaattttttcttaaagcagggtgggagtggggttgtgtggggaagattatattaagcagtgagagaagacagatggagttttgtagaaagagagctggttgttttaaattgtatcttaaatttattgtagagctattggtaattagtgttttgttgttgtgtgtttataccaaccaattaataagaaaggcttttatttttatttcatcagttggagctgaactttattttttattataaatataaggcattattctagggcctggcaaacataggcagccactttttttttctggggaagattataccttggtatgttttcaccactgtgagatgaaaatttgagaacagtgagagacagatgcttgcctgaggagttttattttccctttaatccttatcaaatatccagatattacctatattgccttgatctgctgtctgaaggtgggtttctttgattgtttgaagagttctgggcactagaggtgcttactttgtgacgggagcaaataacaaggtgttgcccatgacatggtcaagcctcttcttcaattagccacctatcttgggcatgttttcatagagatatatctcatcccttttaataactgcagaatcttggacatttagaggtctccaaatattggttgtcatttatggtgtatcgtgtttttgttattataataacgttgcaataaataccctagcaacctatttttgcttacaagtagagtattttcgaagaacaaattccttcatgtgaaactgacgggtcaaaatataaaaggattaaagtttcaatagttagttaattgccttacaatggaattacaacaatttatacttccaccagtaattcatgaactctgccttaccacataatatttctaatctttcccaatctgatatggagaaacatgttttattattctatttttttttcactaaaagagagactttgaacacccctccatatgtttcaaaaacacttgtagaccaggtgtggtggctcactcctgtaattccagcactttgggaagtgagaagattgcttgagcccaggagttcgagaccaacttaggcaacaaatctagacaagggagaccttgtctctacgaaaaaatgaaaacattaactgggcatggtggtgtgtgctgtggtgctagctgctcaggaggctgaagatgggaggactgcttgagcctgggaagttgaggctgcagtgagctgtgtgatggcaccactgcactccagcctgggcaacagagtgagaccctgtctcaaaacaaaacaaaacaatacaaaacaaaacttttttttttcagtgaatgtttctttatagatttcaacttctaaaaattgttggcactttttttgattgactgaagagctcattatatattaagcaatgtagactttttttttttttttttgagacagggtctcgctccgtcgcccaggctggagtgcattggtgcgatctgggctcactgcaacctctgtctcccaggttcaagcaattctccccgctcagcctcctgagtacctgggattgcaggcacctaccatcatgcccggctaatttttgtatttttgtagagatagggttttaccatgttgttcaggctggtcttgaactcctgatctcagatgatctacccgccacggcttcccaaagtgctgggattacaggtgtgagccgccgcgcttggcccaatttagactttttaaaccaacttttgaaggttggtttttaaaaaataaatgactggatcatgttctaactactcatagtctcagccaaacacaattgcggaaggcctagccaaaggctctttgctcagtgaaagtcccatgaatctcaggcacagaggatagtctggaaagacctaacctgcacatgcaaatctattaagaaagatgaagtcttaggcttatatggagctaaataattgcatgtttaatgcaatgccagggtacaggtaatggtgattggagttggaggggtgatgtgtgtggtgggtgaggaagtcagggctgagtcctaggtgagatctataagagtgatgtttatttatgcatctgagggctgggactctcatgacaggatttattttcattctctttcaaggagagccatgctgccttgctgcttcttgctcgtgtacacagagcacttggtgtcttgcgaatcccctttgacgccggtgcctttccaggccagtgctttgcttgtgttcagaggatgcatgctcaggccctaccagactatcttagggatgaggggcaaattttgtttccaatgctctgtgtgggccctccatggcattttcttcattttgggttccatcctggcctaaagcttcccattaaagctaatggccattggagttaacccaaattttctcctttggtatttataaaaagcaacactgaaaaaccttgaaattaactaacaataaaaaaaccattgatcggttctttcctggagatggttctttcttctcaaataggccactttgcagactggaaatcaccccaatcctcaaatagcctaatatttttcacatgtgattccagcaaattgctgtttgcattaacaccttggtggggactcacttaagagctagatttgttagtgtatttactgacattttcacatgatgttttcagctgcctgaataattgtaatattcaccagaaaaaaatcaaagtaatgaaaggtgcctacaattattcatatctcaacattgtaagccttaatttcctgcctgaagtgtggtaaattactcatttttaaagtcatctctagccactgagagtttatggtgatgtatatagatgttttgtagattccaaaaaaaatcaatgactatgaatatcacagactgtcaaaacagctggtgtgattataaaataatgagatcaactaaagacatcagctctcagacatccaaattgtaagaggaaaatgaagacgaggaaggggaaagtgaattgcttaatgtcttgtaggtaccaaataatagagtcagtatctgccactgccatgctgaagattttgcactgttacttacacagattcattcccctttttgcaggctttgttgggccaggagatggttttgcagcagcagaagactatgaactgggctttgggagataggatctctggttgtattctggctatccacactctgaaagaggaccgtgacaggtattgtcattattggtggctgagtttctaggttagccaacctatggcagattgggaagactttataatgcgaataaacagaagaaagtttacttgatcaaaaaagattttttctcctggtggaaactgcaattattagggcaactctttaagtgtccatcaatattaggatgcattttaacaggttaagtactcttctaactgggatgaatagggcattgacaggaaaattaacacacaagttcttatatcctccttcccttatatctggtcgcataacctaatgtgaattttttatgcctttaagtgctgatattatggaaaaaccttctaaaactggataaatatcattttccaagactcagatcaaatatcacatctttctctgattttcttgatccttcctgccaaaaagaaatagcaccatatatgcattagtataatctatttgtaattaacataaaatttctcattttacagagaatttgagtatcctaccaatatacctacaaaaggatgaaagaagatttggagtcaagggaaaacaagggcaataaaatagaagcttaccacctgctctcatacagttgctagaagaggactgcatatttggttctaagtttctggaagataaagccaaaatagaaacacaactcattataaaattttggtgtatccataaaataaaaacaaatgacctgtttga

SEQ ID NO: 2592 - DNA, 171708 bp, Homo sapiens
attacatttattatgtactttatttctattattattacattgttatatataatgaaataattacacaactcactataatgtagaatcagtgggagcctgagcttgttttcctgcaactagatggtcccatctgggggtggtgggagacaacaacagatcatcaggtattagattctcataagaaatgcgcaacttagatccctcacacacagttccaaaagggtttgtgctccttgagaatctaatgctgctgctgatctcacaggagacacagctcaggtggtaatgcgagcgacggggaattgctgtaaatacccatgaagtttcacttgctttccactcatctcctgctgtgtggcctggtttctaacaggccatggaccagtaccagtccatgacctgggggatgggatccctgctctagaagactagttcttgccttcttgccaattatttctagtcaaactgaaacctacttaaatgtacattttaataactttaacaatttattttggatcacccactgacatttacaatgttgtaaatataattcatctaagatacaaataacttcatggcaattaggaaaccctatttaggttccactttttaaaattgtgaattcttagatcacagtatccttctacattaagacaatgcaaactttgtgaaaggctagcaattgtaacatactatggattttaagctgtgttcaaattacttacttagtaaagtattttccactgaatacttgctatgggtagcacaggcatagtaactgtcaattaagactttttttccaattttgactaaaaaaagaggagtttagtaatttttctttctgtggtatacaaagtatcccaattattaaaactgggagcataaatatctcctaacaatctctgtgcttctttatatatgtttttaagacacttgctaaccctatgaaaccagagtgaagtacatgcatacatttcccaatgttttacccatctttttagagatttcatcagatataaactgtaagtttcctctttgacaaatttaattataagaaattaactaagaaattattatggctaattatcaacatatactatagttcaaggtattttttttttttgcaactgacagtttacagaactaatattaccacacactacagacaaagaagccagtcatattgatacaaatatgagatacaaaaatactaaaacctccaacctaaccatattaatagaaatgtagtcagaggcctggtgcagtagcttgtgcctgtaatcacagcatttgggagactgaggcaggaggatcacttgaggccaggtgtttgagaccagtctgagcaacatagcgaaaccccatttctacaaaaatacaagagttagctgggtgtggtgttatgtgcctgtaatcccagctactcaggaggctgagggatgagaatcacttgaacccaggaagaggaggttacagtcagcccagaccatgccattgaactccagcctgggtgacagagtgagactctgtttcaaaaaaaagaaaaaaaatctagtcagtgctaaaaggaacttttgatatcttcattccatcttcagtctatggttgagagttgatctgttcaacatcagcaagctagttgatggctgggtctatggtctaggacctctctgttacctgattcctaagctaagactcttcatagaaaacacattgagtcaattctccctctgtttctctctctctctctctctctcacacacacacacacaatttaccttaatatagttattgtagagcaatctaaacaagcatatttttatacaaatttacatgttgtactgtgtacttacttatcagccttttcttttggcaggagagcacaaaaataaaatacattaaaaaaccagcgcagaacctgctacattatggattttcaaaaacaacaacaaaaaagtctttcttttatccgatcgactgaattagattccagtaggtgtggaaatatattaaagtgttctcagaaatatgtcatagaaattcactaagcacaatattaatctaactctaaactagaatatgcgtctgcactgactttatttcctacaaatagacaacattctccagcctcacctgcctgtttctttccttaactatgtaacagatgtaccaagagttattctatgtttctagattatgtatttcctttcatattgaaatgatgcatatatttctttcctgtgtacatatacccaccaaacttttccagtagtaatgaaactctcaaaaactttctaaagtaatgtgatgctagaaaatgctagtaaaagctaaccaatatacaatatatgcatggagtaggaagttataattccttctacttgtaaatgtgacctaattacattctgccttcttaaatttcaaaaataacatatataagctggtctatcaaaatgttttaaacacctaattatccacaatatagaatttgtttcaactttaaactaaacaaatgtatctgcctctgagcagtaaacaatggttagtgatatttagataataaagttaacttcacagaaacacccaaatcttgtatctagtaaggatttattataacaaatattgaataatttattatttaaatggttagaataaagttcaagggaaatataagcaaactacttctttctctaacaatctgaaatacatgggggtttaaaccttctatatttttgtcaaaatagtaattaaccatagatgacagatgctgctccctagtcaatggagggtctcaaattttactctgcatctcattgggaaggaaatataaatttttaaaatagaattaacttagggaaaggcatcagtgctgcaactcttagcaccaaatgttttttcttggagcaccaaatgctctaaggaaaacattccaagtatcaaagttttcagatagataaatatttatggatcaaatccataaagaacagacattgttatgaaatatatatagatgccttcaaaactttctttctaggcagagtagacacataagttaggagtcatttcccacttaattgtttttgcaaccttatgcaacacgaatggattatgtgcaagacttattcatttttacacagaaagtagatcttgactgacatggtgtccagaaaatcaaacagaagctatttctctatataaaatataaagtgccattaaatttatagaaatggcttcattttaatctttttttggtggaaaagtatagggatttttgatctggtcttttggtaagaaaataacactcttcaaaacaaattcttttcaactgctagttagtataattggagaaaagcataaaacagatctggttcatatctttaagggcaatgaaattccatcagtctttgaactttattaatgatattttttcagtctacatatagaccactgccacttcctcttcattaagagctcttcatagtagctgtataacaatctacagaaagttatttttccatttaaaggcagaggttaattttcattgttcatgcagcaaaatgtaagtatgctacataattctagagaaatttgaagtagttaccaaagaaacatagccttagcttctgtagtattctcaatgatattaaaatagcaataattggtgtgcactcatcagaaatgaagtgcccatttaaggaagccacattaggtcttgttccagatgcaaatgcagaacaaagggatacaataactcattgcagaaagggttgggtatactatatcaggcttccaagttacacttgcatatgcagctactgccaatagtatcatctgtgaacatgagggacattttggaactgaatagaattccatccctgaaactaagcataacaactgcatattcaacccaagaaggcattagctttatgtgggcttaaagaaatggtagcacaggcataggtaaaatttttatttatgaatgtgtggacacatgactttggatccagccagccagtgacataaataaacttgagcaaaagtttcaagctagaggatatatatgtatagaaaattatatatttgtgtgtgtgtgtaaggcctcttggaacagtgccacaaacctggacaccaaccaacagaatactcccgtcctttgaaatttccattaagagcacaatgggggtaattataccaggatgctccaatcgctctttccatcttgtgcactcacatgcccgccaaacatgaaatgttcgccttctcccttccaatgtgatggttgttgaacttatttttagtgtcatttgataagcctttgtgctcacagagagacatcccactgacccagccactggtcattgtctataccagttcacatcaaagcaggcgcactttgtcaggtttccactcgaatatccatttcgcatctgaagtacagtatcgaaagtgactagatcatttgagcttttttcttcagctgctgccttcctcccccacggtgtttctgctcacgctaacataatttggcatcgtcgacgtgacacgatggtggtttttctaaaaaattataatacatacatcgtcaatgttttgtgatagcgaccctccagaagatttaatttgtaaattgaagaaaggtggtctttttcctctactgaatcataaccaaggtagagtgcccctcaaaatccaagtaatgcgcatacagtaataggtcattcaatgtcaaaaggcataaaaaagatgagcaaaatcttcacaggctgctgcttgctgttgcttttaattatattaattaaactttgaaattttaatgcaaagagagttgctggcttgtgacgctgaagagcccttggagacttgaagaaagaaaaaaccctgagcggaagctttgtggttactgcttcctttaaattaaaagcaaaacaaacttctaggtatgtttatggatattaatgctttatgcactactaaatcctaaacacaggaaaagggggaatctactagtcacagggacaagttcgcaaaaaatgagtcccttgcactacactcaagatctctggctagaggccttctgtggaataacgctctattaattttcttgtcccgagtgcataatgaaagaaaggtgtcttcgaaaactaaagggcaaaatcttgcttgctaccaataccttgaggcatcttgtctacattttgtcatgcgtgtgcacttttcagtgttagaatgacaagattttccagtcagaaacttcccataaggcacactgtgatagagcacttggaaggattctgtgatctgacatagctataaggcaatggacttctttatttgcttagcctggtgggaaatttcatactctgcctatggataaagatcttgccacataaaaacacaagtgccatgtttccatgtaaaaaactcctgtctcccatcatggctagttgttttgtggtccttgttttggtatcatcttcgtgttgttgctgttgttgctttttcctcttctacacattcaaacaaactttcttgtacaaaccatagtctgcaggtcaatgttcctctttattttcaatgtcataaatcatgagttaccactgagtttcatcacctcccatgtagatggcagaacaagtgtttagaaatgtttggtgcaagcaaagcagaaggcagagaaaacatttcccgactgagaggaattaagctgctcttccaaaagcttctgaaatgcacttgatttttttcatttggttgaaaatcagctatgtgaaaatgtgccatcttcgtaccttcttggtcttcctgcttcccttttactgagatggaactcgggagaagtttatgcaccggccctgaagaaagaaataaatccatattgaaatattgaagccattatttaaaaaagcatgagaacatctagttttcctaccatgataataaatgattacccaaggaaagtaccatgttaacttgagacatgaagtcataatttttttttcttgggttaaagcatgatggttcattcagatcttttccacagtaagttcacctatgagatggtatggtataattaatatggaaaaacaattatggaaatagaatgttactattatctaaaatacagcattactatcacggccataaaaatatcaaagccacaacccaatatacttctttatgtaatgaattaaaatgaaaatattttcttatgcaagctgatgctcctaaaatgcatacatgaggatcacatttagtaagcagtaagagactgaggatgaggaatcccaaaaaaggtattgtcatctctttgtaattcccttttatgaaggatttttgcaaaatcatgtccattgttactgaccatttctcaccactgcacaccaccatgatgtgttcatttcaaatggtgactatctgcacttacacatttctaaagaggatttgccattctaatttcttaacacttctgtgaaggttgtgtggacacactgttccatgtgtattgtaaataatccaagaaatatttgaaaacaaagtttccaattagtgataaaagatactttccttttctctctttggtatgatactactgatccactgtaccacctaaatcattcccagattcctcaaccagccaaaagctagcatagtgctttctaagttagggtcaggattatcaccctattgacatttctgtatttcttacaatagctgctctcaaagtgttttagattttagagtgtctctttatttccctctaaatgtaagtttgtttttaatatccaaagcatgataaaattcaaaagcaacaaaacattgttgaagaagaatggttggaatataaaagcagaatttttttccattttttccaaaaatgactgctcaataaatttgaaaatttcagaaattagtgaagaaacagaaaagcataaaaacaaaacagagctaggagtttccattagtttttgctaaaaggcaaacattcatcaaattatctgtcttttaaatacttttggaagcaacattattactacaattgccaatttttattacttactttgtgttaatgtctacaaatcatatcagtgcaaaaggaagtaggaaaaaagcagatagaagatcagattaaaatgaggtcaaaattccttactgatacaggtcataggtcatgtactccagactgtatttttgtgttacctagaactttcaaacaagattttcagagtgcatattaagtgaagaggtgctcttctctagattagctaagggagctatgtgtgttgccaaaacacaataaaacaataaaagtgttatttttcacaacacgttatgttccatggttagaaatactttttcaagagggacaggtaggaaaatgacatcatacataaataattgaggcaaaaaaagtagtgcttctaaaacacagtagtatatatattcaatgagaaatagatttgaactatgcaaattcaacagtgatcaacatttaaaatattatcttctggcaattttccagaattgaacaaatatatgaggaatgatattatgacagcaaagatataaattaatgacatctttttcttgtgtatttgtagaccaaaaagtaatagttttctcttttctgtacaagtttgaaaataattatgaacctctattttcacttgtgttttatcacttattaaatggatatagatataatgattcttctgtgaccacttccgttctatataccatattaactttagtgtgtgatgactagtaatggttagtagagtgttaactttaagcaactggatagtttaacaagtgagattcacaatctactcaaattctcaaattcacttcaatacctaaattattccagacctaaattatttatttcatttgatgtggtttaattaaagatatggaaacttgaaggaagaaaactctgctgattttgactctgaggtccttattacaactcttccaaagcttggtattaagtatcaattatcagctgccaaatgtctctagatataagcaccaaaaaaaaaaaaataaagaaaaacctattaaatgcaatatacacctatatgttttaacacacacccgttaacaaaaacaagcaaatgctcttctccccttctaatcatggactcagtgctttttacttttatcaacagctgataatgtctgggtgtaattttatttttcaaaaatttaaaaggaggtgacttcgggaaatctgttcaagagtcactgttaagcatttcccagttttcccagttgtggggctccttctcccaaagatcccactgcatctccactatagccacactacatcgtgccataatagcatgctcaaatatctaaaaggaaagataacagtggttaaatctgagcactctaaagatggagtatgtcttctagcctctgccacttcttaactgtgtgaccatgggcgacttacttaactactgtgtacctcagttcttttatcagtaaaatgaagactaaaaaatgggcctattcttaaggctgttgtaaagactaaatttgttaagatatataaagcactgaaaatagtgcctgacatatagcaaactctcaataaaaacacatattgttggccgggtgtggtggctcacgcctgtaatcccagcactttgggaggctgaggcaggcagatcatgaggtcaagagatcaagaccatcctggccaacatggtgaaactccatctctactgaaaatataaaaattagctgggcgtggtagcgcatgcctgtagtcccagctactccagaggctgaggcaggagaatcgcttgaacccgggaggcggaggttgcagtgaaccaagatcgcaccactgcactccagcctagtgacagagcgagactccgtctcaaaaaaaaaaaaaaagaaaaaaaagaaaaaaaaaaagaaaacaaaaacaaaaaaaacagatattgttgttatccatattccctctataatgtcattgcataagtctaacatagagcagactcaataatttcttacttaggaacaagtgaatggatggatgaagaatgaatgagtacacaatcacacagacctccactggtggtggagccagatgtcaaaaatgagaagacagaataagtatgaatctgagggagagaaagaggattaccaaggagaaaaacagtggaaaggagagaagaaaatacggagaaaatagatgagagtagcacagaagaggaaaaggtaagaaagaagaatcaagaaaaatggaaacttttggctaaagggaaatattttattcagtattccattaggagtcttacttccaggcaactacttcacattggctgctgccatccgcttaccagaaaattctaaaaacaaggcaatgcatcccggttgtaagtgaccatgatcagatagcatcgtccttcaactatacctaatactagcttacaaaacacacattagtgataacgctaattatgtttaaggtcatggatgtttgggctgccatttatattacagcaagaagtcaatgccagaacactgcagagcaatttttatttgcaggaaatggaatatgacaaggcttacaagtctgtcatatcctcatgcttatagtgcctacacaataaaggtatgttatcaaggtagcaagcaaagcaatataaaatagcttgaacatacaactcatcaaagaactgtacagaatggaaagtattattagttaataatgtttctttttctgagactatttcacttttataacaaataatacgagtgctaaaaataacaaaagttaactaaatggtttaataagaaactattaaatgtaacctaaatatatagaagaatacatatagacctatatttattataattttaatattttattctctatatagaggctaatactagtatcaggtgacaggattacatagcttctaaaataaaccattctaacattttaatatgccaaaatagaggaacataagatttccatgagcaagagttaaaatgaatgaatgtataatattatgcctgtatttcacaaagtaattcgataaactggaactcaggtggcataagtgtttagagaataatataacatgtaatatatgttattattatgaagaaaatattttctttattttctgaaaatttaattaaatattctttctaaataacttttttgatttaaaatcatgccctaatcatgcatgtaaatcatgagtaaaatctaaatatactgttgttgtaatgctttaggtagcacccacactacttactcaattaggcaatcaatacaaccaacttgaatttgatatcatgccttataaatcattgaatcataaactttaacaataacaacatttagttaatataaaattgaattaaattagtgtctgcattagttcaaaatgaactataaatatattaccttattttggtttgggaatataatactctttggattcaataaaatcattgttaaatttattaattttgcatgacataaaaatttagaagtagaatttattaaatatttataaaaattaaggttcggcagaataaagataattttatcactgactttatgctatagcgaaatacatttaaagtacattaatttagaaattataattattcagatatcagttatgttgtagctgacctttctccatatattaaagaattaggcaaattaatctaaataagattactctgagtatgtttaccaacttaaaatttgtatagcatataagaagtgcatgtaaatattaataattcaatcattaaattatgatctttttatggaaacattttatttgcctaatagaaattatgactttaaagaaataaaactgcctcccttctaaagaatactgttttatgcaaacttatattgaaaacattacatagttagtgaatttctgtggcaagaaaagaactcttgtgcattgctagtggaagttaaaattgtcaaaaactatatggtaagcaaagtatataaaaaatggtctttaaaaacttacattctttgactcagtaatttcactttaggaatctaacctaataaaatagctagactgagatttcaaatatttactataggatttttatagtagtcaaaaatatactcaatttgtatttatttctgtgcaacaatcagagactagttgaataaattcagattcatctattttactctattctacagccattaaaataaggaaactttctaaagatgaaaaaaatggtaactaaaaatatgatatgattgtaattatgcaaagactttaatagacaatataccagcatgctgcaggtaatgggatagcacatgacttctcgcattctatgttttaccttttctgcatattcaaatatttgctatcttaaaaggtaacattagttttcaaagagtgaattcattcagcaaacatgcaatcatttttaaacatctatatttatgtttttaaaagtcagcccaagaacttactaactactcactttctggaatcaccaccaacttccagctatgccaaagcttttcagcactgaatgtgcccataagttaactcttttactcatctttgggctgtattttacaattactatcttggtgtacccactgtaatgcagtttgactcaagagcacatttatatggtagaaaatttattaataaattttataatccaccatcagcattttcttcttatcatacaaaattataaaagtttcaataaaatgcctgttaaagcatttggcaaggtcacaactggctatctaattgttaaaaatgtgtttgtgtgtatgtctataagtgcatgtcagcacacatgtacaacctacctcatgtcctgtgcatgctggagttcattacattgaaataaatataagagaggctctttaattttcataccacatcaaacttttaaccacatacccaatatctagggcatataatttctctatgcaattaacaatatagaatatttatacctcaggtatttacctgtaataatgttagaatcctttctctccctatcagtttgcaaaactactcccagttgactctaagtggaatgctagccatttatttctctaggtcaatggttttttcatagtgtaaaccacgaagtcctgtggcttttctgcaaggtgactcagaggtcactgtggctggggtagtgcatgagaagggaacaagcaggcacaactgcaggcctctcaaacctaatgctccactcttatctatcttttaaaattgcaattcagtataagattttgtctgtgctaaaaatgtagtttgataactaatagtccagatattttcatgcctgtgtcaagtcagatcactagtaaactatctgtatatatagacttgatttcttttctttagatcttctcgtcgatctacataaacaatatagcattctctctttttttttggttatatgaagagccctgtgaattttggtcatatgaggagaattatcattttggaaaattgctattaaggatactgatattaagggaccaattctccttggtgttcagagctaggaaaaagtttgtcaatactggtaagctcatgtttcccttttattatataatggcaactatacaacttaacgtctttctctttatgtcttggcttttaggaagctcagatttataagatgtcctaaaagcaattgctagcctcagtgtacattttctgttataaccatatcttgacttcggcttattattatttcccaatttttgttcttctgaggtttgactattttttttctcaatacttctttagaagtagactaggtataagcaaatgtaaactaataaaggtttctttcttgattcttaactttctcagtcacggagaatatctgaacccctcttaacctctacaatcctccaataaagaattgcctaaacctgtaccttatgcaaaaagaccatatgctttctgtgttgctttttcttattctcttagggcttaatgaggtactctgtagatacctcatgatgtcaaattatcattaatttgaacttaacctgaactaagttgaaaaattaatatgaacttgaagtttatacatgcaagcatggtgaaaccatactattcttcacataatcccaaagttcttctatgataacaaatctgtctgaagactgaaaacttcattttctttgcctgctaggcaaaagtaagcacaatataattctttacaaattggaatgtattaacagtttcaattcatcacaaagagcacagctctgtgtggaaactttattctattacacacttttcttctgtataagaagatacagaatgtaccaaggatatgacagaaacaaaagtctggtcataataaaggctaaactcacaatcggaatctttaacttcactcaaataattttcaggcaatgattagtatatcttagagtgggaagcttattgacattttcccagaaattgttgctagcaaaaccttctcatgagcctcataataagtaagaagggaatggagatgccctgaagaaaaatgtctgatattacattactactctgcagttaaataaaccaagaggtgaaaatatgacaacagtaggaactgacatatttgctgttgcctaggtatagagaccccaactccactgcaatatttaaaactgacttcactgtctcattttcaccatggccggtaatagcagcattaaccagagcaagtgtcatgtctcccatctcttgagcattaaaattccactggcattaacgcttgtgagctcctttactagctatctgcacaggatgtatttcactgctataactgttatagtattatgctcacctcataaatatccattgacaagctgaagcaaacaactgcactttagtttagacttttcaaacacagttagctgatttatttataaatcacttctaaaaaaaggttactaaaccttcatgttgtgtacgacagtaaagagtgtttcaaatttaaaattgtatacaaagcatccacacgcatagacacagagacaaatcaagaggtccaggaaatcactgatataaggagagacttgagaacacaatagccattttgagtagagattttctgtagcaaatggagatacagaactgaagaaaaggcatgtagtatcacatctttctctctctgtctctgtctctgtctctgtctctctccctctctctctctctctctctctctctctctctctatatatatatatatacataaagaatctgtgctatcttttgctctaaataaaactgcaaaattttgagctgaaatataaattccacatactcttttctaatggaagctcaacctataaatgtccaattttacagtagagaccacgcaccatatggatattcagtagatgtcatgaagagaagttctgagtttggctgaaaaatttacctttaaatgttttttattcagtatctttaatctgtcatggcacctgcaaaatttcagtgactctatacatatggttaatatttattttgcaaatacccatttttaaatatttgttgaaattcaggcatacagttggcagttaatggtacacctaaaccacacctcataagatgaaatagatgcttctaaattattaattccaagtaagatacatatctagatgtagatatagatatctataaaaatctttgttggaaataccttcttttgtgcttcctaataagtcaaaatgggaggtagatgccccaaaggtattaataaatagatatagatataatcaggacagaattctatatacctttttagttgcttaacatttattttgtgaggcacatagtagataatgtagaaattgttttctgctttctaatctcaattagaatacagatcatttcatagatcttaaatcaatagtaaaaaaatttctcataatatgaccttaaagcaataaaaaaacagaaagcaatttatgaatattgtagcattactggtgttaacaagaaattgaaaatgatccaaatgtccaccaggaagagaaaagtcgaataaattaagatacagatagaaaatggaatgctataaataatatacatctgttagaaagaatgaggaaaatttctatacaccattgtggagtgatgaacaggatttatgaagggggttaaaatgaaggagcatatagtatacacactatagcatcttttatattacaaaaaagaaagatacactggcattaacatatgcttaatttttaaagggaaagaaaaaaataattcgtttgaaaataaaattggttagcaacaggtgagaggtacagagtagactgaataagaatgtaaatgagataaatttcaatatatcttgttatatgctattaaatacaaacatgtaaatgtttgacttttgaaaaacagttacacaataaaaagaaatcccaacaaattaaaataaacttcactaagtgcaaggcggaggcctgccaaaagcatagaacatggcaggaaagctggtgtggagaggtcctaccacagtatctgaggctttctttgagagccaagaagtagtcaactgaaggctgggagaaaggcaagagggtagagaaatatttcctcctccaaaggcacatggagccttctcaaagggaatagaagcagcccactgaaggtttgggacatggcaagaggaaagaaaaaaaaatagccctgagggacccagagccttccccaaccacaaggtggcagcctgctgaaacctggaagcagaactgagaagtatcccaccaaaactcatggggccctctcagattgcaagtcattggccagtccaagtctgcaggcagaaaatcagtttgaaagtgggtctcccaaggtacagaaagtttggccagttaaggggactgtggcagttagagacaaaagagacctccgctgcaactttacaagcttgctgatgaactgtaatggaaaaagcaagagagatagagataactctctactgaaggcaaatccttaatcctatcctcaaattcatgaaagctactagtgaactaaaaataagtaagagtaaaacttaactacagattagcaacaggacaaaggaagtggtatgtgcttttctaagggtaaacgttaccagacgagtctcttttttaattcccaatatctagtataaaattacaaattatggtacacacaaagaagcataaaagtatgactcataatcaatgaaaacacagataatataggcaaatctacaggtggtttagatgttgcagttaatagacatggacttcaaatagctatgataaaaataataaaagatctggcaaaaaaggcaggtaacatgcataaagatactgggaacatcagaagagatggaaactataaataagaaactgtaataataggataccaaaactaaagagaaaatatacaatatccgaaataaaaaatgtatttgattggtgttaaagtagaacggacacagcagaagaaacactcactgaatttgaaggtaggagaatagatattgttcaaattaaaaaataaagaagaaaataactaaggagaatctgagccctatgagacaatatccaatggtttgtcatataagtaataagtgtcccataaggagaggacaaaaaatggggctaaaaaactacttgaaaaataaatgctcagaacttcctagaattgatagaagacacaaacttacagatcaaagaaactcagttaaccatgagaaggataaatacatagaaacccagggaatatagagttaaacttctgaaaaccaagaatgtcatgaaagcataactctttccccttaccctgccccacaatgagatataaagagggaatggtgataagcacgacagttgactttttattaaaaaacaatgaaggacacgaggctatggaacactctaaaatagtaaatggggaaaaatatcaattaagatgtctccattcagagaaaataccctttaaaactaaagacattctcagacaaacaaaatatgagatcatttatccacaatagcttttaacaagtgcgaaaagttcttgagacagaagaaaaaagacactggggatggaagctcaggtttgcaggaagaaatagagaaacagaatagtaaatatgtgactaaatacacaagtaatataaataaagaaaataaatttttatgacactattacttaaaggaataaataataacatattgaattcataacatatgtagtagtagaatacatgacaagagcataaggaacagaaagaaaaaaatggaaattataccactgcaatgttcgcatattgttcttgaactactttaatattatttgatgttatactgaaagttaaagtatattgttatttcctgagcaagcaatgaaaaacaagatagagaaatggctaaaaagataacagaggagatagaacatagaagaaaaaaattgttaatctaaaagaggaagaaaggaacagaagaaaaaagaatggatatggcaaatagaaatcaaatacagtaaacttaagaactggaacaaataaactggacacaagaccacatacagaaaataaatatttcaagtgacttaacgcagtattttgcctgtatagcaacattagaatatgaacgaaggataaatggagaagcaaagaaatgtttcacttaattcaccagtcttaattttactatttgttattaattcatagttatataatgtgatggttaatactgaatgtcaacttgattggattgaaggatgcaaagtattgttccagggtgtgtcttcaaaggtgttgccaaaggagattaacatttgagtcagtggacttggaaagacagacctactctcaatctgggttgtcaccatctaatcagctaccagcatggtcagaggtagaaggacatggaaagactagtctggcttagtcttctggcctatatctttctcccatgctggatacttcctgccctcgaacatcagactctgagttcttcagcttttggactcttggacctttgaccacagactaaggctgcactgtcagcttccccacttttgaggttttgggacttgggctggcttcttcgctcctcagtttgcagatggcctattgtgggacctcaccttgtgatcgtgtgagtcaatactccttaataaactcccttttatatatacatctatcctattagttctgtccctctagagaatcctaatacatattttatatatatatatatatatatatatatatatatatatatatatatatatatatataaaaaatgatagggcagacaagtaattacattaatattgttaagactaagatttttcatgttggagaaaacagatgtaaatataaattcaaaaatattcagtaaaatcctttaatgctaagtgggaattataaatatactattaactcaccatttttttcccaaaactactgaatttcctagctctgcctgctggaaaggcctaaaagcaatgacagtaaaaattagcacccctagtactcaaaatgttttctctaaataccattatctactaaaaacaaatctaggactccttagagttgaatcattgattccagttttggaacagaaaatgcaaacgatgtgtctgggacatattatgccaaaatgaaagaaattaatcaaagacgaatggcttcttgtcaaaaatatacagcaatcaatatgatggatcaggcttttactacctgcctcctctgatcaatcttggtatcattaaacatgtaacatcttatgtgatgcaatgtaaagtacatagcaccacctatgaataatctatgccaaaattaaaaggcaaatctgaatcagagtaagagggcacagaatatcagtatatacgtgtgttggggatgagtgctggagaagttgcaattttataaaaagtatataggtagtagagaaaccagcaagggcaaaggctgtggggaaaacatctttgtcatatctgtggaaaaggcagacagataatgtggcaggaacacagtgagcaatgcagaaagtagaagatgtggtcaaacagaaggcagagatcttactatacaaagcctggtagcagtcacctataaatctttttctaaagcacattactaattatacaaaattaacatctggatccattctcatctcttttactgcagatggagttaagataagtgacttatatttcaaattcttaagattcacatgtacaacacaaaacaagcaaaaaatacccatcagacaatatcagactaaagaatccaaactacaatcttcatgtcaaataatggctaattgcaaacaaaatctatatttgaatcatgcatttagaaaaaaatccaaatgaaaggcatattacatcactatcaggtgggaaacagtataaattagtttgcttagagtggaagaatgctagcatgaaaatagtaattttttgctacagtatttctagacttaaaattttttaacctcacttgttaacaccacatagcaaaaagtttacatgcaattcatgtatttcttcttagaaaattaggcattaagaaaattcatttgccttatcaagttgcttttggcacatttaaagagaaattctgaatgtttatatatcaacattgaaaaacatttattgagattttcctaatgtatatggctctagtgatacattgatttattcctagttaagttaggtttctaagaattaaatcctcacttttaggactctaaagcaatgtatactgtcctagtcaaaaaattaataactaaaagcctccactggattcatatagattttcattagctgtctctacttaaaaatgtccatagctctttgggtcattttgccaaacagctaaattcctatacaatttgagactaactgatttagcacaaatattataaaacttcactttaagtttctgaattgatgttttatggataagactttgtagaaatgtatagtttttgaagctttattttgaagggcaattatggattactttctgaaagcttacgaataaaaattttttatgaaaaatatgcctaaatctttaactggaaacttagttactgtgatgttgtgtttttgtttgtttgttggttggttggttggtttgtttttcaccacagcaagtgtttagtgaacacattgcacatatttagttctaatggaagaggtgtgtatatatattcaatttttggacaatcgatttatgccttaggtatttttattatatttgagaaaaacaattttaaacaatcactgaggtcatttattacatctagtaataagatgtaataaatcccaaatcactatttaattttgaatatttattacagatgtatgatataaaatgatgtatatgttttaataacatatacggattaaaactctgcacactatacttccacattctaaactgctagagcagcagacaaatgacttttcttgctaaacttataccatggagagcaaaacctctagcaaacttgaaattctataggctaaaattaggctgataacagcatgaaatccctacttctatgtgcagatgcaagtctaaacaagcctttcattcatagccacagggatttatactgtaaacatagatgccactgtgacccagatgtgatttcactgatcaatgaatatacaatggcatttaatggtgattccttgctcacagtttgtaaagaaactaaacacacatcaattttgtccttaatgaatgcaggcactcctagtctaaacaacttatgttaactaacatgagtaagtctttaaaaaagttatggaaatattaaaccatctctagagatataattaatccctaaaatgaaaaatgtaacctttcaaaggttaaacatttaacacatacaagcatatagatacattcaaataagtagagacataattatgatagtgtttcaaaatactaattgactaaaaactaatatgtattaagttagctttatgtaaaaagaacagtttgcttcttgatccagagaactaaagaatgctgaagacatacatgtaataactcaacataaatccaagaacatgaaactgaaatttaggtctacctacaagtcaaatattgggtccagagctcgtgtagatacatagataacacagatatatagagacagagatacaaatacaaggttagctgcaaaaaattatattctaagccaaaatggctttctaaaacaaaaagaatataattaatgtattatcttagataaatcaaataatataattagactttggataacagcaaagttgattcagtgtttacacttctaatattttttagcaaacaaatctaatttgtttaacatccatcttctttcctagactgtaagctccatgtttctttttcactatcatttaacaagtgcttaaaacagtgctcatcctataggatgagtgcttaaaaatattagctgaatgaatgatcactactgggcttgaaatattaaatttgatttaggtagtcaatagctatctaaagcatataattgatattgcatctgtatgaatattgaaagtttcagtgcaataacacaatgactagcaagccataaaacaaaatacaatggtcgacttgtctaaaaatacaaacacaaaactataaaatgatatttcagtttttgctaactgacttgtaaggaaacaatagtggtaaacattccacaggcaaaagtcttcctggcttatttagtcacatgaatattcaagtaggcctagatgttctgcttcctgtatgtgtggcccatcaattaatagggaagtggctgaactacaggatgcaagtgttctaaaccaggaaacaagtaggcatcggagaggagctgaccttggtgtcagttccaaggagaaagcagatggtaggaagtggggtctgcttcatgctgaagctaccaagagacagaaaagatggggatgaaatatgtattctaaggccattgtgagccttagatcgaaatacaacacacaatttgacaagcaaaagtggtcattaacacatgtacacatataatgaagtagtgaaagtgtttaaatcagtgcacagttaactgacttcataggtatttattttcctttatgcctctgttattccctgtcaaataaataaatatttgtagaagaagcatggtttttcttcacacaagtggcagagcacatgcgctgtctctatgtgtgttgatacaactccagacaccaagttatgcatcagggaggaatccttctgtatttatgaattattaacattattaaatttggaaaagaaaataaagcacaattcatgaagatttccaaaaacacacacatatattgttttaattgtagatttggggagtacatgtgcaggttcgttatatgggtgtattgcataatgctggggtttgggcttccagtgaacccatcaccaaatagtgaacatagtagccaacaggtagtttttccaacattttccctcctctctccctctcttcttttggagtcctcagtgtctattatttctatctttatgtccatgcccaaatacatatttttaaaatgctctcaaaattgatagcatttgctgacaagtgtaaaggtttaaatactgggtacttcatcaacaagtaaagatttggaaattttaaaaggttaaaaacattctttaaaataacgaaaaaggccaggtgcaaagtgactcaagcctgtaattccagaactttgggaggcctaggcaggaggactgcttgaaaccagaagtttgaggctgcagtgagctatgatcacaccactgcactacagcctgggtgatagagcaaaaccctgtgtctaaaataaataaataaatagaaatgaaacataactggataaaccaatttcaattactatagcacttttaaagttaatgaaaaagttcttaatctctaatgcattatcagagttgttcttcttttggcaagagattattataaaaattagtaactccatggcaggactagaacacagagattttttagcattaggaacatgaaagtacagaaaactgcaactacaaaaaatctagtgttcacaaagcttacttcctttaaatttaatctctgctatagtttttaagtgaaacaactaaaattctatttcaaaatattttcacttgaaaatacatctttgttgactgaaacaaacaaaaaaggtcctagtgttcatgtatcagtacaatgccataataaaaattgtgctgaactgtcatactctcacctaacatcctatcattacagatagaaaagctatatgagatgacaatgtaacattttgtttgaatggcatccctgagaaaaatccagctgcagcagcacatttttaagatttaaatgtgaaagatcggtcattctaaatatgtatcattgtatcttttcatcaaagtcaacaccaatcttttgaacttagagaaggctgaatgaataaaatattcttgtgctggcaaaacccaaacctggacaactgtatcagcatttttatttagtttcttctgacaacatcaatgcaccttgcaaaaagcaagccagctgttcattctatttggtgctattaaaagtcgttttacagacttaaattatagtcactctttcctttttttttttttaatgatgatggcattaaagccttagataataaaaaaaaatttatgcaggtttcttgggcacttctatttttaaatatccaatttaacatatgtttaaaacagagcatacggaaataagaaaaagcaaatttgaattccaggcacaaatattggttaaaatgctaacaccatgtaaatgtattactttatagtaaccttcaatcgggaaggttattgagactcaaaattaacaaaaacataatctctttgctataataatactaattttcaggacctacattttccacagttgatttgacattgttcaggttctgcaaaatttatttccagtttttaaaagattatatcaagagagtcattctctttgtatgactagggtcacatcttattgagtgacattaaaaataacacctttacaaatcagccagtgaataaattaattagcagtaaccactgagtactatcagtgtaacaatgttcatctatctgcttaattgcattatcacagaggtggtgtctatgaacaagttaagttttaagcaactgaagtctgacaaagaaaatattaatgtcattcagctgttcttcagacatgaagaatttttaaagcatttttctttggttgcttttcacatttatgagaaaaagacgaactatacctaacaaagtggactcagaaaatatctaccatcaatgagtgtatccttaaacaatgacttcaatgttgtatgtgctttaccttggaatgattgtacatcaaaattgatattcaaaataatggctatggcaaactttctagataattaagtttctgctgaattaattgattagtttatgttcaataaatcaataaatacttttaaataagaatatgtatccaatatctttaagaattaacaccctatatttggttcacatgttcttgtgtatgtttctgaaggaatttagttaaccatgatattcaatttaccaaaacatagcaatcccaaccatttctataaaaaagtttgttataccatgttattgatgagataggaatgtgcctatgttgatgtcagaaggctctagctctaatcctaccatttcacaaactacagatcaaagtttccatctagcaggttgtgttagcttacatgggtgggatgaggaggaagatgattgccatatcaaagcaaataaagaaatctgattttaagcttagaaagaaacatgaaaatgtaaaaagatttgtaaagacttgcatattaaagtaacgattattaaaaatacatatttcatcaaatatggaaacagttgaacatatcacatctgtaggtatttttaaataaactaagaagtccaactacatttcttacataggaaatctgctgtgaagttactctaacttattatctaagtcttttctctttgtattcctatgccaagcaaaaatgcctgagctgggaatgtatagtaactgcacaggtatctgcattttcatgttgattacagccttattcacagtagccaagatatggaaacaatgtaagtatccatcagcagataaatggataaagaaattgtggcatatatatgtgtgtatatatatgtgtgtatatacacatgtgtgcatatatgtgtatatatacacatgtgcatatatgtgtatatatacgtgtgcatatatgtgtatatatacgtgtgcatatatgtgtatatatacacgtgtgcatatatacatatgtgtatatatgtgtgtatatatatgtgcgtgtgtgtgtgtatatatatatatatatgaatattattcagccttaaaaaaaaggaggtactggcatttacgacaacagatgaatctaaaggacactgtggcaagcgaacaaaaacagacatagaaaaagtactgtactatttatttcacttaaatgcaaaatctaaacaacaaaaaagagttacaaaaatactgtatcatatattggaaattagcaaagagagtagattttaggagctcttaccacacacacacacacacgcactcacctgtgcacagtaactatggaaggtgatggatatgttgatctgttttgctgtattaatcatttcattatgtacagttgttccccagtatccacaagggattggttccaagacccacctggcagatatcaaaatctgcagatgctcaagtccctgatataaaatttgcatataacctacctacatattcctgtatactttaaataatctctagatcacttatagtgtctaatacaatgtaaatgctatgcaaatactttatactatattttagaaatttgtattatttttatcgttatagtattatttggttgattgaatctgagaatgtggaacccacagataagaaggactgtctgtatgtgtatattaaaacattatgttgtataccttaaatatatgcaataaaatacaattttaaaaatgcatatgacctgtttacagatacaaaaaagtagaagctgaaaagaactgccattatcatacttcgcacctattaggatggctactattcaaaagaacaagaaaaaaataaagaaaataacaagtgttggcaggagtgtggaaagactgaaatcctcatgcattgctggtggaaatgtaaaatggtgtagccattgtggaacacagaatggtagttcctcaaaaaattaaacatagaattactacatgatccagtaatcccacttctgtgtatacacctaaaagagctgaaagcagggactcaaacagatatttgtacacccatattcatagaagcattactcataactgccaaaaagtagaaacaattcaagtgtctctccatggactaatagataaaatgtgtcatatacatacaatgaagtattattcagtctgaaaaagaaacgaaatttagatacatgttacaacatgaatgaaccataaggcactatggcaggtgaaataagccagacacaaaaggacaaatattgtatgatcccacttatatgtgttgcctaaaacattcaaattcatagagacagaataaaatagtggttactgggaattaggggaaggacagaattgggaattattgtttaatgggtagggagtttcagtctgggataatgaaaaagagagttggatagtggtgacagatgcacagcaatgtgaatatatttaatgctactgaatcgtatatttaaaaattattcaaatcgtaagtcttatgttatacatgttttaccatagtaaaaatattgtcattatttatagcattttaaaaatcaactgaaaaattatcataattcataaaatggagtaataaggtacattccagatatatacaaattttaaaaaatctatatgccagtaataagaatagtatgaaagatttgtgtttgaataaaaaaacatttactaaattcttttaaaagttatgacaatcttttttataaattactaatgcatggttatctataaatatagttattataattatcatgtggtcaattcattttaatctaacaaaaccaattagggcatgtacaaagaaattagtgctttatatatacatatatttgcaaggcataaagccaagaaaatacctgacatttcaaaactcaagtgtaactcaaaattatattttagaaacatcattatcctaatcccaagagaatggttaacagagtccaacaaaatcttagctctatgtaataattggagaagaagtatttcagggtacaattatcctaataatttagagtgcggggcaaaagaattgctgttttctcaccagccctcttctctcagtcgtttaagttggccataatacgggtctccctgtctattgcctacaatttctggtggaaatagatgaccactactgggctcacagacttggccataaaatataaaaaaataaaaataaattttaaaaaggcgtgttgggagggcaggcgcagtggctcacccctgtaatcccagcactttgggaggacaaggcgggtgaatcactaggtcaggagttcaagaccagcctggccaagatggcaaaaccccatctctactaaaaatataaaaattagccgggcgtggtggcagatgcctgtaatcccagctactctggaggctgaggcagagaattgcttgaacctgggaggtggaagttgcagtgagccaaaattgcgccactgcactccaggctgggcaacagagcgagactcagtatcaacaacaacaacaacaacaaaagtaaatattctgagtgttgtcagtgaaagaggagaaagaataaagttgtggctagctgttcttaatgttgatgcaaggacaagattctcagctgagataggcccccaggcattttacgttatggcatcttttcccctacagctaacagaacaatactgttgtgattctgaagacctttccaaactgatatatatgcaaatatacaaaaaaaagtaaagcagggaaaccagttacaaacatcttttaaagtataatttgaactataaccttctaagttccacatgtatataatagttttccgacaacaagagcaataataaaaatgactaaccatcatacaatgtagttctttttataccccaagtgcttctctaaatgctttataagctctggaaccatttaatcattacaacggtcctgtgacaagtactattatactgaatttatagatgaggaaactgatgctcagagtgggcaagtcatttactcaaatcttcctagcaagtaagtggcaggaccaagatttgcacacagaagaatcaacctccaacacccataatcataatcactatagcactaatgaatttctatgtcttggatacttgtatagttcttttaaaactatattagagataataaaatattatcaaatgaaaacagaaaaaagcctacctttattacagaaattaaatacattacaatttaaatctgaaatgtattatgaagatgaatataagatatattaggagaacttatataagagaggccttacctattttagaccgtagaaagtgaactctgatccctaaaacctacagtacaacacaagctagtactcaaggaaagctgtggattaactacattaagttctaaaagtatatatttttcattttggatggaattcttttcaagaacatattcacatttccatcttcctaaaatgtgttgtctgcacatgctttcatgctgaagataaagttttataattatgaacgttgattatcaggatgtggtccatcagtgctgtcagggcatactggggaataagaagctgtttcttcttgcactgaatggccccatactgcagtgcttgtctgagtcatgtgtctgtcctctcattctctccttcttttccttgcaactattacctcccactaacgtgtagtacccatctttagcagcccctctgccccaattctatttcactgtttctaatttggaagcagtatggaaaccagataatcaagcatactaaaagtaggtataagataaaaatagatatagtgtaaacgagctgaaacttttcaacatctatttttactgattggagaattatttatctatttatttccgcttacagctctaaagtgtattatagatatgagagttgttgatctattttgcaatacaatttaaaataatataatcccagaaagattctacagaataatttagtatcctgattatatgttgaatatagccataattttcctaaatagaattgtaatattagtaaatctacatttcagcccatttatcaatacaaagtccaattcgagtggtctaccaaatctaatcaactaaaccaaacctcacattatgtatatttgtcatataagtgcacacatattcaaattgtgtacataattttgccaaacttgaaaatcttgcaaatgtgctttgttgtacttccttatttaaatgtttggttttagcttcttttgcatatcattgcctaaaaataaataggtattatattttatttttcaagagagagcaaatgaatagagttagctttataagggtttaagtcagggacaccagctgcaaatattttgtgcttaccaatgtgtcttctttcctaaattccacttgtgccaacagtgagtaaaatgttctaggatttcctcgcttcttctctctctctctctctctctctctctctctctctttctccccaaacaccccacccccactccaacttccagataaatgccagtcatttggccagggctaactcacagaaggtgcagcaggcacagatggcactaatgcataaatgtaatctagtaaaagaatgccagcgccaaccccgaaaaggttccagataacgcagtgcacttacaggaagtctgtgattggcaaggttaaagctgcaactgtgagagctcactgtctgttcccagatcaacaatagaaattctcaagcaaatgagcatatttaatttatttgccacaaatgcattaatttagatggtattcaaataaatgatatatccttagaaataatactaaatgtggataatttaatttgtgcaactgtcagaacacactcaagtattcatgtatatctgaatagctactgactctgcccaaccattctttatttccttatttttttctctatagcccttgctacctgatatcattatttgcccattaatgtaccaaaatatgccgcctacagatattctcattcatatcactcttcaaattatttcaaatttcataggtattctgattttttttatctgcctcttgagctagaggtaaacccgacaaaaagagagacttgatatatcttgttcactgatctctcacagtgcctggtaatacattgtcaattaaatgaatattaaagaaaataaacggatgaataaaggcactcatacataatatatgcttacatgttaaataacactaatatacatttgaatttattgtatactgttgatatgttatcctgaagattatattttctttcttttttttttgaccaagtcatattaccatactctaattggaatgcccaccacgaaccaaggccttaagcatgcatgttttgttaaattttaaatacaagcaaaatattaataacattaattttggttcataatcttgcctgtatctatcccatggtaaagtttgtttcttgaagagtggcagcaagaaaagagttaaaaatttagcatgtgatggccaggagtggtggctcatgcctgtaatctcagcactttgggaggcgaggcgggtggattgcctgaggtcaggagttccagaccagcctcgtcaacatggtgaaaccccgtctctactaaaaatacaaaaattagatgggcatgatggcgggcgcctgtaaccccagctactcggaaggctgaggcaggagaatcgcttgaacctgggaagtagaggttgcagtgaactgagatcatgccattgcattccagcctgggcaacaagagcaaaactccatctcaaaaaaaaaaaaaaaaaaaaaaaaaaattagcatgtgattcagtctacagagaactagattagtgaaggaggcattgcagcaggagggtagcaactacattgcagaaaggattcccttgcataattatttaagtggctcatcactccttagtggcataaaggagtgatacatttttcttggaaaaagatattccttccaaattctccatcataagcctatttattttctccttaacaatacccccacttaaaataaaagtaatccttgctgcattagttataatggtgccttcccacggtgaaaaactattgaatatcctaacacagaggactgttaagtggactatagtaaatctgcttggtaagatgccaggtgactgctatcatgaaaactacataatataaaaaccaataatggcataatttaaaagtaggatagaaatcagtatttatattgtatggattcaactaagttttagaaaacaggttctgttcaaaaaacaggttcacaaaaaagatcaggtgccaattatttcttctctgtccttcagaaacttttgcaatttgtctttaatatataggtatttgttttgtattttaaaaagaaaacaataccaccttagttatttgtatgctttaccccatctcattccacagaaaaaatctgaagttaccttttatccactgtaatctcaccactgaatcatattgttggaagaaagatattggtttggtttttgttttgttttgttttattttattattttttaaattatactttaagtttcagggtacatgtgcacaacgtgcaggtttgttacatatgtatacatgtgccatgttggtgtgctgcacccattaactcttcatttaacattaggtatatctcctaatgctatccctccaccctccccccaccccacaacaggccctggtgtgtttgtttttttttttttttttgagacagagtctcactctgtcacccaggctggggtgcagtggcacgatctcggctcactgcaagctccgcctcctgggttcacgccattctcccgcctcagccttcggaatagctgggactacaggcgcccaacaccacgcccggctaattttgtttttgtatttttagtagagatggggtttcgccgtgttagggaagatggtctcgatctcctgacctcgtgatccgcccgcctcggcctcccaaagtgctgggattgcaggcatgagccatcgcgcctggccaattgtttctattgttagaaactatgaataaccattcataattctgagttttcttctcacatacaagctgtagcatataaaaatgtgtatataaaaagcaataaaatagagtttctgtgacaagagtatcagtaaatgaccatcaatgcttttgaataggatgacaggaattgtcaagaatgtaggttgtcttttaaaaccaaatctggccgtgtgcagtggcttatgcctatataatcccagcactttgtgggggcaatgtgggcaaatcacttgaggccaggagttcaagaccagcctggccaacatggcaaaaccctgagtactaaaaatacaaaaattagccgggcatggttggatatgactgtaatcccagctacttgggaggctgaggcatgggaatcgtttgaacctgggaggcagaggttgcaatgagccaagatcatgccactatactccagcctgggtgactgagcaagaccctgtctaaaacaacaacaacaacaaaaaaaaaaaaacaccaaacctatcatttaagactcttttgactctttcaccttattttcatcatttataaaatatggaaagtaatagcagcttaccagagggttaccaggagaattatgtgaatgtgcatgaagcttaatgcctgatatatgataaacactaaggaaacgccatgcattgctactatttctgtctaagagatctgaactggaaaatagtttaatacatagacttgttttaaataaaactttaaaatagatgttaggacaaaaaactcctccaagtagtcaagtttcaaaaaaaaaaaaaaaactgtctactcagcagttctttcatgaaggatacacactagtcattggaaagagaccttgtctgctttcaggaactgactttgggccttctgttaagaaaactgggagggatagcattaggagatatacctaatgttaaatgacaagttgatgggtgcagcacaccaacatggcacatgtatacatatgtaactaacctgcacgttgtgcccatgtaccctaaaacttaaagtataaaaaaaaaaaacaactgaataatgctggcctttgctaagaaatttgataggtttgtaacacgcccttaaaattaaagtatatgacctctacaaaggtggagagtttaaaaattacatgtcatcgccccccaactttttttttttaaagcactaccattgaccaattagaaaaagcaccctttcctccaggctggatttcagcagtccccccacccccaccctctccattactccctcattttccacctttatgcaggttataatttgctcaactataaacagcattcttgaaattatttaaagcctgtgggggtatatcatggatcacaatacgaaaataaattagtgacaaagagttggggccagactgtctagagaaacatactgaacatcaaaagaggagctcaaaggccagctgaactggaaaaaaaaaagggagccataaaactggagaaaatgccagaaggagctttaactagggtgaagcctgagtcaaaacattaagaagaagaagcaaagtgcaagatagtacactgacatttattaatataattgcctggctaaggcatgtgggatagtgagaagaaagtcttatttattttggatacagctattgcaatgtgaagaaattttaaaacacttttatacttgaatcaaaggacttggaaatctaagatgaattagcaatggttagctctgcccatttgtgtgtacgttgttggctacttgtgtttggaaggaacactgatatttcacattcattgcaataaaatatagtaaatttctattgtggtccagctgttgcatagctttgttaaagagtgacacttaggctaatgtactctaaggaaatgactccgctcccagtggaatctctcttctgaaacaataaatgcctgttccaacaaaagagcaccttaaactatgattccattccaaagttgtaaaaaaatggaattaattaggatttagcaagtgtacaacctctagccaggagtcatatattctaattttgagatattattcatagttctcaatgcagagagttactacacattatttttactatcagtacaataccactttttaaaagggttcagatgttttaatcactattacacaagtactacaaatgatataattagttgcattcttatttgcagaatatttaattgatctctattcagataaatttttaaatgacaaaatgctatttaactgtcttattttcagacctcctgtcatcagagcttagctactctctttcaaaaccattactattctccttcacaacctagcactaaaactggttgcactgcattagaactctgcttaggtacttcctatgcaagttttctccttcatctcacaaccaaaacctaaatgaacaatcaaaacattctcacatttttctaattctccaaaagtttccttttctttcaaggtaatttatgtcctcataaaagcttaggtataattcctgatgggagaaattagtgaaatatttcaacagtattcaagttggtctcagggactgggaaataatgcaaaagaaataaaaaaaatcctttattaaacgtaaaagggaagaagaaaagactaacacatgaaataattagaaaacaattaatttaaaaattactgcacaatatttaaactaattcactttaagttctgattattaattgcactatgggttataatcaccttttttgtgcttataatcattcccacctagtacaatggtactacactagtagtaccacactaaaggtactacactctaccactgtactaaccaatggtaaaaactacacttatattttctatttttttctatcacttgtataatgctaggcagaaagtcagcaagcaatggataattgattatgtattcattcaatcattttaaagcatttttcattttaatctttgttgcaaagaagaaaaatgtattaataatttttacttttaataaatacattagcattaactttatacagttttaaaacactcataaacttaattaagcttttaattcagttataaataggactcattcactgtattctcaacagtagcattaaaaaaaccaggtgcctatttcatattcttaatgaagcaattgctagcaataggaaaacctcaaaagattcacatttggctcaactaagttccttgaaaattaattacatataatcatttaaaacagcacaaaattgagcagaagaaaaaaaatttttggaagaatgtttgtaatatccataaatgtttaggctagtttggctggtttctgattaactgcatttggacatatcttcattgaaagtttcactgtaacatactcacagaaagctttttatctgcaagtgactttttgtgccacttgcttgggccactttttcccaactctaatttgcaatttgtatctaccctgagagaggtactgtctatcagggtatatagtaccatactcaaacagatttgttccgttatctaaactagaaataaataaatcataaaatgttatgtgtcactaacaaggtaacaacttgaatgcttatgtatatattgagcatcaattatgtacccagcactgtgatagtgtttttaaaaccccctaagagaggagccaagatggccgaataggaacagctccggtctacagctcccagcgtgagcgacgcagaagacggtgatttctgcatttccatctgaggtaccgggttcatctcactagggagtgccagacagtgggcgcaggccagtgtgtgtgcgcaccgtgcacgagccgaagcagggcgaggcattgcctcacctgggaagcgcaaggggtcagggagttccctttccgagtcaaagaaaggggtgacggtcgcacctggaaaatcgggtcactcccacccgaatattgcgcttttcagaccggcttaagaaacggcgcaccacgagactatatcccacacctggctcggagggtcctacgcccacggaatctcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagacagactgcctcctcaagtgggtccctgactcctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcgatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctcttggcagaaaccctacaagccagaagagagtgggggccaatatacaacattcttaaagaaaagaattttcaacccagaatttcatatccagccaaactaagcttcataagtgaaggagaaataaaatactttatagacaagcaaatgttgagagattttgtcaccaccaggcctgccctaaaagagctcctgaaggaagcactaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacatggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagacaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaaccggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtatatctagaaaaccccatcatctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggagacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaatgagtataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaataaataaaaaataaaaccccctaagaatactaaataattgtttttaagcaaaaacaagaaatattttgatgtctggttactgctttatctagtttttaatcataaatgactgccctatccattcctcatttctaggaactggatatttcaacactttgcaaaagttatcatgagtttgattataaacataattattgaccatttagatgaagatgttgaaaaggaaaggacactgaacaaaatggcaagttctcttgctaagtctgaaggcagagtgtcattcattcctgagtttgaatcaagctaattaaaaccttccagaggctttgcaaagcctaatatcattggtagtgctgctcatacaaattacaaaatattttactctagaggatatctttgtgaagcagagaacagtgacagaaaggcagaagaggcaagagctctagaattcaagtctattaaatgtactctaaatgcctctgcattttcatgccaagctctctataactaattcagcccctacagaaaaatttaaataatgctgaaaaagtaacacattacattaagtattgctactttgttatccattgtgactaaaatattgtattatatataggaataattattactgttatacttattaaaaaccattaaattacaagaccattttaaactgctgtagtaggagaaaaatgttcagatttttacaatatcatattctggcaccacaccaaaaacatgatgtactgcactgcttgggggaaaaatgtgaacatgagttcttatacttgtgtatagttctaatttgtgtgacaaataaaaggtatttttttcagcattcacaataaaaaaaaattgcctatactatgcttgtcacaatataaaagtaagccattggtctaagctgtagcccatatggttggtacacatatatttgtgagtttggtacaacatgctttgtgctggcaattttaatttcaatagcccattaatcttttaaatacattaagcatgtccaccactgctggcagactcttctgcccttttgaatctcctttctaccccaatgttttctccctagagtttgagctttcagcatacaaagtgacgcctgcgaacaggaagataaagaaatttaattaaaattacagagttgttttgtaattgcctaacaacacttcaattttctactctaagttttctaaaatcaagcataaatgcatttgaagcagaaaaattcatgtttttaaaaatattacccgaattatttaactcatgatctggggttgatttcaaacagctttactggagatagattcttctataccagagttatttaactaatgagtatgatgtgccttttcctttctgccacatttcttatataaaaaattgttcactgaaggcaatggtgagaaagcaaatatgcatcaatttcttgcccaatagaagaacactaagtaggttaagcaatatgtacaaaaatctagtatggaaatctcttttttaggaacatgccctaagttttgttatttagcaatagctaacctaaccctggaataatcttatcctttaaaattcccatttcaatttcagctttcagattttcattgcaaccatcattcatcttacatcattttattagaagaaattcactgattgtttatgtattgttatcaatggctaaaatagttcttatgcatttactctatgccaggcaatcttttaagtgtttcacaggtattaacgtatctaaatctcacaaaaaataaagcagggagtttatataacataaaataaagctgaaagaaattttatattttctgacttgagagctccaatacaagttgaaaccaaaatacatagcttttgttagatacctttgtatcacagccattcagaattcttttatagtattcatttgacatctttctctagaagatttagtcatcccacctctgatatgatgagaatggatgaaggagccccacagagtcagaaaggtctaaattaaaccaactagaatctaaatcaaatgtattttagccatcacaatatgccctactttaatatatttgttcctacaaataaatatatgccccagatatgctcactgaataatggtcctaaatttttttttaaaaaagctgaaagcagagaaagtaagttttttcaaagtagaagatgtaaaatggtaaaatgtaagatgaaggtgacagagagaaatagagatacaaatttttgaattataattgtaagcatggtaaaactaataataacaaatatttattaaaaaccttccaagttttagtcactgaactttatgctttattatctcatttaatcttcaaacaaccacatgaggtaagtgttgttatataacgatccccatttaaaatatttaaaagaagaaaaggaagtttagaaagattgaaaatttgcttcaaggcacaaggttagtaaaaagtacaaccaggaattggaatctaggtatgccaagatagtaacatgggttactaagttaggtcgtgtgcctctgcaaacaaactctaagacaaagatttgtgtgtgagaagtttaatgaggtaagttttcagaaacaacccatttctgtgaaatgcagtaggatttggcaaaaggagaatttggactgtgtcacattggtaacagaggtctcagccaatcccgggtaagctctggagctggaatggcctttcaagctattcttaattagggcaggaggccaaccattgcaatctcacatcaatcaatcattgaatatgggcagccccaggcaggggctgtaatcttgggtggaggggaatttcctgaagaggggctcaactgcaaattgtcagtagccaactcttctggcatgagggaatgagtgtctccatcctgcaggggtatctggtagcacatcatagtacccactacagttatattgtatcaattcgagaaaatcaaaacacttttaataaaatacatttataagaaaaacacgaataggtgatgaaccaacaaattctccctgtttttgtttttaattggagacatttatttgtttagaatggttgctgttacctaaagttatagaaaaatatataccatacagtttatatcctatgagctaagggtactaatcctaaaaccttaggctctagataacatacaaaacagaagggaaaccatgctttatcttttcttactgaagatttaaatgcccatgtaggtaataatccaaattgctgtgaatctcttctgtgtttaagctacctgcttcttttggccagaagcaaataggaacccagctgtattaaatgaatcaaagtccttacttctcagtcagacgaagctgttttaagggcattaagataagctactcgcagttcttcagttcttcccattagaatagttttccttcaaatttaaggctaaatgaaccatttatcagtttttaagctagttcatgtaaacaggaaataaagttttcataagcaaaatatgaaattgaaagaaaaaagtaattattctgctttgtattgctaccccctcttataactgaatctgttcttgcatgttagttcagtgaggtaaatctgattatttgggtagcaaggtcctattcacaacaaggattggtttggcatgaccatcattcatattttaagtgctacaaagatgaaacagcaagacaaactcatagtgttaaaaaaaaagttttttattttgccccagcagaacattttctgacctatagcctccaatcaccctttactgtgggtgatgtcaaaaacacttactgcacaagcagagacctgtgtttcctttgccacagacaataaatctttagtgtcttctcctgatacgcatcactccacttgctctcaagaggcactatacatctctcttgcctttcccctcactaacaaggtcacttttgagtgataacacaacttattgcaaaaatgtatagacatgcacaataattagtatccacttttaagtaccttgtcagtaaatattataaaactctggaaaagacttcttcccaaacataatgtattcataaatttaatttcacaaatatagatttgaataagcccatgtaaaaacagattttggccctaccttttcattactgttataaaattatactttatccagaaggtatgtatttgagaaattaattttagcttcatagaaatctccttttcgagtaatacaataaattgctagttgactgtactcatttctagcttgcaaaaccaaaactttttcttaattaatgatagaaatagtggaaaaaatatgtaagatggaattattttttaaactattagcgtttcttaaccaggattccatgagtacattaggactgagtgctcaaaggcatctgttatatattaaaaactaacttctcatcaaagccttatgctagttatgtggcatccttaggagaattgggaaaataccccctcaaattatcttctctgttttgtggttcagataagaggacttggttgaaaaatgctgttaaaaagagactcaggttatataactcaatcaaaaccaataagcacgtaaatataaaagctgacatttgaatctgaacttttgaaaataaagctgaagtcacataaaaaatacaacacgtgttactccaaatttcaggcatgacttattttgttttcttaaagtgtcaaattaagatacacagaaattcagaagcacattttagattaactcatctaagtaaaataaaccataacagatgcctatgaatagggttttaagcaaaacaaagattatacaaatctaaaaataagtctcaaccttcaatctctgagacaaagaatttctaaacccattcaataaatatacaccattatgatgacttaaattcgtgattaaaaccgtgatggaggtttcttccatttccactttagtaacttagcgaattccctgcctgtctgtctcctgtctctctttcaaactaaatgcaaagaaggagaaggaaggggaggaggaaggaaaggaggaggaggaggagaaacagaaacagagaaacagagaaaagtctctgtaggtaacctagatctttgaattaaagcaaagtctttaatgtaggcattatgatatgctctgtacatgatttaaacactttgaatttcatcatcatcatttctttgagtcagcactattattcctttctctgatttctcctttagctctccaatatttttaacaggataaagagactctaaatccagtgaccatgctttatgttcagaaaatattacctcttaataaatgtctggctattattataaaactaagaagaaaaatccttttaatatgagtggcagaatgaaaattcatcaatttaggtataaaatgtatttgaacattataaaaaaggaaagacagaggacgcaagtacccacaaacaggatgagaacacagaaataacatgggtttggcacattatgacatgatgcttacatgtttgggatgactaagagttatctgttaaatagagggtgacaggtagtaattattccaatgcaagacattgaacactaaacaaggatggctaggataaagtgtcaaatgcaggtcattaatgatgacaaggactggattcagctgcagcagctgtcactgtcccaggtgggtgaccatactgtcataatccttatcgctatggtcttcctggaaaagtacaggctaatatggcaggttaaaaaagtacaaatgataagtattgcttacagaaatgtactgaacaaatctcagtgtcttcagtggcccaagaatttatttcttggtagatcatctttttaagtttctaactccaatgtaagtgaagctttgatgtcaggaagctctgagtttaaatgtcacaacttaccagctgtttaaccttttttaacctccaacatacatagtggaaagcctacttcatatgaggattaaataagaaaaggaatgcaaaatagatggcatgtagaaggtatggaataaattttagttttctcctaagccaagttccgccctgaacaagttgatcaaattttacctaaaattactttctgctagtaaatacatttcattcttgcaaatgtttgctgcaaatacatcagtttacaaatactatagtttattaattatcatccaatattttaaaaataaagtatataactgatgattatatttgaaattttatgattaagggacaagaacagctatcatatcaacgttattgtctttgaataataaaatctataaaactattagaaaacttcaatttctaaaaatttctgactcaatatttattattttgttcaatatctgttcacttcttttaaattaaatagtcatcctaaaaccactgaatcatcaatcctaaaaaagttgaagaaatacagcccaaaactactatatcatctctattcatattctttctgcagtctacttaagaatttaatagttactatttgtgctattcctcacaaatgtcattatttaacacccatttttcagatacaatggcccttaagaccccatagaccctcatctcttagttattacccttgtcgatttacaaaaacctccaccattttaggaagaaaaaaggccacatctccagtggctacaaaagtgtatctcttgaaagaaagaagctatgaaaatagctgctgcaatttaatagcttcaaaacatttcaaaccaaagctactatttcttctttcccctctccactcccattgtggattattccaatacttcagtttttgtacattccatgctatcaaaaatggcaaagaattggaaaataacattatgccaagaagacgtcaaggtgctatttcaaactttaaaaaacaaaacaaaacagatgccacttttgacccatgagagagaaaatattcattattaaagtagaccagactgttcctcagtcccttaaacactctacagtttgaatgatcaaaaaagcctcttcagtgtgcatgtccaagcctgacgttcctgccaaatccagtatttctaactttctactgagcatttccagtattttctttcaagctgaactccatggaaccagcctcaggttctctctcctctccctctcttctctgctacacacctagctccacatagtaatcaagtcctgctagcatccccctttcaactcagattgtcccattctgatggagtgctactgtctcatgggggccctaacaaggtggttcctgcattagcccagttgccttctgctcttaccttcagtccttctaagagtatactgcctgtcaccaagataatacttgtaggaaaacaaaataaaacaaacaaaaaacccaacttgttttcatgaagtcttagtacaaaattagaaaacaaaattcaataaaatatttttgtttgatgggacacagatttatttaaaattttaaagttgagaaacagcaataaatatttgttggacattcatagctaagtgctagtctaatatactacattctccagaactgaacaggactctgctgggcgtggtggctcatgcctataatcccagcactttgggaggctgagggaaggggattactcatggtcaggagtttgagaccagcctagccaacatggtgaaaccctgtctctactaaaaatacaaaaattagccaggcatggtggcagctgtaatcccagctactcaggaggctgaggcaggagaattgcttgaacctgggaggcggaggttgcagtgagccaagatagcgccactgcattccagcctgggggacagagagagactctatctcaaaaaacaacaacaacaaaaaaaaaaaaacaacaaaaagaacaaccaaacgggacttagatttattctctattatttccccacatatagctcaaaagttgctaaagaaaataattgaatcactgtcccagaacaaatgtaaatgttcctactttctctacctctacaaatccttcaagattaactcaactctctcttctataaaacctcaccttacctcttggtctgaagtattcttccttaataactcaaacagcaattaatgtccagacaattcatttagaaattaattaggcaacacttttgtgtaatctcttctgttacttccttgaattgatgtttaaatatttcattattttacgttgtatatgtggattgttgcccttttgagtagattacaaacttgttgataactatgtattaaatattttggggtttcaaagactgcctgaaaatagtgggtactcaggaaaaaatggctaattttattttatgcctatcatgtcctaattctagcaaatttttttaaaccaccaaaattatttgatgtggaattataattgtggagttttcaaatatatataataggtatatataaactatttgctgtttatatataaatatatatcatatatataattctaattagattagattctaattagaatccatcttgactatacaactggttttatcttctgtttttatttgttaattgcattttgcttgctctgctttgggttataatttttgaggcttttctttatcccccactacatctagactgtaataaattcctagcaggtagggattatctagtattcactagattttttaaagaaaaaaattttttctcgagaacctgttgataacttgtagctcattttcctttgtctaatcttactagaaaatattttcaccaaaaatttagaaaagtcagaaatgtgtttaaatgctcatgtgttaaatgctccaacatgccaaaaagaaaaattatagcacttataatttaagttttaatattcatctgtaatcttacagagaatatgttgtattttcattaatactattaattaatccaaaatttcacttgtttattatttctaagatttcagaaacaaagcagtaaatgtttataaatgattagaaaaactgtttgctctaaagagtataaaaagccttaaaatgtagtttacatgggtatttttcttatgccttcagttataaaaaccatcttattattattaataatagtaatattattattttatacaacagagagtacaaagaatgatgccctaggaataaaggaaacctcctatttcttataatttgataaaactttctttctcagcaaaatattatataatattagcatgccacaacatgaaagtctttcaagatgcctcatctaaacaacaagttctatgacagctgtatcatggggaacccttggcccctccatgtgaaatagggaatgtaaggactgaggtgtctaccacaggacctagtgttgaaggcaggcagactgaagaggaggccgacctccagatgctcaaccctcagttcccagtactcacacactaaggatttctcatcaaaaaaatagctggcagcccatttgcctcagttttcactaacgtacctgaagagatattaagactttaaaaaccatttcaggattgaatttttgtaagatgattttgggcacactattttcagatacatcaaagaataaatttgattagtgaaatcagttgctccatagatcaaaataagagctcaagctctcagaatgatctgggaaataaacagtaaattcacagtaaatttaacggaagtctaaaatgatgaaagattctgaaaactagattttaagagggaattataaataataaattatgactgtgccaacagtatcctaaactaaaaatgatggcttttccatagtaaatctgagagctttgataattgaaatatataatttgggattgtgtcataatcttagcctccagatagaactccttttgctttgattttacaggttagaaatgacaatcaattttaatattttaatattaagactaacatgttgatttattttctaccactaattatatttcttttttttaagtaaagtatataactttataattattcttaagttttggcctctggacaatatctgtaggtgcttaaaaatcaatccacaaataattttctgacgccaatatttacaataatatgactaagatacttaatatttatgttttgtatgtattatatttaaatattcactagtgattcctatgttacaaaaatagttcactagtacttctcatttatatgttggccttttcaattttattgttaaatttttcttaattcaacacctgggcctataacatattaatataactaaaacactaaactctaaactgctgtaaattttctggaaaactgaccaataaattctgaaacataaagcagaatttacacgaactaaatttttcaataacctatttaaagttagagttaataccacttattacctacctacctgcatgaatctggcaacttgagatctctatatagttgttgtttgtttttgagacaaggtcttgctctgttgcccaggctgaagtgcagggtcactgcagcctcaatctcttgggctcaagtagtcctcccaccttggccttctaaaatgctgggattacaggtatgagccaccatgtccagacttacttgacattttaaagtctcagtttccttatctttaaaatggcaataaaaatattttactgtgagatgttttgataattagagtaacatgatacatgtttgaaatatttgaaatattaagggcctaaaaatttgtaattaaaaactgggcccagtgacaggcatctgtagttctagctactcaggaggctaaagtaggaggatcacttgagcccaggagttcaaggctgcaatgagccttgtgcaatgtgccactggactccagcccagatgagagcaagaccccagattttaaaaagaatgaatttgtgattgaaataatattaattcaggattttgttctatttataaaaaatatctgaaatatactttcatctaattaataaagaatatgtcatataagaataaaatcatgatctgtactgagaggttttttaaacgcattcagaagccagaccggagggcagaggccagaggtcagaggctagacaagtgttatttgtcatctagttagctgcaggtaaaaagaccacttaataaaatgagtctattaggctgatttaagtaaaagtgattgattttcatttaacatttgtccattattgttaggtcaagttggaaaatcaatttcaatgtgacccaatgggagaacagttccagtatctatatgtgtttaatgacaagaacacattagtactcatttgcttataacagtattaaatgatagcttgtgtttaaattattttacagttgtgacacaagacagcaaaatacagcatatcaaaatgacaatggagataatctaatatcacacattgatctcttcttattttgaaagaagaaaatcagtgagaaatagacaaattttatagagaggaaactggaataaaatttaaataaatatacagagctcttaaaatctgtatttcccttactctctttcatatgcagttattttcaaattattttaaagtgtaaccagtagcaagatatccattatggatctagaatcatagtatttttatagtcccttgaacatattttcaaatactatgcagaatatatgccatttttttagtcttatagtaacttgtaaaatatttatttattcattattgctggcctcatgaaatgtctatatactaaaaaaagtatgaattaatttaaacatattctaaacaataagttagaatttccacctgcatgaattattctgttcaaatattgttaaggcctcctctctgagggcaatgtgcagggttttgggaatacccttatgagcataggaaaaatatcatattcatagagctgggttggttgaaattagatttttttaaaaaaacaagactgctagaattcaaaggtaactttttgatcatttatttttctatacacaaatgagaagaccgaagaccagaaggtttagaaaatttgcgccggactgaagctgataaatgacagtatcgagatcccaactcccctgactcccaatgcagtgttctttccaatatgccaccaagggctataggaatagctctaatttttcttccttcctataactcactttcccagctcctaatctcttgcataactcaccttctcagctgccaatctcttgctacagtttgaaaagcaatgtgcaattcctggaatatataagctagttcatccctcttgtgcttttgaacacgcttgtccctcttggagagaactgaagtagggatggaagttgcagtatacgaaggggttgaattacacaacttctaaggtttcttgtgatgtaaaaattccttattctgtataaacttgctgtagaatttattgccacttctaaatattaaatattatttatagatgcctatataattaaatgtatgttgtgtatgtgtattatagagtaatatgcatgcattctgaatatatgtcaaatatatgtgtatcagtaaaaacacagatacacagttgataacccaggcaccagaagaatcaggttcaaaactgaaattcaaaagtgcttccctacatgtataattgccctaagtcagtcagttattgcctgaataggtagaggaatcaagagctgcactgtaaaatgacagcatggaataacgagcgttcactggattttaaaacctgactctcaatctagattctgttacattcggcaatgtacccttgggaaattcaccaatcatctctagatctcatattcttcatctgttaaatgagaacagtatgacaccgactcaacacagataggacaaaaatgtgataattaaacatacataagacatagtaggtgctcagtgactgttagctgaatcggagttctgacccttctctataaaaataaagtatactcccctctcctgaaattatgagttccctcaacaactacaataccttgctacctcccattagacacaaacatcaccatgcacacaagtatatgcatgcgcgcgcacacacacacactcatagaagcattggaagtattggaaacccaagttttattcccaagaagcaaggaaggagaccccgggcaaatcaagaaaaatagctgaagccaataatccctgtttttcagttaatgaacctaaatttgtgttctaaaaaacagagtggatttatattaggaaaaaagtgttctttcacctaagaatccacttgaccacttgacaatccaccaaatccaccaatttgaccagttatatcacatataatatgacctgctatatcataatttttatgtgattccttttggagcccataatgaaagactatctacaaaggcagaaacattgagatagggctaagctactcaggaaaacacatattatttccattccttttacaaatttgagaaccctccaagagtctaattctaacttcttttgcatcatgttattgtccaattcaaagctgttattatccacagactataaataaaatctaaatccttaatgcctgcagatttttgcatcttcaataattaattaataggtacaaaaataaatgggttgataaatgaaacaaatgaacactgtttcatttgtatgttttcctacttacatttaaagataatcattaaaggaagaaaacattgctgcaaaaagaaaagtataatgtatctcaaagccaaatttgtgattttaaatttgtagaaaacttaagaatatctaagctactgattatactttactactgaaatttacttcactgtcattagaggtaagatatatgtgtaaatactaaaataattcagtgtgctctatattttcatgacagagcttttctttttattttgtccaaataaatggagaacatgagatataatccgaaaatcatacttttgaagtttagagccttatctgttttttaaagatttccccttgaagccattttttgtggccaaaattctcataaacaatatggttagttgcaatttcacattgaaaaatatcacagaataataatatagacttaatggtaaaaaggtattaactagacaaacattagtggaacagcaacgcagggaggaagggaaggaaaacaaaattttaagaaaagactgtttagtcatttcaagtttcaatccgtttacttccaagtgattagggctgcaatagtgaaatatacaaccttaaaaacataatttatagtttattatttaaatgacacttcattttcctattgcctgcaaattattaattaaaataatatctcttccctattcttcatcttttttccttttcttttctgtctcattttctagctcttgattctctctccttctatatcacctcataatctgatgtttcctcttcagtgaagtattttgtatgctggtaaacatgaaagtaatattattcagatttactgctgttgctatacctagggattttatttgaatttattggtacttgtctatcattcctaactgccctacagtaactgtcaaaaggtgaagttctgaatattaacccaaggaaatatttgaaatatgtaaatgaaaatattttatcacacacacacattctctccttcctaaacttcttatctcataaaagagtatctgatgccagagcatgaaaagtgtattaagagcttaacatcagtattaataactcagatttaaaactcttagcaattaattaagattaatgacagaagtcatccctttttctccaatgtaacacttcctcacatcttttcaatctctcattcatgagcccctccatgctcatttcaggctgtgaaaaacgaaggtcctgaaactttgatcctgttatctgctgctttttgtatctgagattaaggaagtagacactggcaaatttacaaccaacagctcggacagctgtcctactttaagcagttaatggaaaaggaactaatctagttaagagcataagactagttcataaatctggattcggaggacagttaaaaccgtcccacctcttctgaagagtagtaactgaattaaattctcttctcactgtttgttgagaagagccagtgtttctgtaaactggactaatgaggcactcagagctaacataagccacatataggccagcaccatagatgattatgcaaaagattaattaacattaaaatatatgatttggctaggacaaatacagatctcacaagaattccgatcattgaaaatttttcttaaatagaatatgaaataaagatcaaatgtttttaaaaaatgaaaaaaatgcaactgcaagcaaaaaaaaattctgaaaaagacaataaaaattaaaagccttcatttgttcaaaatttagcctaaaggaaaatgattgtgttatgtttttataattcagaaaatgttcaatagatttaattataatttaaaaattaatcatccaaactgactaattttagccccttataaataacatttttttgtatcatcatccttagccacatttttgcagaaaataattcaaacgttaaatttcagaattgttctgtcttatttttctcagtagcttaatttataagtagtaaaataacaagtaaagataacagaaatgtttaaattctacaaattcaaatgatacctctcttatgaatcactaggatctaatgcacatattaacttataatttatattcttaattataataaaactaagaggaactataatagacaaaattctgttcctcaaatcaatatctcatgcatatcacagggtaattatgttatctgatggcataggagactgtacccagaattagaaagttaaaatcttgaccctgctcactgagctgtgggaaccacaatggtgtgcttaagtctagtgggcctcagtttagatacatctggtgagggatagagcaaatgactgagagaaaagttatataactacaatttgaaagacatacatgaggaaaatggctaagtcccgctaaacacagataatgtagtgacaacagggggtcaaagcggaaaattcatataagctctcagagacatgcaagtggaattcaagagggaaggtcgcattgtctaagaatgatgtctaacgacgtctctaacaatgaggacaaagcagtggaagcctcaatcaatgttaggaagtcagacaagggagagaaatgaaagaattagagaaagataatgggagagtaatccctctttactccagaaatttatctgtatgctacgtatgtaaacatgatatttgaacgttttattgaaatgttttacagacttactaactcttttaggcaactaagatttgagatgggcatatgtgcatgtgtctgtgtgtatgtctcaccaatctgcactaggttccgccttaaagctatttaaataaaataaagtgaattcataattaactattaagaaatcattcatgtcaggaaatggctctagaaaacaaaagtgcttgatttaaaaaaattagaaaactctaatatgattcaaaacaaaagtatgcttagtactggatatgattatgaaatttaatatatatgatgtattattttcagtatactaacctgcttactaagaagcattatgggaacctaaagtatctttctgccacattttccaagtgaaaagagctctttaaggagaaagagatgatgtatatcagagaataaaattattgtgaaatggcaatgagtttgtagaaattatcccaactttataagttttttaaaagcataaggagaaaaaaaacttgtaattatttgaaactaagaaagtgttaacccaaagccagaaaaaataaaatggtaaacaaatgtccaggggtattctttcatttctccttattttctgtttccttctctctttttttatgttatttgcaaagtttgaaaaataaattatttttattttataactcaaaattatatcagtttcaaaattcttaaatgttagaggttggaatttgattcagagtacaattagtggaaaatataaataaaaattatatggaaaaatttttaaagaaattacttagtataattattactattgcatactactatatattagcttctatgttatacaaatcctagtgttttatttataaataaaaatgagagatatttagcaaagttgaaaaggcatttataagtacatttttaggaataaaggggcaataaaagcttcctactcaagccaatttccttaactgagttataaagctttccttaaactaaacttataaatggggttctggtagacacaaaggcaccatcataatgcattctatttaagtaacaaactgtctacaaaaaagatgcactgtatccccccttggactgggtcttctgagctctaaatttaaaaatgagtatttaacacatgtagaataatgtagatttctgtaaattattagaaattatagtaatttatttaaatatatatttaagcctctgtaataaaaagtatataaaaaccatacataaagtaaccaaaaaatggaaaataaagcttaaaattgtatctgtgttgacatttctgctccccattggatgatttaattgattctacatcacagccatacgttgagcctcagaaaataatgtgtttagtcctggaccaccaagacattttgaaagtattctttttttaattattgttatttttttaagatgggatcttgctctgtcacccaggctggagtgcaatagtgtgatcatggcttactgcagccttgacatccctggctcaagcaatcctcccacctcagcctcccgggtagctggtactacaggcatgttccactctaccaggctaatattttgtttgtattttttgtagagacggggtctccctatgttgcccaggctggtctcaaactccaggactcaagggattctctcatctctgcctcccaaagtgttgggattgcaggtgtgagccccacactcagccaaaagtattctttcagagtgccaaagctcactgatgatgatgaaaagaagttacatttctaaaaccagtgcattgagaagaggtatttacactaatcattttttgtttcttgtttatcaaaaggttgctgatgaaattttactcaagataaatatttatctaaacttggaaattaatacagaaaatgtatatgactccactaaatagctaataatgcctatatggggaggggagacaactaagtacccaagttctgtttatagattctttgaaaaaaaatatattttttggtaatttaaatgattaaattttgcatattctgcatttcacttcaggaaaccagactgagtcaacacttttgccaacttatatacctaattaagagattattttattgaaactaagaaatgttatcaaaaagcattctatttcatgaatttgttattttccactgaaacagttcatgatatacacagtgagcaaatatgtcctataagaatatatgcatatatatagttataaacatgctatatgcacattcatatatatatacacactctcctaaaacagtcagtgggatagtagtaaaaatggcatgttcatgagatggattattctagtaaaaatttatctttcaaatatgtataaactgaagttaattacttccattaatttaaatggaatatgatggtattttaaagacgccctgaaaggtaaaggccaaagataataataatgaaagataatataaagagcggaaaagactagtggtattcttttccagctttgttgcatcagaatcgccctaaagaaactataacaaatttcagatcttatagaaataaaaggtaaacaatgggtttacagtttttaaacatttttatattttctactctgtcactttaatatataaaaggaaatgaatagaaatacatgggcattttatacatgataggactgactcaattaggctacaataaagggttattttttctaaagcccctaaaatctgttacaaagttcagctatatggcacaaaatatttggatggaaactaaaaactaaatttaaaaatgtagccctttttcaaaacaatgatttttggggtaataatattgagtagcccaggctatcaatatacatatattttaatgattttttttaagaatgcagtcattagcagcataattctaggtactgaagacacttgaagcatcaaatcaattgagtgaaggttccaatctgcactgaaagacccactagtggttacacttcgcaactgtgatgggaacataatggcagtgtgatgcagaatctctaccatccagatgcttattatatttgaagatgacatggtttaagagtgccaagcactgggtgatttgttaacataatggagtacaaagccatccttgagaaggttgtaatcatttaagaagccaccattaaaaagggcaaggccagtgtgagcctgaaaattcacaagcaggactgaaaggcacgagcataaatttagaaattagagatgtaaacaagaggtagagcccaaagcctttgcctttgacgttatcaggattctcgggtcccttttaaatgaacttgtgcaacctgtcttctctgatatttttgtgggttttgctgtagatttaaaaaattggaggattgagatagtgttctgtcagactgaatattcttgagaaagcaatcgccgtcaatcatttcaaaaaaacgaaattacatctgcacaactgacaaaagtcctctcaatatactgaaaaatatttatgttgcttatttcaacaagacataaaaactttgctacatactaccatctgccctttggccattgctccctggctacttccctctccaaaggatacttttgagtcagcatctctcctttttctcaagaaagggagcctaaattttacgaatgataatattttacgttactatagaatctttattatcttaccattcccaggagctctttcttatcaggataatattgtaaccaattctattatgtcatatttacgtgtgcaaaattaaggagtttttgcagtatttccattgaaaagtcaacacattcttgaattttttgtttctggctgaatgtaggtagtagaggaggagaaccgcccaaaaagaaaatgtttgtttacttctgacttaacattttattttttatatgtaactataggaatgaagtctttatgaataggaattagttaaagtcaattcaattttgtaaattttgttttagtaaaaaattacatccatcggcaaagatttaatttaatttcatctccgtgtaataagaaaccttaaaagtttaaaaacaaatggtggatgtacttgacgagtgttactaggattcttcaaccgctgtatacacacttttatgtctgcttgctggtgaggagagactgccttctgaaggttaacataacctcgattacagccaagaagctccttggagatttaattggtttgtggaactactccaaaactagtgctgcgctttcttctttctttgcctttctgcttctctaactctctcttttcaaatcaaaaaggagaacgcatggtaatgcatcatttataaattaccttgttactgcgaaaaacaaaacactgctttgaaaaccaaacaaactcctgctgcggactccggcatgtttgatggaggcctttcaaaagagtccacggcttaatggaggttgtttatgtggagacttcgatctgtacctgctgtcccctgtcactccctggaaacttggcggcagatgttgcagcgttaagttgtctctgaagtggctttctgtcctcgtctccccaccgcaacggagtcaaactacattagatctcttatttgtgcctaaggcaagtttgggagcgcagctgtgtccaccccgactcctacctttggtgtttcaggcctccaggcagcgagagtgagaccaaaacggttttgccgctctcaactacctccgctgacaatccggccgctagctgcgggatggggaggccgctgccgccgctgcaaacagatgtcagcgacaacctgctagcttacacctggacgcgcggccctcacctcgcgcgccgcgctgaaacattcatgtctcggaggacttcccgccgcaatcaaagcccgggcccggcgtgcggcccgcggaccccgccacctctgcggaagctggcgcgcggaagagagcgcgagagagggcccgagcgggagactgctcgcccgctttgatactttctgcctgaacttcaattacttgatcaaggacttcaattcagcagtgaattcttccacaaacgtgcccggtgcggcctccgagccataagagccataaaaggggcgcatttggctggaaattcaccgtgacgggactcacagagtaaatgcgcgtgactctgggttgagttctaggaacgctgatttgtttatacaactaaacttgagtttcaagcggcagaatctgcagtaaacaattataaataaatgacaagattgttttcctaggtagaaaacatgctgttgactaggcagaggtcgtgttatttagaaccattagccacaacctgaaaacagctgtgttttattgtctctcaagtggcatgaagtttgttttgcctttttttagagtcactattatctcctttaaaaaaggaagcattctcatttacttcttgacaatacacatcaagttccatccatttctaactaaaaaaattgtttaaactcttcctgatttctacagtttaaaaattgctttataagcacacacatggaacttgtatacctgtataaatacttcataagaaccataatcaaaagtaaatattatgcatatatacacacaaaaaccattatgagcacagaacacacaggaaaataaaattatttgcaagatatattcaccaatttacatgttgataagaaagtttattttaaaaagaattgaccttaacagacaataacatttgttccagtgaactttttgctatgcatagacaattcttttagagggaatcagtgtatctaatctaagctgatacaatgctatttacaaatttcctaatattcctaatatcagataatttgttgagaacatagatttgttgatataaaagtgatatacattttcaaagggcaatggacatctcttaaaaatataaaatctttcatgaattggtctcagttcaacgtttttcatttaatcagattttgattgacattagggatgtaaatttgcaaacaataggatttcacccttgcttagagcccaattgtaggtatatgtgattatttaaagctaacaaaagaactccaggactaatttttctcattcaatgaatgattatgctaggacttagacacacacacacacacacacacacacactactctaaagacaattcattttctcctttcttgaagcaaatataaatgtaggtagatagttatttaaagaacagccagagaagtagaggatactaccacttgggcatcgtagtcccctaaattttaattttctttagtacatgtaattccatgagataaaccacatctacataaactaaattggtaaaaaccataaggttcagtaactttaattttttaccaactaaccacagtaagtagaaggtagtggtgagctatggatgtcttctcgtgcatagataaagcattaccaaagcagatcatcccattttaatatgatgcatccaaattagctgtgccaaatatactctaaattcctgatactcttcctgcctctgcgtcattattttctgaataggtaaattactgtaagttccccaaatgaaagatactctaaagcaaaaaagaactgaaatttaagaaatattatgtgctctttctataaaatagaaataaaatttgtaggatattagagtctcaatacagattatatcactgccccatgcaaatatgattttatttaaacaaataatgaaatattactttttggataatactatttttatgtttacattattttagagacttaaaaaaatcactgaaatatttaccatgattaaatggcctgtgattgctgcacattctttttggcacaagttgcctttgtcaatcaagatatttactgtgctggcgactataagaatagggcgtccggggaggagccaagatggccgaataggaacagctcaggtctacagctcccagcgtgagcgacgcagaagacggtgatttctgcatttccatctgaggtaccgggttcatctcactagggagtgccagacagtgggcgcaggccagtgtgtgtgcgcaccgtgcgcgagccgaagcagggcgaggaattgcctcacctgggaagcgcaaggggtcagggagttccctttccgagtcaaagaaaggggttacggatgcacctggaaaatcgggtcactcccacccgaatattgcgcttttcagaccggcttaagaaacggcgcaccacgagactatatcccacacctggctcggagggtcctatgcccacggaatctcgctgattgctagcacagcagtctgagatcaaactgcaaggcggcaacgaggctgggggaggggcgcccgccattgcccaggcttgcttaggtaaacaaagcagccaggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgactcctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcagatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgttgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattgacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctcagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacatggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaaccggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggagacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacactttatacaaaaattaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagtcaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccattccattactgggtatatacccaaatgagtataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagtgcaccagcatggcacatgtatacatatgtaactaacctgcacaatgtgcacatgtaccctaaaacttagagtataataaaaaaaaaaaaaaaaaaagaatagggcgtccgaaggcttcatttgttcacaagaagccaactgaaaattaacatataaaaatgtataaactagtataagaaattgtcaaaacaaagtgaaagcatagtggaaataaatgcatttaagaagaaacaaagataaaagaagaaggaaggaaggaaaagagggagggaaagaggaaggtggggaggaagggaagtaagatagcactctagagatggtgaaaccaaaatagtatggtttcctaatacatactgtaaacttataaaaaatgttggggcccttcaattatcctaataatgtacagaaagctatttcactaaagtagtggaagaattcttgctgtgtatttttatgattaaatctctggaaaaatgtaggttcaggtttatatgtgtgtgggatagggaatttatatgggagttaattttatgaaataaagaagacctggttgatgatgtggagttgacataaatttggattttttttttttccctctgttgtccaggctggagggcagtggtgcgatctcagctcactactgcgatctcagctcactactgcaaccttcacctcctgggttcaagtggttctttcaactcagcctcctgagtagctgggactacaggtgtgccccaccacgcctggctaatttttctattttttggtagagacagggtttcaccatgttggccaggctagtctccaactcctggcctcaagtgacccacctgtcttggcctcccaaagtgctgggattacaggtgtgagccaccacacctggccacattcaggtattcttaataatctttgtgaaacaatgaaaatggaaagctgggaaataaaaatgtgggggatgggggtgaagatttctcaagttgtctaaaaggtaaaggtcatatgctgataactacagatttcacataaaacctcagtctaaaacaaaataataaatattataaaaaagcactagcaagaaacataaaggcaaaacggcaaatcatgccaagcttacctgattttcttgagtgaagaatctgtggttggtttggttggatgggtgaatagatagatatacattataccttaaattcagcaaggaatttaacacaatttattaaaaatccttgggaatcatgtagtaaactgagtttgtacttttgggtaggttcctagctttaacatactaatgacacttaactgtgaagtgtccatctgtgagaaaaggctctcatgggatgccacactgaggtttcaacagtggcttgaaataaaaatttgcaggtaagaaaacatcagaagtactaaagctaaaaagaataggtatgacgataaaagattaactcagactgcatcaggcacacatagaatcataatatgtatctgatgaaaaaaacaaatcaattaattgaatcgacaactgatgtttactaagcctgaagtcccgcacttaagtaaaaacaaattttaaaaaaggcataaatagcacagagtggaaaaagtggggttttagttaacctcacataataaaagtcaattatattttatctatatctctgaggttcaaaatctttgaaaactgaaagttttaccctacatttgtcaccaaaattcatttggaagcaacaagttttacaattcatatatattaatatataatagaaaaatgtctgaataatatgattaggagatgatgctttacataatatttgataaatagattatatcatattcctaaaatcagaaaaatcctgaattttgaaataatctgacctcaagagttagaataaaggctttggacttatcttagacaaaagtgtgagcatattgattaaaaaaaaaaagaaaaaggaagaaaatcttggtcaaaataatggaaagggaagcattattcttcaaacatgaaaaaataaataatttaacctgctggggcaacatgtgaaatattatagcattataatttaagaagaatgttaaatttatttgatatctaacagattacctgatatatgttaggcactaggtaaatatttgttgaatgaatgattataatgcatcattttaaaaactaaacataccaattatctaaactcacatatttcttcttttctattcccagtgaatctttctggttttcacttctgaaccccagattatctagcaaaccacgaatcactgcctcagtgactttgctcatgatgccacatctatggaaatgttcattctacatatctcctacctatattcaaagacagggcacctatatttttgaagaagctttccctaatctctcctgagggagagctaatctttactttcctatgcactcaagagtacccagaacacattccagaatagatcttatttttgtacatgtcttgtttcccaaagttcaggtttcttaagggcggaggctgctgtttgtttctaccctttgatattacttgatgccattgcttttacatattcataatccaaaaattattgaattgaatcaaaattaataggaataatgaaagactataaactaaattacaatcatgacagttaaaagaaaatataaagcattagcaagagaactgagaccactgtctgtttttattggctagtatatattcaatgttagctcaatacccagcacttaataaggtgaaaattattgaacaaataaactagtgtctaacctggggaataaaaactaagatgatgcatgaaaacaattttaaaatacatgaagttaaagtctagcatgtagaagaggaagaagagttagtacatgttgttccagaacagaactccagatcacagatgaatttaaaaagatacaaatgtcattatgaagaaccacagtgattggatcatgacagagactgctttataaaccaactagttctctctacttatggtcttagcaaacagtaaatgatgatctgttggggaaaattccaggaataaattttctcaaattacacttttttttttttttttgagacgtagtctctctctgtcgcccaggctggagtgcagtggcaagatctcggctcactgcaagctccgcctcccaggttcacgccattctcctgcctcagcctcgcgagtagctgggactacaggcgcccgccaccacgccctgctaattttttttatttttagtagagacggggtttctccatgttagccaggatggtctcgatctcctgacctcgtgatccgcccgcctcggcttcccaaagtgctgggattacaggcgtgagccaccgcgcccggccctcaaatcgcatttaaaaaaaaaatcccctgaagttgaagttcattaagtttattcccttgttaaaacagaggaatgatcatgttgacacacagtgaaaacaattctaatgaggtaggaggcagtactggattctggaggtgaggcttggacaccagacctaattgatgattaactaaaacagggatggggcaaaaacactttcccataagacacactgaccagggtgccatgtcagtttgccattgccatggcaacacccagaagttaccaccactttccatgacaatgacccgatgacccggaagttgtcacaccttttctagaaatgtctgcatgatccaccccttaattttcatataattaaaagtgggtatcaatatgactacagaactgcctctgagctgctcctctgagcacgatgcctatagggtagccctgctccacagggagtagtacctctgctgctgctatgcactgtcgcttcaacaaaagttgctaacacctctggcttacccttgaattcttttctggatgaagccaggaaccttcctgggctaagctccaatttgggagccttcctgccctgcatcagattccttcttagatgaagttaagaactctcccaggctaaccttcaattttagggctcacctgccctgcatcactactattatgaactgtactgtctctgaaccaaacctatccattgttacatatgaaaaggttttaatcaatttttcttacatcaatacaatgggaaatagtactactatattactgaaattacaaaactagagtaattgtagccatatttccaaaacaaaaatatagcctcagacaggcttccctggtggggaaaaaatatatacatatccatatgtgtgtatgtgtgtgtgtttatcactatcacagatttttataatgctttataactttaaagacacttttacgtaatagtcaagaaattcgattacatcaactgttgaaggcagggaacatatttatatctataaaacagattctgaggcctttgccctaggccttattgctactaaatgctactaaatgctagagaaggacttcagctactaactcccagtctgttggaacattttgtcttcaaagtcaagggctgatgcaatgattgtgcttattaaagtatgtgtacaaatgaccagaattgtaaagaatttcttgaaaagggaatggtgtaaaaatgtagtttgaagatgcattctaacaataggtaatttatagacaattctatgtaatagaaatctacacttgacagtatttccttcctcaagtgcaatagggctttaaaatcattttttattactatttccctgcctccattatactgactcaagcagttagctctttctcaatacattcccatatacaaacctcatctccttcctgaggtcgcatcaaagaaacccggtcatactgccgcctcaacaaagcccagagagcatcaagacgaccctaagggaaaatgagatttgtgaattcccagagaatgtactcaatctctatgtactgaataaatgaagacataaaacgaagaaagtaaaatcttctttaccctcatttctttcataaggtaaactaataagtaataaaaacctagaggttcttattgccaagaaagtattcagctgttaagagtgtacaatgaatatctgcaatttcatctaccctctttcaagtagctggggggatgtggtacaaaaaaagttacaatgtctccagaagttttgagttaaattacacaaaatctggacacataccttaattggggtgtaccattttgtctgaggaggctggtgtgtgggtttgggtcgaggtggtctaggcctgatgggttcctctgtttcttcaggaatcttcaccacagcatttttggctttctctagccttgcaccttcctcagtagatcctttatcaccccaacgaacctgtaaaacaaagggagagtactgttatcagacataaagtgtcctagaggaacaggctcttattgagcctatggtcctttagttcacatctcagagtgaaaaagaagatgagcaggtatcctaattcctaatttctcctcttcagaggctaaataggtttctcaccactcctgactgtatttaatattaagatccaaaaaaaaaaaaaaccctttgtaaaaaaatctggagccaactaaatttgaagcaaccatttttccatagttttaaataaagagtccatttgtggtttacatatgaaatgcatgacagtgtgtaattttgttctctaatttggtttgttcccctgctagctaaacacatacccatatgtagtgatgacactggaagaaatatatgaaaatgacgatagttagcatttactgagtgattactatgtgtcagtctgcatttaatccatacaaaaatgcagtgagatagagactctattttcttctttccagatgaggcacagggaggttaagtgatatgcccaaagccagctagtaagtgacagggcagggattcgaacatggattgaaatgggttaataagtttccaattggttagaattttacaaatgtattttatacaaaagagttgcttcttccaaacttttcatcacatctgattaaggcaaaaagtatgatctgaacatttagtttttgaaagtaaaataattatatatgagttttctttacttttatagttctaagtaatatagtgttcagcctttagttcccaagctcatctgagtatggttgtgtggcatatgatttttttcattgaggaggtcaaatctgaaaagactgctttgaaaagaaaagttcaggaaccctagagaattccacaaattatagcaaatttcctcctctgaaaattcttgacattgaaaaaccataagatcaaatgattgttttatttttcaatagacagaaattaagagcaaatgattgttgtatttttcaatagacagaaattaagagctaaatttgagtcaaactgggcatgtaaaaataggatgcagcccctggagaagagcttgtccaaccaggagtagtggaaagccctacaaaaaccaaggacatcaccaaaaatgggcgaggtcagaggagtgaagctctaaaaacctataataagagctaccgagggcacactatgacacatcagagttaagtgatttctaaaaagaaaaaaaaaaatcctaagacttcctaaagcattttaatgatctgaattagtgggtagggatagagaagattactattcatggaaagaactattcagtctttttgataaggcttacttagatgtttttacctttttttactacaattttagaatgggctttcaatttcaagtgggccctgttgagtcattaaaatgtatctatatctttcagtgtgatcaatgatactagaatgtttttatgaggttgttaaaattgttttaaacaccactaaacctttagagctagatagttggctttctttccagagaaatgaccttctctttccaatcacagtgtcatcacctggataaactaacacttataaaatctttagatatagctaaattgtattaaaaactctaaaatcaggacacatatccttgcagttgtaaaggctcaattttaaggaaaaaaaagatacacaattaagtaaagacacaaatgtcttaacttagagaagtcattcagggtagaaagagaagtagatacaatttagatccattcagaaatgataggctttagaatagacagctctctcgcctatgtttcacagttgatattgcagaggtaatgataatcatattcttctttcaagtttcactggcactattctcagattaaaaaaatatatatatgaagctagttaaactagagttctgacccaatgtggcatttctaggtactacactatcaaatgactatacttgagaaatatagttgctgagatctaaagaagatccattaaagaaattcattagttttagttcatgagggagctatttaatcatcatcaacatcatcaccaccacaaacaccaccacaaacaattctcacttactcaaagtctgaaactagaaattattacagttttcaaactcttaaaaacaattaaatatacatatatatgtgtatgtgtatgtatgcataaattttaatgttttagtttgaccacattgagacagttaaaaaggacaaaagaataacaacaatagactgctaaaggaagccttagcagaattaatatatcaggctttattatggaaaaaaataagtgtaagcttgatagctaaattcttccaactccacttggctttcattataagcaataaaattccataatttccagagcatatttggatgactagaaggttatatcattgaggagcaatttcagaatcgagaaaagaaacaaaaacagtttcacactgaattggcagaaacacacatttgaagtcattaggtattgtggatcagttgtgctaacagctgttattaacatcatctccgttccagctttctaaaaattcccattaccatagtgtttaaatatttaatttaaagaagaaggaagaaaaaaattctaggtaaaaatccctatgctggcttaaaataaccttagctataaaaatgtgttctgtaattcacatgtgctcataatttctataattccttttacttttcctagtttaagggctttaaaaaaaaaaaaaaaaaaaaagagaagtaccttccaggtttgaataagcatgcttttaaaacaaattttgtttgcacagtggcacctgcctgtagccccagctacatgagagaatcgagagaatcgcttgagctcaggggttcaagaccagccagggcaacataatgagaactccccatcatccactccagatttcttaaaaaataaatagataaatgaaacatttccatctccacatttaaataaattaatgtttgaaaatgtttaatgatgcttaattctcagttcaatttttactgtgtatttttatatacaggttgagtatagttcaaaaatctaaaattcaaaatgctctaaaacctgaaacccatgaagtgccaacttaacagcataagaggaaaactccaaacctgacctcatctgatgggtcacagttgacactttgtttcatgcacaaaattattttaaaacattgtatattttaaaattcatttatgcttgtatattacgtttgtgtatttatggtatattttaaattcatttatgtttgacgcacaccttatatacatattcttcttatgtgtgtataaggtgtgtgtcaaacatattcctcttatgtgtatagggtatatatcaaacaaaaataaatttgatgtttaaacttggctcccctccccaagatatcatattaagtatgtgcaaatgtcctgaaatctgaaaaaaatccaaaatctaaaacacttttagttccaatcatttcagataagggatactcaacgtgtatcgtgtttcccctttgtaacatccacacttgcttttccatttttttcttcattctcattctcatttccatcttgttgatggaatactccatgcaaggtagccaaaattatccaaaactaaaatggacccagatttattacaagttggctgcggtttttcgtcacaaattttgttcaactgaaaaggatgtgtgggcaacataatttcacatattgagagttaaaaactcttgaaacttgaattataggttagttagggatgtgtgtatgctcttggctctcataaatataaaccaataatgttccttttaactcaggacccattcaggggctcactcacacatttcctttcctttaaaaagagatctcaatctttggaacactggaatattgaactaacaaaaatctgacatattcctagttttttaaagcaagaatattatttattcaattaaggctcacatactaatatccttactttattatcatgccatattttacatgagtgaatttcaaaatggcattaagtttattattctgaatatgaagtagtacatgctcactgtcaaatacatttaaacaatagggaaatatatagcatagattgaaaattgtccatccagagaaacctactcacatttttggtatattctatcaagccttttttccccgttatatagatctttttacacacacattttggaatgagatgaaatcaaataaaaataagttgttacagatcgtatttggatatttgattgtaacacttttatttcgaagtgtatgttttatacatataggaacatcctatatactttcttcccacctttccaagtctagaatgacacaacaaaggtaagaaaggaaaataaccttccttctgtgtcaaacaacaagaacttgcctagccatgctctcttatattgtttgctattctcagtttctagcacacaaaaatacatgcaataacttctccaaagaacagcttaactgcatctagcaactgtttataatcatggataattggcaatgaggtatctgcctcagaggatatttcaacaataaagggcaagctctcagggaaaatgtccattgcttcaagatctaatgtggtccagaaaagtaagaatcactgtcagatgacctatataaacactttgctaatgacaaccatgttcagtatgtctgggctttttctgaagaagagtaaaatttattctgaaaaggggaaactctccttgggaatctgaattttattgtaatgtataaaaggagaaaattgcaataattgtggggttgttcattaggttatcaatttttgctggcacaaagcagatatgacaataggaaacgtgcaacaatggtaaaatgcataaaacacattctaatcagaaggaaaattatgactaaaaaggaaggaatgccagaatttaataataaagtcaatgtgttcatgaaaaaatcccttgaattgctccttgggatgggatgcaggcctgtttatactgttgttaagagctcagtgctggtaataattgcttattactaaataatatatcactttgaaaaaatagttcatggtgataataaaatcttatttgacttttaagatataatattaaagttcaattttaatcaacactttgggctagtctgaaagttcaatgcattctataaatgatatataatatcaattacaatagttcataagtggcaactaacataaagtattaaatgtgcttcctctatatttgtgataaagtcagatccacgctattgaatattttaacattttcttctcaaatagtagataactattggatctttacaaagaagaacattgttgcaacttgaagtggctggcttcttcaaagttgacgttctatgcggtaattttttccaaaataagaaaaaccctagctttgttttgtcccttagaattcagaggtcttatcaatgcaatcctttgactaatgaaaccagttcttctaggccagttttgcagcggctaggatgattccatagaaaaaaaaatgtatccagaaaagacccagtgttaagcacaaatggatgatattataatattgaattgtgaaaagtagtttctatggcttaatagccctagaaatacatactccagattagcagcttctatttttttttaagataccaacctccattcttttaattcctccaacccctcgaccaccataataggaagcatccacagttggccactttttagtaggcaaaggttcttcttcctcctgtggaaatatgttttataaatagtttttaattaatttcttaaaatactgtttagtcggaactggctcatatttaaatatttttctgaattatgtcattactatggaaaaaactatgtatagaacatgtggatatatttacacttacatgcataaatttcaagtggagttctacaggatatgagaactcctttccctcctcaaatttcaggaatctctcttacatcatccctaggtaactagaagttgttctttaactatgggaatcatttggtatttcaaatctattcatcacttcatacttagaaagataaaatattaaattaggacagcattttaacagtcattaaagcatcaatgtgtgtgtaggtttggactctatgaaatttgaactgaaaagataggcagttgagaagctttgaaaatatacaacaccagcacattccttatttcatgttcctaacatgattctggttaacagaatcatataaaagcaccaagaattttgaagaaagtaataggatctttcaactgtcagcttggatgttttttgtcaataacataagtgatatcagaactgttgatatagtactataaaagtatattaaatctttatgtactattgattccaatggccagtttatatctagtaatgtatgaagttcccattcctctagcacatgaaataaatcataagaggatgaaaaataaccactgatttgtataaattaaaaagtcagtacataggtatcatagttatctaacagacaaaattgattaaatttgggcatggtatctgcatttggaaaaaaaaaacagccatatcagttttttaggcactcacttacctcttttggtgcaggggcgggtggtggtggaggatccttaataacctgtcaaaaaaaatcaaatataaaaatttctatggcatagagaggagatagtaaggatgtgtaaaaataatttgatacataaaatactgtggtagctccaaagaagtccctcactgaagcttgccacccaatatttatgcccctctctttgaatcttggattgcctgtaactagctttcggcaaatagaaaaaggttgaagtgggccaggtgcggtcgctcatgcctgtaatcccagcactttgggaagccgaggggggcggatcacgaggtcagcagatcgagaccatcctggctaacacggtgaaaccccgtctctactaaaaatacaaaaaaaattagccgggcgtggtggcgggagcctgtagtcccagctacttgcgaggctgaggcaggagaatggcgtgaacccgggaggcagagcttgcagtgtgccgagatcgtgccaccggactccagcctgggcgacagagagagactctgtctcaaaaaaaaaagaaaaagaaaaagaaagaaaaaaaagaaaaaggtagaagtggtactatgtgacttctcaggctaggtcaaaagaacttaattttccctgacatccgtggaacactcactgttgaggaacactgctgtcaggtcagaaatccaccccaagaccatcaagctgtgaggaaacccaaactaacctaggctgggtggtgagacagagacaccagctgatccccagctatttcagccattcgagaggagatatgggacatataagagaaaagtccatcttggacactcaggcacaccaagcttccagatgactccggccaaactggcacctgactgtaaccacaatgagactccaactgagagtctcctaactcagcccgtaaggatacaaactgttgcttgaagctgcttgtaacaaatcagcttcttagccaagacccctttcctgtgatgccttactcatgaaatctttcacagttaattcttttttttttttttttttttgagacggagtttcactcttgtttcccaggctggagtgcaatggcatgacctcagctcactgcaacctccacctcccgggttcaagcgattctcctatctcagcatctggagtagctgggattacaggcgcccgccaccacgcctggctaatttttttgtatttttggtaaagacggggtttcaccatattggccaggctggtctcaaattcctgatctcgggtgatccacccgcctcggccccccaatacagttaattcttcacgtgaatagaatggggcttaatttgaaatgacctttactggtattgggctatctggatattcacaccatcgtgatggaaaatctttgaccaagtgtcaatggcttcagctacttcaggtacaaatcaaagtctctatactaagagggaaaactgaaaatgttccagcttgatgtcatctaatgtcaaatgtgtcaactatgctattaaattttcaaaggtttaaaacaatagcaactttgaaaatgtggttccacttttacctcatcaaagaattatttttaatgtgtagtatattactatgatcatggatatatatttaaagactgtttgtcttttaaaggtatgtacaaatatttccaggtgaaatgatatgattttgatattttcatcaaaataatttgggcgttgggacttggatatgggtacagataaagaaagattgacaataatgctccaccactgcatacacaccagtggctccccgctgccctgttggttttcatttgtctgcacctcacaccatcgccccactagtgtgcactctctggtggccccctacttcaagacattctcctgtggcaccctgcccccacaaccagagcacttttgtcaacagcccccatcagagtgttttgccagcagtctgggaacaccccagtccttccagtgcagaaagtgtttgacctcgagaggtcaaagaacaaagccatatgcccagtcccagtccccaaggcattagcatgaagctcaggagtgctaagctgaggcttggcctcctgaaagcatccagaaatgaagtcaatcaactaaacacaatttatactgccttcaaaccctcaagaacatcaaagaatataaaagcaaatagcttcatccaaaggacagcaatgtcaaaaagtaaaggaaaatcagtgaacacagatgagaaagaaccagcacaagaattctggcaactctaaaagccagagtgtcttcttacctccacaaactatctcaataactcccccagaaatgaaatgtctgaaatgacagacacagaatcagaatctggatggcggagaagcccagtgagatacaggagaaggttgaaacccaatccaaggaaactaataaaacgatagaagagctggaaaatgacattgccattttaagaaaaaaaaaaaaaaaattgaacttccggaaattaaaaatttgctataagacttttataatgcaatcggaagcattaattacaaaatagatgaagctgagaaaagaatctcaaaactcaaagactgctcctttgaatcaatgcaggcaaaaaaaaattaagaatttttaaaaatgaaaaaacaaacctccaggaaatatgggattatgtaagaagatcaaacctatgactcactggcatttctgaaagagatagagaacaagcaacttggaaaacatatttgaggatattgtccacacaaatttccccaacctcactacacaggtaggcatgcacattcaggaaattcagagaatctttaaaatatactagaaaagataagatatctagtcatcagattctccaaagtcaacgcaaaggaaagaaatgttaaaggcagctacagagaagggccaggttaagtacaaaaggaatcccatcaggccaacagtgaaactttcagcagaaactttacaagtcaaaagagattggcggcctatattctgcaactttaaagaaaagaaacttcaaccaagaatttcatatccaaccaaactaagcttcataagtgaagggggaataaaatcattttcaaacaagcaaatgctaagggaatccattactatcagttatgtttacaagaggtcctaaagggagcactaaacatggaaatgtaagacctgccaccacaaaaacacacttaagtacatatcacattggtactataaagcaactatacaatcaagtctatataacaactagctaagaacatgacaagatcaaatcttcacgtatcaatattgaccttgaagataaatgggctaagtgtccaacttaaaaggtacagagtggcaagttggatacagaagcaaaacccaactatacactatattcaagaaattcatctcacataaattttatatatatatatatatatatatatatatatatatatatatatatatatgtaggctgaaagtaaaggaatagagaacgatcactcaagcaaacagaaaacaaaaaaataagaggggttgcaattcttatttcagacaatacagactttaaatcagcaatgatcaaaaaagacaaagagcattgcataatgataaaagtttccattcaacaagaagacttaactctcctaaatacatacactcccaaattggagatcctagattcataaaacaagttcttagagacctatgaagaagcttagataaccacacaataataatgggagacttcaacactccactgacagtattggacagatcattgaagcagaaaactaacaaagatatttgagacctaacctcagcacttaaccaaatggacctaacagacatcaacagaatacccaacaacaacagaatatacattcttctcatctgcatatggcacatactctaagatcgaccacatgcttggccatgaagcaattctcaacaaacttaaaaacaacaaaatcataccaatcacactagcagaacacagtacaatagaaatagaaatcaataccaagaagagctctcaaaaccatacaattacatggaaagtaaacaaacttgctcctaaatgactttcaggcaaagagtgaaattaaggcagaaatttaaaaattctttgaaaccaatgaaaacaaagattcaacatcacagaatctctgggacacggctaaagcagttttcagagaaaagtttatagtgttaaatgcctacatcaagaagttaggaagatctcaaattaacaagctaacatcacacctagaggaacgaggaaaacatgagtaaaccaaccccaaagctagcagaagaaaagaaaaccaaaatcagagctgaactgaaggaaactgagatatgaaatctgtacaaaagatcagcaaaatcaaaatttggttctttcaaaaaataaacaagattgataaaccactaactagattaataaataaaaaaaagaagatccaaataagcataatcagaaatgacaaaggggacattagagatcccaaagaaatacaagaactctaaaacactattaggaatacctttatgcatacaaactaaaaaatctagaaaaacatgggtaaattcctaaaaacatacacttctgaagattgaccaacaaagaaatatttatcctgaacagataaataacaagttctgaaacttgatcagtaataaaaaaaatccagaaaatgccgtagatgagacagattcatggctgaattctaccagacatatagagaagacctggtaccaatcctactgaaactattccaaaaagttgaggagaagggacacctccataactcattctataaggctagcatcattctgataacaaaagctgtcagagatacaatgaaaaaagaaaacttcaggccaatatgcctgatgaacatagacccaaaaatcctcaacaaaatactagcaatccaaatctagcagtgtatcaaaaagttaatccaccatgatccagtagactttatccctgggatgcaaggttggctcaacatatgtaaatcaataaatgtgattcattacatgaacagaactaaaaacaaaaaccacatgatcatctcaatagactcagaaaaaactttcaataaaattccacatcccttcatgttaaaactctcaacaaactaggcatcaaaaaaaatatctcaaaatagtaagaaccatctatgataaacccacagccaacattatattgaacaggcaaaagatggaagcatttctcttaagaaatagaataagacaaggatgcccactctcaccacttctattcagtaaagtcctggaagtcctagccagagaaatcagataacagaaagaaataaaaggcatccaaataggaaaataagaagtcaaaattatccttcttcaccaataataagattctatatttagaaaaccctaaatattctttcaaaaagttcctggacctgataaacaacttcattaacctttcagaatacaaaccaaatgtgcaaaaataagtagcatatctgtataccaataatgtccaagctgagagccaaatcaagaattcaataacaacagttacaaaaaaaaaaaaaaaaaaacaccttgtaatacagctaaccagggaggcaaaagctctgtgcaatgagaattaccaaactctgctgaaagtaatcagagataacaaaaacaaatgaaaaagcattctatgctcatgaataggaagaatcaatattgttaaaatagccatattgcccaaagcaatttacagattcaatgctatttctatcaaaatatcaacatcatttttcatagaattagagaaaactattataaaattcatatggaaccagaagagaacctgaatagccaaagctatcctaagcaaaaagaaaaaagcaggaggcatcacactacctgtcttcaaactatgctacaaggctagagtacaccaaagcagcatggtactgctggaaaaggttagataacccagaaataaagccacacacctacgaccatctgatcttcaacaaagttgacaataacaagcagtggggaaaggactccctattcagtaactgattctggtataactggctagctatatgtggaagactgaaactaaaccccttcttttcaccatatataaaaaccagctcaaaatgaattaaattcttaaatataaaacctaaaactctaaaagaaaacctgggaaataccattttggacataggctttggcaaagatttcatgatgaagtttccaaaagcaatggcagcaaaagaaaaaataaacaagtaggacctaattaaactaaagagcttctgcacagcgaaagaaactgtcaacagagtaaacagataatctacagaatgggagaaaatatttgcaacctatgcatccagtaaaggtctaatatccagaatctgtaaggaacttaaatcaaaaggcaaaaaacaaacaacctcatttaaaaaaatgggcaaaggacacgaacaggcacttctcaaaagaagacatatacaaggccaacaagcttataaaaaaatgctcaatattgctaatcattagagaaatgcaaatcaaaaccacaacaagataccatctcacaccagtcagaatggctattattaaaaagtaaaaaataaataacaggagttagcaaggctgtagagaaaggagaatgtttatacactgctagtgagaatataaattagttcagccattgtggaaagcagtttgaagatttctcagagaacttaaagcagaactacatttaatccagcaatcccattattgggtatattcccaaaggaatataaatcgttctaccaaagacatacgcacttgtatgttcatcacaacactattcacaatagcaaagacatggaatcaacctggatgcccatcaatgatggactggctagaaaaaaaagtgatacagatacaccagtgaatactaaacagctatttaaaaaaaatgaaatcatgtcattggcagcaacatggatgcagctggaggccattatcctcagagaattagcacagaaacagaaaaccaagtactacaggttcttttttataagtggagtggaagctgcacattgagtacaaatggacagaaagatgagaacaatagacatcagggcctacatgaagtgagaacccggtagaaaggtgagggttgaaaaactacccatcaggtactatgctcactacctgggtgatgaaatcatttgtacaccaaacaccagcaacacataatttacccctgtaacaatcctgtacatgtacccctgaacctaaaataaaaattgaaagaaaaaaattgacaataagttgagaatcattgaagctgagtaatgaagacagtgggaagttcattatcttagtttttttaatttttaatttttgtgggtacatatattagtctctctctttgtaaatgtttccattttccatagtgaaagggtttttatattttgatgtcattgataatgtttagagaactgacccataattttctgtgtgtataatgttttcatcatctaaattttagtttagatccaaacctcagggaaaaaatacacagacaataatgacaataatatagatataaatagtaattaaatttgaatctccttttgaatgctacaaagccattatttctacttaattctttatttaattcaattttatttttttaataatcataaaattccagtagattttggtaatcatgaaagataaaactttatgattttttataattagcccagaaataaatgccagtagagaattaagatttaaaataataataaaacaaaataaagttaagttcatcaaactgcaggtatatttcctctataaaaaaagaaagcatgtcatatgactatgaacttgcatgtccaaaacaattaatgaaaaccaaatctgttagcattttataacaaaatcaaagctaccctaaccatcttcatttaaaagctaacattccttcctatcttccctgtttctttcaagtgaatgacttttttcagttgcaacctaaaaagttggcataatctgtaatctcttttctcacttcaaatgactttaccaaatcatttccatgcccaatacattctttgaaatatcccccaccttcctctctccctgatgaattctccccattttctcaaagcatatgattctcttgatatgcacagatgcattgttctctcctagaatttatccaagttgataattttatctaccaaaaaagggtttattaattttatctacaaaaaaatagtaagtttcatgagaacaggtgttatgtctgctttgctcctcactgactttctagtatttaatagaatgtctagcacaaattagactttcaaggaagtaaggaaaaagagaagttaggaagaggaaaaggaaagaagtgagaaggggagagaaaaggagggaggaagggataaagaaagagagggaagaaggaagaaagggaaattaggaggaaaaaaagaaggaaaaaagggagagaagagaggaagaaacaaattgagagaataaagaaggaggaagggaaggaaggagatagactgcagagggaaggacaaaggaagaagggattcttttcattccctccccctgtcactcctaaaagcatattctcaagattctttgggccttaaatgtacctagtacaacattttttcaactcctccaacgcatacacaatcaaaacttcaatactctgaaaagttcccaccaagctgtagtctaattatgtttgaattactgcaatcaagagaaatccactaccttacaaagcaattcagtccattggcaaggaacccacatcatttgaaagtttttcccccaaatgaagccaaggcacttcccactctgtagtttccagtctttagtcttgatcctagagtctggcaatacaccacacacacacacacgcacacacacacacacacacacacatgcactttttctttcagaggagagcagttcctatttttgaatgctaggataattgccatatatctactgagtctaccaatctggaacctaaatatatcaaacatttctcatgagatggtcctgagttatctggttatcttggtcagttttttttttaatcacatattgatttggtcaatatttcagtgtggtttctagaactgataacattttaagtatggctgagctattataaataaatgaatggtgctcagacaaaggagatgcatctccatcttttctcaccacctcattctaagaattttaattaataatacattcacaaaatttattgatagttataattaccatagccttttttgcatcaatgacttaatactctacttgttgttaaattagacatctaacttatttctctatctccaattgattccccattttaacctatgtagccaggtcaatattcttctaacagaagcttaaacgatcatttccctggtaaaaatgaataaacaatcccaatgttcaaatttgactcaataaagtactaaattttattggaaagaccttacgaatcatgcttccactcttagttttgtgaatttccataaagtactctctggagttctctcactagaaaaaggtcaaggtacatccttccattccactaagtctgagaataatacatctgaactcattttcacttcatcgtgaggacttcaaatttactcttcttattacatgtacatcttgcactgttatataaatttctgaggacataaatagtatccccaaccctgttcctcctgagaattacatcctcctgagaattattcaacatctctctccataactcttccttttttttaatgtcatattcattatcccatatagcatctagtttaatagtgatatgggaaaattgaatttcaatttaaaatccccatatgaccactgttatcaaactcacatagtaccatgggaggcatctttacattccttctcttcaccggaggtcctttatctaatataaactgcaagataaactatcaaagccccttttgcagcacataaacatgagccagtttttctattctcattgttaaaatgcctcagcatggtgtcagtccctccacggttaaggcctaacatgtatctacaaacatccccctacatgcacctcctctccagccagcctgatgatcctgatgcttcccccaaatacaatgatcattttcctgttaggtcccaaccagccttcacagagtagcccaccaactccctgttgtttcatctagaagacataaaactttttaaagtatatgttgctgcacagttgaaccatttatgcatcattaatttgggtttatatgttgattttgtaatttttaaattatcactgaaaattacaaatttcttaatggcaataattatttctccttatttatacatgtcatcatgcctaataaagtgctctgcacacagcagatactaaaggtactaaaaatatactgaaagtgaaattgatggaactgagaacgttcacaaaaaattatagttgatttccaaatgtataagtcaaatattgaggaaaaaatatacaaaaataatacacagatagatttacatgaaactaaaatattactagtccctaagaaaatgaagcactaaattttttcctgaaccaataaagtcagataacccaattgtagaagaggagatagaagtatactaagtttattcatctgggaaataaattggattaactgtaggtccttgtcaaaatgtcaattcttataaaatgataaaaaatacatattacaatgtttccaccaggtttttgcttctatgcctttccatggataaatatggccatatgtctatatgcaattatattcaccttattccagaaaagaacattagagttcttttcaatagcatgccattattcttttgtgtgaataattcatgacttattatacatttaaaatgaattaaagtcctgacaagtatattttctacattgttaataatgaaaacgaagccctcaaagctctatctaaatcacattttgatctggtaaattaaggcacacaaccaccatcacaacaaataatagtaccttcagaaactgaaccagagctaaggctcatctgtgtgttgttaacactattaacaggaaccaccctttattggtgctgccagatgccacatgctctgtctctatagctcttttattttcataataactctgtgcaatcactatgtttatcctcattttaaatataaggagaggaaagctgtaacttcaataacttgcccaaatatatacaaagagaaaacacagaattaggattcaaaccgaggaccaagtctacctatctccaactctgaattcaacttctgccatatgacatctttttaaaataagatttagtttgcaaagggaaagggtgcagaagaaaaagcctatgatttgttgagtagttgttacttacttgcatggatggatgggtagatggacggatggatatatggatggatggatggatggatggatggatggatggatgaatgaatgaattgacaaatagatgatagataattacacagatagttatatttaaaacttttaataactatgtaagatagagtttatcaccattttatatagatataacatttagctaatatgcccaatgtcacccacataaaaatttggggacgagaaacaaaatggttttcttgtgatgttccaaaatcttccctctctccactctgccacacaacctcatgagtaacaaagaagggtgaaaataatctgaagccatttggctcaaaagccaaaaatggcaaaaatctgtgttcaactgacattcctacatttcagtaaaactagttcaagagaaaagaaagatttactgttagtaaaaatacattaaaaactacagtcatgagaattccattcttatatcaaatagtgcaagaatacacattcatttcagaaaagaatgtattcatatgcaccatattttatgagaatttgcagattttaaaaggcataatattgcctagttgccagaattttttccacttagcatccttcagctctgtattgaagattctggaaaacactttcaccactttatgaaccatatgcagagtttgattcttctccaatttttttttcatttgttattatcatcatcaggaaggattacatctcatctacttagctgctagaatgaagatttcagtttggaagagagccgatttctttaaaaaaaaaaaagttagctgcttcaggcaacagtccttttgatctgctcattaacacttttcaaatgttcaagtgatatgggcattctttgcgctaaaaaatgtcagcactggagcctgcagccagcttgatgcaatcatatgttccaatattcagaaaagagtgaaaagaactgtcaacattgaattgccttggattaaaaaaaaaagatattgtacaatgactgtagactaagtagtatttcagaactgatttttgccagtgacaaaaaaaatgcccaatttatcggcaatgtcatctaggtgcctagggacccacagacaatagagaaacattcttagtatttacaagaatttctttaaaatatatgggggtcttcctttcattctcccttttctttttgataagatcagagaggaagtaaaatgcctttcttttgacatacaaaaacacaaagttcttacattactgcttgtgaagtccttcttttctgaatcccacaaagtatctaacttcaacatctagccttcaacatcctgaccaaaatatgattcaagttatctcatcctctgctttttatttcttcctcgacaaactcatcaatgatcaaataattctactttgaacaagtaaataagtagcctgaaatctggacaataaatataatttagaatgctaaatgagaactaagaagaacagtgtgagagtgtattctgccaggagttaagtaaaggtgcttctgtcaaagcaaataaactgagaccaggatgagtttgatactgtctcgtaaaagatgctctgtcggaaagcatcaccatgaaagcatgaaagacctaacatcacactctatttcaagaaggcaaccaaacataaatcattttaattaatggtgtaaggaaggtatattaaaatttaaattacttatattttattgtgcattccaaaaaagaaatcaggctgctctcaaagtacctcaataaaggtaccaggagcccttctcaacaataaaaacaagtgcaatgtacagcattattactatttagaaaagaacagcacagctgttgctggctaacaaaatgattctatagagttccagctagacatatcatcatcgcgtgagatcaactaacttataggcaaattgggctttaaaaacataaaaaagaccatttgtaaatggtattttaaattaagatctatgagatctttatgtaacgtcttaaatgcactaaagaaaaatgaatttgcaattttcccttgaggctgcagaacattggccaaggacactaaagcaagtgaacatttgtcattttcagcatattcaggtattatttgcagctatataacacaatctaactgacaacactacagaaagcctttgtttgccacctcatctgtaattcatctggactgtctggttaccccaaactatgcaactataggactgtcatttctcctatcctgattagtaaaacaaatttgctcttaactcaaaatatcccctaatctaaacaatgatgaaaacatccataatttctgatgtcactaacaattcaaaacaggataagttttgttttaatgcctcctgcctttttaacctagggaaaaagacaggatgctgatgacggctttgttaaagaaaggcagttatagaggatggatatgaggaaggatactcaatgaacaggatacagactcttaaacagatgttaagacataacctcacaaaaaatgagaactcttcccttcatggaacagtttgaaaactcaacacaatctatcattcactaatggtagtgcctaaatattcaaatttacatgaggctccttttttataaggcttgctagataaaggtctccaaatatcattggtttagatttatacttttgtatggaaagcccacgcacacagaggacactatctgcaacatttagattacatcacatctctctgtcattcttgaaaagactctttagtatgaactgaaagatttaaaatttaaaaatagtctcttattaaaagcatcttggctgaccagatcttctatggcaggagtttttccttaatcttttttattatatgccccttgatatggtttggctctttgtccccacccaaatctcatctcgaattgtaatccccataatccccacgtgttgagggagggacctgggtgagaggtgactgaatcatggaggcggttttccccatgctgttctcatgatagtgagctctcacaagatctgattatttaatgaggcagtttcccctcctcttactaggcctctctttccttcttcatgaagaaggtctttgcttcctcttcaccttctgccatgattgtaagtttcctgaggcctccccagctatgcagaactgtaagtcaattaaacctttctttataaattacccagtttcaggtagttcttcataggagtgtaaaaatggactactacaccactccttagcagtctggtgaatctatcccataataattattctaaattaaaatgtatagaatttaaaggaccccaatcatattgaaatgtaattttcaaatttattttttaaaatatgagatatggaaatatgtatgtttctttattaactcattaagtaataagctcttgtaataagtttagaaactatcataattttaaagtagcaatgcctgtaaaacacatttcaaagatatctgaatagtagtcagtagttatggtgcatgcctatattccccactacttgggaggctgaagctgaggcaggaggatcccttaagccgaggagttctaggctgcagcaaactatgatcatgtcactgcactccagcctgagtgacagagaacctgactcaaaaaaaaatctgagcaactataaatatgatatgggatacatgtgattgctactggtgacagttttcacaactgctaatatttttgtgggcagggtaaaaaaatcaatgacaaaaacgataaatttcagttggaagaaaaaagaaagatatatatttttttccacataaattcacaattcttaggtgaggcatccctgtggggtatatgtagcagcaactagacaaaagttgaactgcttctacttcagagtttcattataattaataaattcttatgtagttgtatcttagttcctactaaaaatgattacaaaggccacatttcccattgtatatatattatgagaaacaaattttaaatgaagtcaatgaaaattatatcaagagtgattgtatcataaatttcctcaagcacaatacttctccataattgacagaattttttactataactagcaaaaaggtactctattttgaatttgatttccaagtaaagcaatatcaattttctcaattttaagaattgggataggtgaagaagatgcattcaataataagtattcaccatgcaacatgcctggtttacaatgataggtagaatacacacagtacctgccttcatgaaattattagtctataaggggagagagattttaaacaaataatacataaatcattatctaattgtaattttacttaagcatcaccaaaagggtaacatttgctcacctgacaggataatgttataagaattttggctaaaaatttaatataaaacatcatagaagggatgtttctgactttgacatgtttctttttcctgatataaaactggtacagctaaccaggtaaacgtcatagtttcacagacacagtaattagtcaaatgttcaaattctttgctttcctccatagagtgaaggtcaatttctagcttttaagaggttcaatagttcaatatctgaatatgaatgaaactgtgctggctcctctagcaaatcatatcacccctgaggaagctgtccatggatctctgttgtcaaatgattctaataacatatatgcgtgaggcacttctgaaaattgtaaacccgtctcttccaaaaatcccttgttgctctaagattgtaagtaaattctactcagtatatgaagcattatgcatattaacttcaaagttacaaaacagaggggttattctaattttaaaggatgcatattggtttcaatagccttggtaccattgcaaatttttttttattatactttaagttttagggtacatgtgcacattgtgcaggttagttacatatgtatacatgtgccatgctggtgcgctgcacccactaactcgtcatctagcattaggtatatctcccgatgctatccctcccccctccccccaccccacaacagtccccagagtgtgatattccccttcctgtgtccatgtgatctcattgttcaattcccacattctgagtaaactatcacaagaacaaaaaaccaaacaccgcaaatattttaaagaatatttcattgcctcttattttgcaattgcttgtaccctataaaaagttcagggttgaaaaaaatgtatattctgttgatttggggtggagagttctgtagatgtctattaggtccgcttggtgcagagctgagttcaattcctgggtatccttgttaactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcctgttgaattgatccctttaccgttatgtaatggccttctttgtctcttttgatctttgttggtttaaattctgttttatcagagactaggattgcaacccctgcctttttttgttttccatttgcttggtagatcttcctccatccttttattttgagcctatgtgtgtctctgcacgtgagatgggtttcctgaaaatggccatactgcccaaggtaatttatagattcaatgccatccccatcaagctaccaatgactttcttcacagaattggaaaaaactactttaaagttcgtatggaaccaaaaaagagcccgcatcaccaagtcaatcctaagccaaaagaacaaagctggaggcatcacgctacctgacttcaaactatactacaagggtacagtaaccaaaacagcatggtactggtaccaaaacagaggtatagataaacggaacagaacagagccctcagaaataatgccgcatatctacaactaaccgatctttgacgaacctgacaaaaacaagcaatggggaaaggattccttatttaataaatggtgctgggaaaactggctagccatgtgtagaaagctgaaactggatcccttccttacaccttatacaaaaattaattcaagatgaaataaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaacgggatctaattaaactaaagagcttctgcacagcaaaagaaactaccatcagagtcaacaggcaacctacaaaatgggagaaaatttttgcaacctactcatctgacaaagggctcatatccagaatctacaatgaactcaaaaaaatttacaagaaaaaaaccaacaaccctatcaaaaagtgggtgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagtttaaccattgtgaaagtcagtgtggccattcctcagggatctagaactagaaataccatttgacccagccatcccattactgggtatatacccaaaggactataaatcaggctgctataaagacatatgcacacgtatgtttattgcggcactacacacaatagcaaagacttggaaccaacgcaaatgtccatgaatgatagattggattaagaaaatgtggcacatatacaccatggaatactatgcagccataaaaaatgatgagttcatgtcctttgtagggacatggatgaaattggaaatcagcattctcagtaaactatcgcaagaacaaaaaaccaaacaccgcatattctcactcataggtgggaattgaacaatgagaacacatggacacaggaaggggaacatcacactctggggactgttgtggggtggggggaggggggaaggatagctttaggagatatacctaatgctaaatgacaagttaatgggtgcagcacaccagcatggcacatgtatacatatgtaactaacctgcacattgtgcacatgtaccctaaaacttaaagtataataataataaaataaaataaaataaaaagaaaatggacaaaatacatttagagccatttcaccaaagatataagcaaataatggcagataagcacacgaaaacatgttcctcactagctgttatagaaactcaaattaaaaccacgatgagatatcattacatacctattagaatggcaataataaaaatagagaaaacaccaaatgctgaaaatctgaaggagcaactgaatcactcattcattgttagtgggcatgtgagatggtaccaccactctgggtaacagtttggcagtttcccataaaactagatatacaactactttataactcaggagtcacagatggcatttacctagaaaaatgaaaacttaagtttatgtaaaaacctgtacataaatgttcatagtagctttattcataatagggaaaacctataaacaacctaaatgtttttcaacaggtgaataattcaacagactgtggtacatctacaccattaattactatgcagcagtaaaaacagagtggactacgactacacacagaagcttgggtggatctcgggaattatgctgaatgaaaaaaagccagtctcaaaatattacatgctgtatgattccatttatataacatttttgaaataaaaaaattatgaaaaaaaataaaataaaaaaataaaaagttcagggtttttgttttcttttcttttttgtaatgagtttgtctgaaaacataaaaattccccaactctggggaatatcagaaaattcaggagataatataggtttcttcttgctgctataacaaattatcatacacttagtgtcttaaaaccacagaaactttttttttatacttctggaagtctggagtctgaagtgagtcttacagggttaaaaatcaggtgttggccaagctggttcttcctgtaggctctagggatggatttgtttcttgcctcttccagcttctagtggctgccagcattccttggcttgtggctgcatcactccaatttctgcatctatggttacactgccttctttccatctatagtctaatctccctctgtctcccttttataaggcttggactgcatttatgacccatctagatcatcctgaataatgtcaagatttttaatttaatcacatctgtaaagtcccttttgctatatcaggtaacattacaaggttccagggattgagacctgcatgtctttagggatctttattcactttattgaaggaggctttttcaaactgcatgacctctggagctgcctcagtctacccaaacccacttcctctccaggagaattaccaccattggaaacctgacagccactgttctgaaagacttgctgttgaggcagaaaaaagaaaaaaaaaacctgagaatctctgtctaaaatataagtaacattgtcatcactgactcattgattagaggtctatgagattttaaactctggataacaagtgattcaatcatgttataaaatatgacttaatatttcatattttggcattttataaaacatgaaatgactgaatgaagaatatgtgacagatattgagatttctattcagggagttttctttccatgttctctgtattgataagagctcctgagcatacgatgctcatggaggtggatagctgacacaccataaatgtgcctgagaatagacattttaagctctttagtcatgtttcagttgaaagattagatttaaatatttgccactagttcttaaaacatattcaagcaaaaagaaatttgcacaacaccacgctgataaatagataaatttcattttctattaaaaagttcattgctaggaatgacagtcaaagtcatattgatctccaataatttaacgctactaagaattatttaaatggtcacatcctaatttcagcattgcacaaatatataacctaaaagaaacaaaataagataaacaccctgcgattgtattataataccctctgaaaactcaagatccttttccacaaggttattgtcacactacctcctttttacatcatgtcttcatttttctctagctcacttaatttcagcttgagattccagctgtctatactttgttagaagtactttgttctggctatatttaaggtgcaatatctgtcactgcctttccatttccattgttaatggaactcagttggatacagtcttaaataatttttgccaggactagactttagcactactgtgaagccagcaaagtttctttcaggtaattagactgatcgaatctctccagtggcttctcgtcatccctgggaagagatcagactttctattacaagacataggaggtcctcccctatgggttcatgccaaaatccaaaccatcattcacctagcacagtaggtctcagcctagcacttctgaaaacatgtcagaataactcatgattccacatgcacttcatctgaaatgtcattcaagaactgtcaacatcttattcatgactcagaactgaattgggagtcatcaggtcagtcaggtttctctgaaatgctccctttagtcttggcaaacccttcctcctttatgtttctactgttctttacacacgccgctattaggacttcagttaccttccatttacacttatttgcacacatttctatgtttccatattaaaatgtgaatttccatatcatattataagcacttttgtatccccagttcctagcacagtactgacacctactagataatcaatattagccaagggctgaattcagaatttcacctctcctttcttcctgctttaaaatctactttagaaaacgtttgctatcattcacttatatgtaggtataaatataagttcatacttatatgaacttataagggctaattgctttttaatctatatttctaagggtaaaataaaggaagtttcctctattaaataagttcaggaaattaataagcatttgtgatgtttctgaggacgggaagcctttctgacatcctgatactccaccattaaagggctccctttatgcctcgtagaaagtaactccatgatttgagatctgtagagtccaaggctttagagtaccatgtatctagtctctgatctagtcacctgatgattggctcctctccttaatatccaaaatgacagtcaaaacccatatttgagcacatttcattttgcatatgtctttttaaaaatcatacactttgacacttctgagccctctggtcaatactaaatgaaattgcaaagtgataatttaaaaaaaggaggggaaatgcaccactgcaaagtttaaattaaaaaaccaaggagcacaaattacattagggcatctttttgctttttaatgtgatactcaagaatgctagccaccctaaaatagccataactagataatcaagattacaacaggaaactgagcataaattgctatggcaggaaactgattagttcagcaaagagacaggatgcgtcttgtctctactgttatctgagttaattctatgcctcctccatgggccaactgctctgagataaaggattgtcaagttgcctcatgaaagcaaactgaagtacaactaataataaacgcagggctaaaacaaagcacatctgaaattgcaaggatgatgaaatcagtcagcaaacatgagagcggcgggaaaaggcagtcttgcagtattatgtaaaacattaccatgaactacacaatattaagttctacacaatgtgcttataataaaaggaatattctcaaaataaatagtaggcatgatttggaagagggcttccttaagataattttttttctatgaaacctgaacaatctaaattggattgcttgaaatgtgtagaatgataccccccaccaacatctccataacttaattacctggtactgtgaatatgttatcttaatggcaaaagggattttgcagaagtgattaaggttcaggatcttgagatgggagatgatcctggattagctaagtgcgtccaatctaatcccatggttccttaaaactggaggacctttcccagctgggttcagagttagagggagatgtgactacagaaaaatggttgaaaagatgcaacacatctggctttgcagatagagaaaggggggtatgaggcaaagaatctgagtagcctttagaagctggaaaaggcaaaggaatggcttcttccttagagcattcagaaagaaacacatcccttccaacacattttagtccacgtaaacccagtgagactcatgtgaaagctgtgattagacagctgttagataataaatttgtgttgcttttagtcaacatatgtgtggcaatttgttacagcagcaatagataactgatatacacccatattctttcacaggctttatacaaacacaaaaaatgacacaaactgaaactcctcgtcattactccaaaagtagcagtttaacagatatgctgacaattgtgcatgactaatttccgaacaaatatttttcagtagcaaacagagaaggtcatgaaatggtagacccttcaaagaggaaatgaataattaaatgagcacttaaaaaaactgacaaattatcaactcctctcaatgaacccaaaagaaaacatcattcaatttacttgaatttctcttgcacttgaatgaaaataccctttatcccaactacttcccctatttttctctcctcctcttcccacaaacctgatttaaaagtgctttttagatgaattttttaaataaatatttactgacctgcatgttttctagaatttattatagtagtgaagacaattaaaattcattttgcaaactgaaactttgctgttattaacatggcatttattcatatttcagaccttactttacatctttctaattttttttaagtagagttgtaaatccttcttactcaccactttgcagcaaaggggccaaaaccaccacatcaaaccgatccccaggagtagcagtaacaccaaaataacaatgatggctgcgatcccgttagactaaagtaggcaaaaagcaaaaacaaagcagtcagcacagcttatggtcaaattccaaatgtatatatattttaaggaaacaccagaaaataattcagaaagtataatgtcaaactagattttaactatattattttaatttcttgaaattctacaaatgtatcttctatttaatatatattatgttttatgttatattgttgtgacaggaaataataaacaaaaactttcccaaaatgctgcagattctttacaaatacatctaaaaggaatttaggaaaaatcactaatcaggattagactggtctctatctttcatgtaaggattattttggttcaaagcaaattacccataggcagaatttaggcagaatcctgcagactttttgatggtgaaacacaatttattgcatgtagttaaataataagatgaatattaaaaaaaattatcaagtagatgacaaaccaacaatggttcttgttgggaaatggtatatacacatcaatgcaagaatgcaatctcatgcattcataaatcagatgttctctcattgaagctgaaatatgacctacacaaaaaccacagtggtgttctttcccttcctaactactgagctcctccagccttaaggcacctactctgggcgctgttcttaaaccctttcatataaaaaccacctactcattttacagggctcatattaagtcacttcatggaagtcttccttggaccctttgactataaaatgcccctttgattaaacaactcatatttctctatactttaatctttagtacttatcacgatgcaacgaattatgaattttgtgattatttgtttaatttatattttctaccatgatttattgtgagctctaggaagtcaggggttacatctagcctacttagcaccgtatactccatgtctggcatttaaaaactacttactgaggccgggcacaatggctcacgcctgtaatcccagcactttgggaggccgaggcaggtgatcacgaggtcaggagtatgagaccagcctggccaacatagtgaaaccccatctctactaaaaatacaaaaattagctgggcgtggtggcgggcacctgtaatcccagctactcaggaggctgaggcaggagaattgcttgaacccgggaggtggagtttgccatgagccgagattgcaccactgcattccagcctgggagacagagtgagactccatctcaaaaaaaaaaaaaagaaagaaagaaagaaaaaactacttactgaaagaatgaactctaaagaaaaaaaacagcaaaagacatggatacaaagaagaatgtttactgaacttttactgtacaaacagtttccaagggaacaaggggtatctcccaaatgcctaatccctaggatcctcagtaataatgttttgttttgtggtttttttttttatgagaaaaaattcagggaagaaaagaaaaagagcaaaagagaaagaagattaatactaatactttatagaaattttcaggcaaatacctaagtagcctgttcttagaaagaacattccaaagtgcatctttctttacaaaattctaaatattcatgaataaatcagctaccgtccacaggcacaaacacattaagctctaaaatctaggcaaacaagaatataacggaaaaaggatgtcatagaaacgcatggaaaactgtggtaccctatgggagaaatattgtcaaatgtataaatcttgatctcaccttcaaaaatatggtcttatgtaagacagcccctatctgtgactgtccatgtacagaaggaatacatttctcaccagacctttcccacatgaggatccagccacagcactcatagaaatggcacaccatttggctgtgctatacagctttcaaaagggctctatgaacatttggtttccccttttcttagaattcacacccatgttcagaaataaggacatgcaactagaggccatgaaactgctaaaaatttagtggttagtttgtttcttctatgcatgtgccaagaacaggaaaatcagaaaattgcactgacagaacacaaagtagatgggctagccctgctagatactcaaaattttttatttttcccttaaaaaaagcctccattagtagcatcgacaaaatattatgcatctccagatacaaatataatttattattacaatattatcatatcgactgattgcaaagatttgtcttaaaaaaattaaaaatggccgggcacagtggctcacacctgtaatcgcagcactttgggaggttgaggtgggcggatcacaaggtcaggagatcgagaccatcctggctaacatggtgaaaccccatctctactaaaaatacaaaaaatcagccaggcatggtggtgggcgcctgtagtcccagctactcgggaggctgaggcaggagaatggcgtgaatctgggaggcggaggttgcagtgagccaagatcatgccacgcactccagcctgggcgacagagaaagactccatctcaaaaaaaataaattaaataaattaattaaaaataaattatgcactttctaaagacctacagacctagtatatatataagccaaacatgatgggaaaagcgtcagggaaaatgcaacctggtcttgctatctatctatctatctatctatctatctatctatctatctatctgtctatcatctatctatctatctatctgtctgtctatcatctatctatctgatgactatttcatttactggattctttttgaaatattcaatatcaggaattaggaaactatggcacaaaggtcaaatccagccaatctattttgtaagaccctggcaagccaagaacatttctaccctgtttaagaaaaatgacatttgagtaataaatatttattagaactttttcagttctaaagagaggcatgcctatgtaaaactgagaagcttctagtttcgctcgtgatatagatctatatgtaatcaaatctagtttcatactcttcttcatctgactcttaagtccatagtttgcaacatggtatctgattacgggactgaattctgtagtgttccacatttccccaatatgtttataaagttttgggcaaaatgaaactgtttttctttcatgactaacatctttcttgctctgatagtggctctggctatcaaaacaaacacaatgggaaagcctgaatttgtatccagttaaccgagctgatgtctgggattagtgtattcagggactgtgtcatctgcatctaatttccttttcttcactaaaagcaagttatagaataaaaaactttattctgccaaatataactaaaattctagtgaagagaatcatagagatataaaaacaaatcagggtgactgctgcccttgcaacataactatgggacagaggaatcactggaaagtttcaaaagagcattagttattattgctgcaatctatctagaaaatagtgaattcacagcagccacattagaatgaaacagacacagaacggggaaaatgggtctccacaattttgtttcatgaatttagagttagggaaagaaaacagagtcatgaaacagataattatttcatttactggattctttttggaatatttgatatcaggaattaggaaactatggtacaagagtcaaatccagccaatctatttggtaagaccccagcaagctaataccttttttttttttacagtattacataaagctgaaaaaatcaaaagaagaatatgttacaagaaattccaatgtcagtgtacatagttttactgaacacagccatttgtttatataatgtctatagctgtttttgcactacaatggtagagttaagtagttgtgacagagaccatatggcccccaaagccttaagtatgtatttactatttggccttctacaggaaaaatttgccaacccttgtcctatataaatcaatgtagaatctggtttaaaatggcaacttgtggaagtgttcagtcagggggtgggggagacagacgtgggttcaattctgaattatagcatttatcagactgcaaaactgggcaagtaacaacctttcagagcctccaggcttcaagtatcccttttgcagggacagtaaggactgaaaccacctgctgttacactcatcaaaccatgcacctctttgagggctgggtccacataagaagaagtaccttctaatgtatttggataaaagtgcactgaatgttggaggtatcttcctgttcctcagttttctcatctgcaaaattaacataatctgaacagcctcctcttggattgtgagtgctaaatgaagccataaaggatttagcacatatacagcagagctgaacacagcgtctagcacttaatacttgctcagcaaacaggttcttggtattgttattgcaaaagagtcagaagaccagtgattccaagagaaaaaaaaggacatctttccattatgtttttaaaagcagagatccattttaaagatcttttgaggagagatgaacataaaggattgtctaaatacaaaccctcctcagactctaatcttaaatctcttaaatctaaaacttagtttccccattttaaactagatatatggttactttcaatcattcatttaggaaataattttggagcacttgctctgtgtaaggaccagttgtgagagacgggcaataagcacagcacaagccctgccgtcaatgtctcaaggctggtaagaaaggctcagaagcaaacaggaactcacagctcagttcctaaggcctcaataggactgagccctggatgttcctgaagcatacagaggagcttctttatttgtgagattttaacaaggactaaccaatgactacaataatagtgttctactttgtttggctttcaaatgcctgagcaagtaaaaagcattatcctcacaatgagcaatatcgctaactgcatttcacctgttcaccatatgcaaatatgcctgaaagactaaatatcatttaaatccaaggtccaggtattcatcatagtattacccactatactcttctattttcaatagatatttcatacataaatcagcaggtgcatctcatcagcgcaagtctcacttttcatatctatggaatggtaatatcactaccacaggcaacaggaatttgaggttaaatacaaggcaatggttaaatttaaggaggaaaaataattttcctataattactgtcaacctgaaaaattgaattgtagtatttattatcctgtaataactagtggaataataaaagtcataagaaagagaaggcttcaagtcatcagccttggcagacacggggagatcaccggtgacccctcggacattttctcagccctggctcaccttggcctctcccaggcatgtactgctgccctctcttcaccttggaattctatcttcctttgtcttcttcactcggtgtctggtcttcccacgtcttaagcagttctttctcttatttcttcacttactttattcatcaagacagccttacctatttcttctgcttgattaaactttaaacttcagtcaaattggatttcttctaactgtgggtcttggatctcccttttctttaagaatctacttttaaaaatttgtggccgggtgaggtggctcacgcctgtaatcccagcactttgggagactgaggcggccaaatcacaaggtcaggagattgagaccatcctggccaacgtggtgaaaccccgtctctactaaaaataaaaaattagctgggtgtggcggcacacacctgtaatcccagctacttgggaagctgaggcatgagaattgcttgaacccgggaagcagagattgcagtgagccaaactggcgtcactgcactccagcctaccaacagaacaagactcagtctcaaaaaatatatatatataaataaataaataaaaacttgtaatcacaaaatatttctccgccttttgaaaagcatttaaatctcctttaactctcagcagttttacagaccttggaggactgtctttctcaaggccctgggagccattcctttgagatgtaatcatcaagggagatagtgcccctatcacacggtctctgtagaagcggagaaacctaacatcagtggtgccttgctccaagttttagcactacctcctattaggaaagtaggagaaagtttacttttcctttaggtaaggtcaattagcagatactggtggcctataattcccaccaccctagctttgaaaattctccaaccttttgtttcatcacaggtaaattcactcttccctcttgcaacagtcttgacaaggtcttcttttcctgtttaattttgtccagtgcatttttgtctttgactctatgtattcctccccacttcaaaatgacattaactctaaattgtcccatttttcttccccttcctacaacctcagcaaaagcaaaacttaaatttttacttccagccctgatcactcacgagatgtgaagctatagctacaagtacctgcttgacattgccaacctcacttacacaacatgtctacaatgaaaattcttctgatctccagatttacctctcgctttggatgtttccaatggcagcatcattcttccagcccatgagattcaatattttggaatgaaacattcccccataaccaccagtaagtcactttataatatggatttcttcattaatacaatttatatggctatttctaggactatttctaccaccatcagtcaatttagaaactaaagttttatgcctatattctagcatttgtttcctaaaagctttctctgtgccttttcttttcctgtcctttctcttacatgtcattactaatttaatcttcccaaaatagtatgtttcaccatcacatgtgtgtccaaagctctttaaaaccatattattatttattggagtcagaccttgtgatttctcaaggcaataaaacctgaaaaaaaaaatctgctcacataaacttgccagctaataattctgccaagtaacagcatacaaggaaaaagagaaaagaagagaagaagcaggaggagggagaggaatatgaggaaggaaaagaaaggactgaaggactagggagaaggaaggtgggagagaagaaagaaggaaggatggaatgagggagggagggagggaaggaaggaaggagaggacaggaaaggaaaggaaaggaaaggaaaggaaaggaaaggaaaggaaaggaaaggaaaggaaaggaaaggaaaaaggaaaggaaaggaaaggaaaggaaaggaaaggaaaggaaaggaaaggaaaggaaaggaaaggaaaggaaaggaaaggagggagaggtcggtcctgacaaatgaagtgtatttcctcaatcaaaggatattttaaaattaaaataggacaaagaacaattttaaaataaaagaattctttcaagttgaataaatctaataatatgaaaaatataatccattttctttccttttttcatttcaacaccgtagagtttgggaatcacagcctgtaggatgaactctaaattcaattcggtttcttaggttgttgataatctggtctacattttctatttccaagaattccttccacttatttctactccagtcaaatgcatctcctctcaatttcgtcaacacatccccaccctgtttgctctttctctataatatgctccccatcccctttctttgctgacatcctagtctcccttcaaggccctgtctgtctcagttcctccacaagcataaaacctttttctggtactctttcccttcttgctctaagctcctggaagccactatttcccagtaaatattatgtgaaattttgttgcctaatttattccatccatttgtcaacaactaacagctccaaagtttgtacatccaatccagacctctctcagaactccagacttgcatattcaggggcctgacatttccactgcgatgtccaatagacatccctcattcaacctcaccacaactgaacttctctttgctctgaaactgctgtgcctgatgacaattcatccttctatttggcaaaaccacagttgcttttgcatcaacctaatagttgctcaggcaaaaacacttggagctattcttaatttctttctttatctcacatcccacacctaatctgtctaggcatcccataaacttcccctgtaaaatatattctaattcaacccttctcaccatctccaatttgatcaccccagtggggctaccctcctctgggtggggaaggattcctgcattactgcaatagccacagaattgggcttgatgtttccacgtttgctgctactcgcaaagtctgttttcatacagcagccagagtgatcctttcaaaacagtgaatcaaatcatgtcaccttccaaggtcttcctgtttcactcagaagaaaagctcaggtcctgacaataactatacaccctacaggatctgccctgctcctgccactctctcttccttatccagaggctcccactctccctgactacttccattccagcacactggctggttgctcttcttgaaacttgccagagacttgtcacctcaggctttgctctagctgctccctctgtgtggagcactattccctcagatggtctgcaggcctcactcccttaccttcaagtcttttctcaaagccttccttcttacggagaatcatcttgaccccttcttgactgttacagcttgctcctttccccttacctcatcattgacacatcaatgatcatttttctgaaatctccccactcttaaaccatcttgagtcatattaccctcactcaggagcaagaactagaaagtcttccttaaagcaccaacctatacatcccacatgagtcatttagcctcagcatccttgcatgtgaaaatcatgcattgttataggataggaacaaagacctgttttcctgcttgcatggaagaaaggaagaaaaagacagtttgtaggtgtagaataggaagaaggatgaggaaggaatgccatttcagtgagctaaacactgagaaactacaaaccacaaatatttgtaatttcaaccacatcctgagggaccagaaaaccagcaaactgcaacatccacaaaatctacaaattgcaacatgcgctagaaatgggagaaaaaaaaccctccccaaaaagcacaaatacaaaaacaaaaaacctagctattttcaaaatagaagtagctgttggtaaagacttatccaaggagttaaaaagtgacccaagggtccatatgatgtgccttttacctgaagcattgtcttaaaatgagaaatgcaactacctctatacagataacattgaattgttttgttttgttttctgttggaagggtatctctcgaattagtagatcaaaatcaaaatataaaacaatgaaaccgtgagatgtgagaaaatgtttaggtttaggattttggtcttttggagggcaggaatttttctttttttgctttgatttacatattttttacaaaatatatttagaaataataaccatgtggttggtcctgtttagtgctgcccgtttccacgtgcaataatataatattgaaactttctataaatccacaaaattaaataaaaggaagaaaatgtctactgaatggagcttatatttcaaaatactgcatttaggtaatgcaaatcagtaatctcaaaatatatattcgatgtggttacaaattaagatagtatcaagctgtcaaagtcaacttcctcattcagaaagcaccaatattttaaatgaacaaaataaaaaagtcacacattaaaatgcaataatttgatttcaaaccatgataaatgtttagatactgtaatctaaccttcctaacagaaaacataatttctatatttaatgttttaagaaaaaaagtgcttcatttgtaaattattatcttaccttattttgatttcaaatatgccttttaaattctataagtatgaaaatcaaatgcatactaccttaaagttcctataaaagggagctcaacataaaaaaaagcaatgccacccaaaacgaattctatacaaaatttttccttgtaatggtctccaatgttattgtttgcatctcctttattgtagtatgcaacaacaccaaagatccatagattatttctggatggaattgcttttaaaagataatctttgtgcaaacttttacttacacattctgtggctgtgacaattaatgatcctgaaatgacagattttcctccattaaagctcactgaaacatcaagagttctgaaaaagaaaagaaacaataattttatatacatttaaaaccagaggagtaggagatttttatttccttatgtaattcaaaaccagccagaaaacatacttaaagagtaagggtctcaaactcctgacctcagatgatccacccacctcggcctcccaaagtcctaggattacaggcatgagccaccgtgcccagcatggccaacatagtgaaaccccatctctagtgaaaatacaaaaattagccaggtgtggtggtgggcccctgtaatctcagctactcaggaggctgaggcaggagaattgctggaacctgggaggcggaggttgcagtgagccaagatcatgccattgcactccagcccgggccgacaacagcgagactcagtctcaaaaaaaaggaaagagtaagagtcacagcttttggtaaattatgccagcttttttcttccttagttctagtctttacttattagtcaggcaaacttattaagtggactaattgtttctttacaaagtagtaacagaaatacaggcattaagaaatttctaaatccagaaaaatgccaaggttgtttcaggttcacaaaaacctacaaagaaagaaaagctttagatcccatttagcctatttctctgtctctaggtattactactaagaatataaaactggaagcaataaaccagtcaaaaataaaatataaagaaagtgaatatgaaagacagcaacaaagaaaagaaagggagaaagatttatttgcaggtatttgttgcagatggtccaaagatattaaaatatcccgacaaaggtacaaagaagagataataatttttgtccctggctaagaaatattatagttaaaatatagttcttattttgaaaatatgatttcaaattataaaacaagtaataatcattaaaatttcattaatttagattgattatttgggattagcctagagttagtaattttttattataaaaataactaaaacaagatatcaaaagggaaaaaaatgacaagagggtttgtatggaaagagctcttttccaaaatagtttacaaaggatattatcatataattggtttgcaaacaaatcaaagccatccatccacagggtaggcatggtggctcacgcctatagtcccagccctttggaaggctgaggtgggaggactgcatgaacccaggagtttgagaccagccccggcaacacagtgagatgcccatctctacaaaaagtaaaaataaaaataattagccgggcatggtggcatgtgcctataggtccaactattcaggaggctgtggcaggaggatcgcttgagcctgggaggttgaggctgcagtcatctctgattgagccactgcactccagcttcagcaacacagtgagactctgtcaaaaaaaaaagcaaaaacaaaaacaaaaaacaaactcccagaaacaatctcaagctgttgacagaaaggggagataagaaatattattcagttcttactattgccagatgctatcctaggcattttatgggcattatctatttcaacccttcacaatagcccttgaagtaaatagtagtttcacagttttacagatggggggcaggaggcccagaaatgttaattactttgcccaaagtaatacagctaggattctaactttgaactctttccatcatatcagagaggcttgattaaatgatgaaatcaaagtccttaatgtgttttttttctcaatgtgctatttggtttggattcatacaagaaagctactgggaaggatattcctggcaaagttcaagctaaattcaatcaaaatatagaaatacttctattaaaatatttctgtgtaaagtatttacttcaaagcatcttgtttaaaaagatggtttagctaggctgggcgcagtggctcacgcctgtaatcccagcactttgggtagatcacgaggtcaggagattgagaccatcctggctaacacggtgaaaccccgtctctactaaaaatacaaaaaaattagccgggcatggtggcacgtgcctgtaatcccagctacttgggaggctgaggctggagaatcacttgaacccgggaggcagaggttgcagtgagccgagatcacaccactgcacccccagcctgggcgacagagcgagactccatctcaaaaaaaaaaaaaaaaaaaaaaagatggtttagctaaatccagaagagaataagaattccggatgtttacatctaattaactatacttctgaactattccaacacagaaggccaagtggcgtattaagaaagaaaacttaaacctaattgctcattctgaagaaatgggtgccttgttttgtttttttaatgactaagcataatcaaataaaaaattgtcttccctagttcttaattcctctactttaaagaatgtggcctgaatcatctgacatgttggcatggttttattttttggaaagataattttcattcataataatatgtgattcttgcaggtaatcttactgattcaactttaagggatcagtagacattgactgaagttgtttataatctgacagttaaaattcaccagaaacgaacaagttctctaattaatgaaggaaacattcaaacttttaatgcttaaaaaaatgaaatgagaacagaagatgtcattttaaaacaaagtttactctttcctatggtagaaatgcatgctgatatgatcttgtaaccgacaaaaataactgcattctccgaaaatctcattctagtataatgtggctggtgtaaaaaaaaaacaaaaactgagttaattctccgcagatatagaaatccacttgatgatatatgatgtatggaactgaaacaagaatatcttcctccttttgagagtagtagtagcagcgtgatcaaaatgtaaccataaacaccactcataattacaggcaattgttgatttcttactaagaaccagacacattaattcatcttctcatttaattctcacaacaacctactgaggtcagcactagcatcatctccattttgcccatgaagaaacaagcttataaaggtaacttgtccaaatattggacttcactgactctgtactcaaaatgctttcacttctacaacatactactttaatcctccacatgtattttagcatcttatatttaaatttctctcattagtatgagtttcatttgaatcttctagctttttactacattcacatatttctcatggttaactagaatggcatttactatatgctaaagcaatatatttacttgtgaatatatatatttatgaatatgtgtgtatagatatatgtattctgtgaaaatttttcagaaaagttgcaaatatgaaaaacacagttacatctgcttttaaactttgctgcttctttagaaaaacatttttgaaattattggtatggtactggcaccatcattaagctagagcctttgcccaaagctatgctactccttttctggcataggttgagaaaaccgcccactgtaatgcaaaccaaattcggtaagctttccttgcctcaagagtcaactatacatatttagtgttttctgtcatattttatgtcatttctgttagcatctatggattgttattcctactcctacataacttctacttctagttagtatgtttctgacagtggaagccatacgctcagtaacagaggctttcttatgggcaaaaatgtattaaaacaacattgtgtttacttagttgcaaacatatatgggaagcaagagagcagttcatttttatttgccccaaggatctaataatattgaaaaagggcatttgggcgaaactggagtcctgagtttgaaccctcatcactccatttttaatcttccatttctcaatctgtaaaatggggataactgtacctatttcaaagttgttttaaggaacagagcttggtaaaataatatacataaaatatacaacacaatacctgggacacaacaggtactccataaattaccgttaacacctgaatatttgtctaatggattatttagaatatcaaggtactttttaataaaccttttagatccaagctaagaagaaatgtatatagaagcaataaaatcattatgtaataccttttgtttaatttaattaatttctattctgctcactgccatataaaaatattgtaagctaaattgttcaaaaaatgcctactatataatgtcaggcagtttcatgtaaaaaattttttcaatgccatattcttcctgttataaaacatgaccttgattaaatccaacattatagctatgttgagctctgtgcttaaacctcaggcctaaaatcacactccaaattggtttaggaatatctgccaataaaatcactcaatcagtcacttattttattactagttaattaaatgagtatttattaattgattgtagtagcaatgataattgggctgtacttggtaaaatggctgcagtaacaaataatacaaattacaatgtaaataaaaggaagccccgtaaacaattacaaaagaatgcgatattaaataggtttaggcacaggggttctagagggctgtgtgggagattcaacagacttggccttggcatagaggcattagcaaagttttcctgcaggaagtcgactacaggatgaagcttaaagaatgatcagaagttaggaaatgagattagaaaggagtccatgcagatggagcactccgacagggtggaaggcaagaaagggacagggacagaacagtcaaggcagtaaaagtgattcagtactccagcaacaaaagagggtgagagtaagaatgaaatggctccaggttgaaaaggggagcagagaaaagatcattgagtccctggatgccatctttagacatctggaattcgtcttaagagttttaagtttgatagaaatatagttagaaatgtgttttacaaatatcattcttgttacagtgtaaggcaggggtctgaagaataaatttcaaaagtagaaagaccagttaagaaagtctcagtgtacttgaaataagtaccaaagtagaattgaactaaaatagtggcaatgaggttagtgtgaaaacaaaaactgagacatattaggagttagaataaaaaggacatggacatttattggatgtaggaggtgaggaagaagaaaaaaggatgacctcaaagtttctgtcttacacaagtaggtgggcagtcttgcatagggaacacagaaggagcaagtttgaacagaaggatgtgagtttaatttgggacctccaagtttaaggtgcctgtagaaaatccaagtgactttgtagacatttggataggaggcatttggacagcagacttaaagctagtaaaaagatcttgccaggaaatttggagctcatcaggaagaaaaagggagccatagaaagggtgagtttataagtcaagtatcctccaaccatgataaaaactgaggggcactggacactgtggctcatgcctgtaatcccaacactttgggaggccaaggcgggtggttggcttgagcccaggagtttgagaccagcctgggaaacatggtgaaaccctgtctatacaaaatgtacagaaaattagcagggtgtggtggtacatgcctgtagccccagctactcaggaggctgaagtaggaggatcacctgagccagaaaggccaaaagtacagtgagtcagatcatgccacttcactccagcctgggtgacagtgagaccccacctcaaaaagaaaaaactgacagttaagagactgtaaaaacaaaagtagtctaaagggatatctgaggagaaaggggagaaacagctagggtgagaatatgaagtcacaaaagacaagggaaaaccttctgagacaagagtggcaccttgtgcagataatacagggaggtaagggaagataatgctgggaaatggcaacactttcaacttaattttctataaattggttctacactgtttaatatttcttaacaaatatcttaatccatgctttgctccatcattaaaatatgttttttcaaagtagaaggatagaagaaagcttaacaacttaatgtaacaaaaagattgattgaagtgtactttcatgtcaactgacaattaatagtaataaaattaaattcaaacatagtaaagtcattccacatgagaaattattaaatagtactatgatacacaatttagtaaataaaactcactaagtcctaatagtcacatacttctatttaatgtctaaagatgcatgactcttccaaaacaggagaatggctcagtgccatatgtcatagctattctgatctaagaaatgttatactccatgaattatgattgacatttcaatccacagtaacatatttgcaaagtattcatttgcttctgactttatatatatccaataaaagattgtcattttatgatccattaaaaaggatgaaaaaattaaataaaattgtgaaagacatttgctggaagtaataaataatttaccttcaatttgcacatactgaaaattaaactggcagctactcaaaaagttattacaattatggtgacttaagatattttgaaatcaagtgatactatttaatgttctgcagtgctttttaaaagatagttttatgaatgataaagattttaagttggaagataagattccatattcatgaatagtttaaaggtaccacttctagtaattagtttatatgtaaattaatgttttgactaaggatactttcttaaaagtggctaaaagatttttgaattaaatgacttatttttagcatatctcaatatgtgtaatagataaaacaaaaattgcagttagcaagatgtctacatttcagaaggaaaaagagctatattcagagatttactggacatcacaggaaagctgtattataattgttctgagtattgcactaaaaataagcactttccatttgctgtgtgttttttaataacattctaaaaagacacttaaaaaacaatcaccaagtcaatttagtgcctaaatcaatcaaattgagtgcctttcatccaaaactttaaagagtcttagtgatatggttttgctgtgtgtctccacccaaatctcattcttgaattgtaatccccccgtgtaaagggaggatcctgataagaggtgaatgggttatggggatggtttcccccatcctgttctcatgatggtgagtgaatctcacgagatctgatggttttaaaagtggccatttttcctgggcttgcacttctctctcctgccaccatgtgaaggtctttgctcccccttagccttctgccatgactaagtttcctgaggcttccccagtcatgtaaaactgtgagtcaattaaacttctttccttgataaattacccagtctcggcagttctttatagcagtgtgagaacggactaatacatttagtaataatgaaaagctttgataatataaaatttagaagcagatatataagaggatttaagtacctatttcaagaatattctctacatcctcatataggtgtccatctttaaatacttttcattgtccaaataattatctactaaataatttagtagaattatctactaaataattctaaattttagaaagtatttccttatattgatctgaaatgtgcttccccttaacttcaccctttttctcctatagcaataaagaacaattcaaatctgtctgtcatgtgacagatcttccaatgtttggagagttaatgcatcacatctgaatagtatttttttcagtattttaaattgtatcctatttaacattcccatacatggtgacatcttattagccacccctccaggtgttcatgtgttaaaagacattgccagaaccgtatataatacttaggatgaagaggcaatgcagatgaggtgaacttatcacattgatagatataatttgaaaacagtgcaccatgtgaaggaaaagagaaatgttccaccaaggaagtgtggggtagagaaacagagaaagcccttagctttaacccatatcatcatgattctaatgttcatattcaaataaagacataactaatgtcttaatatccatgatttttccaaaaaataaaatctcattcctcacaagaagcaaaaggaataatgttgtggttgtatcacctgctactaacataagagaattagggattctatagacatacacacacatacagatagaagtatacttttggaaagaacagaaactgtagtaaaggcagaatttatctaatcaagaaagagaaatagaattaatcaattttattccaggaaaaatagattaggcttaatactgaaaaaaaaagttgaagaaaataaaaagattctattatgaagccaggctctaacctcaattctgccacactgttcatctcaatgatccttcagttttccttgaaattttccacagacagtgacgtcccaccacttctttctcaaaacactctgtcaagtgtcttcccacactgccttttaagagaactaatactatcagtttcatctgatttagatatttatttcatatttgccagaagattctggccaatgtttttgaaagcacatttaactataccatatgcctccttaaatcatctctatcaaaaaaactgtaggataagactccggttcattctgttctgtttttctttcttcacaatgtgtttatgtatatttacccaatttgctctgttcttcttgccaaattacaggtttgagatctcaactattgcagaacagctgtgctattgttgatgtctcacaaaacaagggtcatagaataagcccacgttgcaaatacttgtaatacttgcacattaaactgtgaggctagtgccctggattagggaacatccaaagaacatcagagaatgcatcctattcaaacttaaagaagacaatttggcacaaaggaaccacttttagaaataaatttctaaataataggcagatttttcttggtaaaacagtttgtttaatcatacaccattttaaaagtaaaccgtgttcatccaaaaaaatagaaaacaacctcactactatgaccattctttctgtttaaataataagagtttgttcatcttagcctaaaaatctatatcaaataaagaaatttaataaatacagatctctgtatcagacagatctatcaaaaaaagttattgaaagacccatctgaacaatgctcaaaatgatatacctggacaggatttgcccagataactttaactttcctttactccataacatcaaattccaaatgacgacctatgtcctagctactcggctacattcttactcccccatctcccacatgctcttttaaaccaaaatccacaggccttaagtttttaaaagaataatcctcaaacaaagtgaaattcatgaaataacataaagataagaaaagaacggatagagcaggctaatgagatgaggcacatgcccatggatgcagctctgagactgtgcatctggctttgaggctctctgtctagggttacttcaccagcatgttgttaattatttaagtgagagaatgaggggaactatcaccacatctgtcaccctcacacaggaaaaaccttcattcattgttgggccagatgtgtttatctgaaacatagactaactagctacttaatgggtttgaatccttagccaaaagctaattaggcaaacatattaagcatcagtcaccttacaaggctaaactgtttcaattgtgttgatttcaatccaatctcataagagagctcatcacctacaaaagtgtctgaagaaaattcaaggcacaggaaaggtccaaattacttgcaacatactaagtaaaataaataatgatgtccccaaatacccagtacattaacaaataaaatctaaagctttgcttcaatggtatcatgtacctgatccaggaaaggaagacaaaagcaattcttttagacacatctctgtcccagaacattctcagtttgcttgtaggtgaaatattaatgtcaaaatctaaatgaatgatgatttctcatgtctgatatttattatgctatgtgtgattaaaaaatgtatctcctgggtatttaacctatctacaaataattaaagtgtatcactagccccgatggtattctcttctaaagaagactgtgcccaaaggcaaattctagagaaaacaaaatcagtgcctgggataaaacaggcataatgcattttataactacttcagagaagaaagtaaattactttctttaactagtcactattatttgaaagccaagattttttttttctgctttaaatagtatggccccccaaaataaaattctgaccattttcctctatcctggtacaagtacctgatcccaccaatcaaatgacctctttcagatcgttatgttaactggtaaacaaaaatatttaagaaaaattcattcatccttttatccaccaaacatttagtaaatctactatgagtcagacattgtgttaagtgctagtaatacaacaagaaacaagacaaaacgtgtcctagcaggaagtagaaacataataacagacaaacaattggctttggagaaaaaataaaacatgaaaaaggtatacaggttacagactcaaagaggaagattgcatgattaaatagggtaagttaggatttgttttgttttacttagactaagttcacatacagttctacatcaggggaagagcaatccaagcagaggcaacaagaagtataaaagtgcaggtgcaggagtgtgcaggtgtggtcaagaacagcaaagaggccagtgtgaccataactgagtagaaagagcaaatagaagatgaagtctgagagggaatgagaggccagaccctgtagaacctggtacagtattacactaattagactttactctgagtggggtaaagaactcatcacagagaatcttaagtgaagagatgacataaaataatctgttttaacaagatcactcttgtgaaggatggaaacagaaagaccagttgagagactaataatccaagcaagagatggcagtaacttggtctagaatggtagcagtataggtagaaagcagagattggattttggataaattttgaaattagagctaagatttgttgatagactgggtctaagagagagaaagaaatcaataatgactcaaaagatttttacctgaacaacaaaaatgatggagctgccaataactaaaatggaaaatacagtttgggagatagattgggggaatattcaggaggaccaacctggaattacagattcactaaaacaagactaaactttaagtcaatagatgtatcatggctaatacagacacgattattcagaaagccttgagtcctacggtgtgcttggggttaagatggctccacaagaaactgacttgcctcaaattccaatgccaatttaatttagccacaggcatgttgtcaataacatagattattacatgatacagaaaacgaataatactcttagttttgtaagccatcttgtgcagcttctttgaatctatttaaaacagaaagctgatactgctccaatttacttgcatgaccaaaagtgatgtgcgatagatatcttgaatatttaagtatccacaaaagataaatgttcaagtcagcttaaaaatgctagaatgattttcttagtttcatagaggaaaatatcattttcagtctctaaatactaatccagattttggattgtggccttgtatatgtaatttttccctgctttcagtatcagatctatataaagagatcctagaaaactgtatcctattaactatcttaaacatgctctactgttgggctagagaatatctgaactatttgtaatcatttgcttcatcatagaactgaaaaaaatcacaaatgggaacactaaattatcagtagaattacttgtgtataaacaattcaaataagactccttcatccaaactaaatttatttttctttttagcagatatcgtggttttttggccacacaaaagaagatgaaaagatagaccttaacagaaatggaacacaaagcacaagttaatacaaatgtacaagtatttcctagtgcaaggtgtgcctttttttagccatgttcttgaggcactttaatcgcaatatttattaaatactatagtaattattgaaaatctcacttttgaactgggtgtgtgcatgcacacacatgtgtgtgcgtgtgcatgtgtgtgtgtttaaaataatgtttatggctctgattatttatagattctaataatagttctcaaacccatccagataaatattcatagagccttttaatcagtattgaagaaactagctaaaacactttttagcattttcaacctactaagagtatagctgaagtactaacttgcttgcctagtactaagttaagtggcttgcccaaggcttactttttaatgctctgtatatcaaaaaaagatagaataaaatgaccaatgtatatgtcaccattttctaataattttttactaaaaatgttataaaattgttttaaattaagtacttactctccagctttattcaggataggtgcaggacaaagcatagaattaagctgtacacttactggttttacacctagaaaataaaatgccactgaattagtaaagggttttatgcatctcacacagtttcattaataatatgaacagcatgcttcaatcagagttcaaatgtggaatactagatatattaacataaaaaaactaaagaaagagaagtgaaagggaatgaaaaatggaaagagattatatgctccattgacatatagtgttggtaaatcataagttaggattattttgacttagactaagttcacataccattctagatactataaaatatattttctcttaaattttttaaatatctcagatttttaaaaacaaatgctccgtattattttaaaagcacactttagaaaagatgaaggaaggtgaaagttagatgtccaaaggaaaatgaacttatttcacaagtttaataaaacatttgtctacaataaataaatgcattttatgaagtcacatacttaaatcgcccttgtaactttaataaaatatgaaaaaaatgatttagactaaaatatgcagaaaagttacttagtcaaactgatcattctagaatctaaaagaggaaaataccaatttcacttatttgaggatttactttaataaacctaatcttatgtagctaaacatgaaatacgtttattttataatgaactcaaatatgtaatcaaaaggagctaggtgaagctaatgcttagatacaaatgactactgaataaaaataaaattatcttgtcctactcaattgtggaacctactatgaagagagtttgtaaatttttgccttactaaaattgtgatcttaatagaaaagagaggaattaattatgacatttagcatgctaagatccttaccattttaattcaataaacacatattgaataggtactgtgtgtatggccaaagctgtgttaattggagtgtttatactcagataaacagcaaaatggcagatgaatctaaaaaaataactctaccagagtttacaaagttataaaatctgctttacaatataaattttgaagggcaaataataattaataaggaaaaacatttatatagatactcaagatgctcagaaaactaaggtctatttaagagggagggttttttcagaatgaaaacaaaaacgtactcttggcttttttaaaagtcaaaggtagggaaaattaaaactcaattcaataaatacgaaaattatcaaccaaaactatgctgggtgagaatttgagatgcaaaaatctataaggcaaaaaaagactatcttcaataaattaacaaattattgggaaattagataaagaaaacaagtgacaaaaaaaaagaaagaaaaaaaggaacaagtaggagagaagctgaagataattagattttaaggcaggtgtgacaagaaagaagcctgaggaaagaagcaattaaatcatgtgtttgatgtagtaggtacagagtacagtcaggaaaagtgggttcaaatatcagctctgtccattattagctgtgtaaccacatgcaagtaatttcattcttttagccacaaaccatcatctgttcaatgagggaagttaggacagggtccagcatttattaagttataaacaaatgttgccattattaaataactattaaataattatcactactatttgtattatcattcagacttcatttctttcttcttagattaaaaaatatgtcagttagttttcgttggagaaaaaaagaaaacatttgatgctgatgtgctttgcagagattaagacaacactgagattactggggacctactcgttgtatatgtttcatttacagtgtaagtgcagagaacactgccattccgactgcccagcatgaatcctcttccacttaagacaatctgaaattcctctagaagtaaaaggaaaaataaacatttaatcactgctttaccaaaaaaataaaaaacacaagctgaaatgaaagtattaaggtgcaaagaataatttttttcatactattcagttaactaatagcaatgaagacatagctctatatttccaactgtgctggctttcccagaccctctaggtaaatgtagtgaagataccattcactgccacatggggatgcattattttattttctaaacaaagtgattcccagtagtgaccaaggtatagaacagaagcattaacagtcattcccagacagatactatacaaacctcctcaacttctatccttaggaaaataccagggggaaaaaactttgtttttccctactctcaggtattaaagtttgggaatgtaaataaaactaattatgtacgttttttagttcttcgaaaagtcgtatgtagtactttctttaatctatgcctgttccatacagaattcttctttaaccacttcttcaccttactaatcctgattcattttctatttcaaacctataaataatcaaaagatcacgtattttgaattactaataatcgatggccagtcacaaaagttgatttaacttattgtaccattatttatagtagaagcaagcactaaaacttgttagagagtgagagaataggctggaatgaaagttaactgatcaaatatcttgacagacaatgcatgtttactgctaagctgcaagatagtatactaactattttaatagtgattaacgcttatttaaaaggtaaattgaagcacaaataaaattttaaatagtttatttgagcagaagattcttgaattagacagatccaaatcagaagaggtttggcagctttaccaagggaatacaagggggaggcttttatagaaccaacgtggaagtaaaccaaagaaagtatttgacgggttatagttacacagttgccttgtttggtctatcctgtggaaagtccctagttatataagtttgttggttgtttttgattggttgcacttaaattctatttttcttaatgtaggcattgacaataaatagttcaaattaaattccaattatatttgtaaatcaaataaggttaaggctacttacgaggcctaagtgtttttgcctgcttaaggcttcttcaggcctgttctctattttaatttaacattaccagtcctctaaaacttctcatatctaacataatacaagtataatatagtcattaactatgcaagaaactactgccaacccacttttcatttactatgttatgaaaggaatttcacttgcaagttaaaataaagtgcaggtaaaatgtgattcggtaagagtatgggcattcaagtcagacaggaaagggtcaaacagggtaattactagtagcaagtactgaacctgtctctgcctcagcttccccatctgtaaaccagggatgtataaaactttcaatagtgttgttataaggattaggtaaaattataaatgcaaacaacccagtataccctcagcacaaaattggagtttaataaacaacagctactattttaatattatttttccatttatttttctttgttatctctagaaatgtattaaccttcactgttagggaagataatccttccctgggaagttcagatgcactactttccttaaacatctccatattcattcattagggaatctagaagatgcagaatgtgagaccatgcacaactggctgagaggctctatggtacattacacaacatattttctcccccaccagacccaatatttttcctttttaaagtaaagtcaggttaaaatgaactgtaggtcaggcttgaaaaagaaacaaaataggccagagagaatcacactctgtctgggcaaggatggctgggaggtgtgaaaacctgagtatgtgcttagcaccagctgataaagccacctgcttccttcctgcaatccgtccataagtcacttccttatgtgccctgagctggcagattctgtactttgtccaggtcatcaaagcatggagctcaaagtctacatatacctgactgtttgtataatcagacaaaagaaacaatttcatattttattttatttgccataggaaaggtctcaagcgtgaactaaatatacagaagattctaaaagcctgtcacacaatatgctcattatttaaaataacattccaatcttaaaaatttgaatttaaaatagaaatatttcaaggaattatttaaaaattcttacacaaaaaagatgccaaaaaagttaattttgctattctttttccaacatgagtttcatatcatatattttagctaggaaaaaaatacaatttcttacatggtatttttaaattctaaacacttaccccccacacagacacttgagggctgcaattctaggatttcagtacatgactgagctagtatctaaaaaagaaaaaaaaaaaagattaccaagctatagatctaaaattacaatgtgaagtaaattataagattagtaataaccttgaggtcttctccatacttcaatagatctcagagaaaatctattaactatagcgtgtacagctaccaagttcttaggaaacttctgcactgtatttcagggtatattttaagattatgtactgtaggatccttatttgattaaagtaaattcagataagcacaggaaaagtgagcattgtctcaaagtctgataaccttgggtatgaatagataactaaaatttcctgctgccataaaatctatgttgactttcccaatcaagcaaaaacaagataacaaatcagaccccctgtttagtaatgctgttatgttttctgttcagaagaccaatataatatcaataaaaaagcactgctgactgggtgcggtggttcaaaataatatcaataaaaaagcacttctgactgtgcacagtggctcatgcctataatcgcagccgtttgggaggccgaggcagagggatcacttggggtcaggagttcaagaccagcctggccaacatagtgaatcctgtctctactaaaaatacaaaaaatgagccaggtatggtggctcgcgcctgtaatcccagctactcgggaggctgaggcaggagaatcgctttaacacagcaatgagccaaggtcatgccacttcactccagcctggacgacagagcaagcctccgtctcaaacaaataaataaattaaaattaaaattaaaaagcacttctctttattggacagtggcatttctatcccatttctcaggcttaattcctgtgggtgctagtccctcttacttgcataaaaaattacaattgcagaacatagactccttatatgagccaatattctttttaaaaacacagactccatactcaagcattcccagaacacaggaacagaactgctcttcttagcttgttctgagaaacagaaaccaccacacaagggacaaggctacaactgaaaaacaatgatgaaatacgctgctcctcatggacaacaatcctgtctttatttttagaactgctctgcactatattatcagtcagacaaattccagatgatctccagaattcctttcttgacattcctttcttggcagaagttgaagacagattatttacagcagtttctagcatctccttttcataactagaataggaagtaaggactgtagcaggaaatagacatgctttctgtgctttctttaataacagcaaaactataagttctcagcccctaaaatcaactgtgtcaaatcatggaactttgttgctgaatatacatctctgaaaagagggaaaatttgtactttttaagataactttccaataaactcaacttttcacatagtgattgaggattttgtgattagaaaacaaacctcgtaaaattttatatctgagaaactgcagatgaggcccatttaaatccagaaatgaccaaagagattccataggcactcaaagacctttctgcacccaaatacctcctcttggtctgctactttatctacaataaccaacattcacttttatggattcaagaattaagaactcttgttaaaggttaatgtgccctcttggaagggtagtatttcaaatcactaacatctttaaaaatttggacataattcagataacaagactctgaaggaaatagaatagaaaagatttgcaaaggaatatgaagctgaaaaggttccaactaacaaaaatggacattatagctatagctttggccaatctgagataacagtgacaacagtgaaccatcaaaatggaaggttaaaggaaaacacaaaacccccaaatctattttgtctgtcatcagtcctgaaggaatttatcttaaaacagatcttattaaggagactaattgcatctttcagtttataatctctttagttatttagccacagctttatcagtattactgaaaaaatatttcaagtactcaggaaaattatgaggcacttaaagattacatctattggcaatagaaaccatttctctgcaattcctcagaataaagtaaatcaaaaaattacaaaaggattttctaaagatcatgtcaaaaaacatgcatccggaatgacttcagtgaatttgtaactttatatttgttttctctcttctatcagcactgaccataagtcaatcagatttcataatatttaagataattgtgcatatgttgacttggtcttttaatttgatccaatccatcaaaacatttctaaataaatgagaattccaatagcaatatcaaataagcaattctcctaaggagatctctttaaggctgaagaacaaacaccctccaggactgctggtgatctacatctttggagccaggccctgtatatcccctataaggtattttaattttaaagaagaggttcaggatgattcaacaatttatgttctattaaagtctgagtttaaagaaatcaagttaaattaagcagagattaaggatagctaatgttagatatatcctgcagtaaacagtatagcttacatttgctaataacaatacatttacattaattcaatattcataattattttaataaaataagtttttctaaaaataatataattgaatggaaaagtgactcaggtaacacattcattgaaaagcaaatagtgagagcacaagtcataacattggtatcacaatctaatgttatctaattgaatttccatggcatatgctcctctctaaagtttgttttatttataaaaaaaaactgtttggaccttaaattatattattagtgcataactcaactcttctactagaaaacaaactttttgaggaaagaaatgagattgaattatactatacagcacattcagggccttacacattgttttgtgccttcggtacaaccaataaatgcttaaggaataaacattgaacacataaattaatgaggatattaaaaagtcttattaacaaaccaacaatcatattaggacacagatgagtcaggataaagttaatttatgtgatgaggcatctatttcttccataaattatgaatgttggaaatccagaaatctataatttgaaacaaacttcaccaaaaccatttccaaatgaaaaatagagaggagggagaagagtaagaagagaatttatgcatttttagaaaataaaatttgttctaaatttgttcttttccatctagagtttaccatgttccaatattaagaaagcaacaactagaaatcaaaataatttgatgtctgaatgcaaatagtttgcaccataagtttttttgaacagttttacaaaaacaagttaatagtctattctcaccaagtaattatacaaattgaaatgttcaagatatcaaaatgggtgaacagacacttctcaaaagaagacatacaagtggccaacaaacatacaaaaaaatgcacaacgttgctaatcactagagaaatgcaaattaaaaccaaaatgagataccatctcacatcaatcagaatggctattattaaaaagtcgaaaaccaacaaatgctggtgaggttgtggaaaaaagggaatgtttatacactgctagtggtaatatgagtttagccactgtggaaagcagtttggagatttctcaaagaacttaaaactgttatttgacccagcaatcccattacaggatacatatccaaaagaaaataaattcttccaccaaaaagcaatcatgtgttcatcgcagcactgttcacagcaaagccatggaatcaacctaggtgctcctcaacagtggactggatgaagaaaatgtggcacatagaaaccatggaataaaacacagccataaaaatgaatgaaatattgttctttgaggcaacatgaacgcagctggagaccattatcctaagtgaattaatgcaagaaaataaaaccaaagactgcacgttctcacttataagtgggagctaaatattgggtactcatggacgtaaagatgggaacagtagacactgaagactactagataggggaggaaggaagagagatgagggttgaaaaaccagctattgggtactatgttcagtacctgggtgatgggatcaactggacccaaaacctcagtatcatgcaatacacctaggtgacaaacctgcacaacctgcacatgtacctcctgaatctaaaataaaaattgaaaggaaagaaaaaatagaataaaccaaaatgagtctattatattaaaactgtcatctctaaacaactgacaaggaggagaaacattctaaacactccagttaatttttgccaaattaaataatattactgactgaacattggatcaggtgtcccatccacaataaatggcaaattatctttaatactttgcaactccatcattggtacaagagagaaaattgtaaggactttccctctaatatatgctgtcatcattatgtttcaatagtaaaagaaaatagtttctactaaatatagccttagctgatattagagagagctaacagcaccatagaccaatagatcaaatttaaagataaatcaagtgcttaataaatctagggtatgttaagtcatgcacacactaaatgcaaaatttcatcatttgatattttgggggatatatacgcatgcatagacacacacacacacacatacacacacacacacacacatattggcaaagaacctgatatcaccatgaaaaagtatactatcgaagcatctgttcacccaaaaagtaatattagtattaaggagtatttacaaataaaaaaattatataccttattacctaatccctagttttaagtcctcaaacattaatatagataacaaaaagtcaaattttctaaattaagtacaagtatcagtagtccaaaattcaaaagaatttctaacatgataatagttaaccattcattgggcacttatgttccagcaactatgctaagtgctttttatgaatttttttcagctaatcctcataagtctaataaacaaatatttttatccatgttttattgatgaggaaactggggcttagaaagatttttttaactgccctagaagaattagctcttaactaggttgtccccaggttttattgagtccaaaccccattcttctagccagcaccttccaccaccctccaggtttgtgatggataatctaaccattacaaaatctaactcttaacaaactagtgaaatgtatctgcctgttttgtctggactcctgtaatgctaccaaaaacaatctaaaatctggcttattccttatcctcgaaagtatatcactaagcttttgcttttatttgttaggatcttctttccttttttctcaaaatttttttttaattttaattttaagttctggggtacatgtgcaggatgttcagatttgttacatacgtcaacatgtgccatggtggtttgctgcacccatcaacctgtcacctaggtattaagcccggcacacattagctatttttcctaatgttctctctctccccaccccaccctcaacaggccccagtgtgtcttgttccccaccctgtgtccatgtgacctcacaattcagctcccgcttgtaagtgaggacatgcagtgtttggttttatgttcctgcattagttcgctgaggataatggcttccagctccatccatgtccttgcaaaggacatgatctcattcctttttatggctgcagagtattccatggtgtatatgtactacattctgttaatcaagtctatcattgatgggcaactgggttgattccatgcctttgctattgtgaatagtgctgcaataaacatacgcatgcatgtatctttgtaatagaatgtatgtttgttttaaaattcctaatgccattgactttggatttaaaatgtttaatcattctatgaattagtaacttataagatagccaaatacttagggccctctctcttattattatgtttctttcttgtcttactgtattaatgctttctatctcaaatttgttttgcacagataaaaatacatagtttttacttctcagcatcattcagaacctaaaagacaaaagaggccatactagaacaacaagctaccacaagccctaactctggttttcgaagacaacaggcacttagaaaactgcaaaactccgtttataaaaattaaatttgttatatgatcttagaacacattttctttactaactatgtgaatgacatctaggtttcatagttctaaaattttagaatttacctgagttgggagcagaaatgtgaggcagaagtttgggggtgtttttctttctttctctatactttttctggacatggagaagacattgggtacatttttcatatggaatgttagcctttggtcctctccccctcactgtctcacctaggttgctagacacacacagttacttcttttctaaatatgctctctatataggtttcctttatctcccaaaatactccattttattgtacctattcttatctcatgaactcattcatactttatattgaatgtgaatatgtgaattgataatattgtaaactcaaagtgatgtttgttaagctatgaaaaataactgtgcatggaaattcaggcagtctaacaattttaaagcaagaaatgcaagcagcatgagggaaaatctaaaatgggatcccaacatcgcaaaaacaggtctacctataaggccaatttctctgtttttccttttcttagtttctttccctcttatatttgtgaatcacagggtctctaaaacctttttaaccgatggttgttctcagagggcacagaataggcagaaataaaggtatgaacttccaggaggaatccgtctaggcaaaatagctattggtatacacaatactatctgtaagacttgtgctgatagtctgctaaaaatatacaatagaaaagagttcacaagcatgggggagagaggggagtggaggatgaaaaattacttagtgggtacaatgtgtcttattccatactaaaagctctgacttcatcctgaagcaaaatattcatgtaacaaaattacacttgtaccccaaaaatttatacaaatatggaattttaaaaaacatattgagttctaaattctgatatttggtataaaatggctgcattccatattgtgccagtgaattaaatgcctagttttaaatatttgatctctgcaataacagtcactatcctttctcactgaaaccttctctcctacttaagatgtgtcttgaatgcctcctttaaaatgtgtggtaaaaagtctgtcatgtattaacatgagaaattcaaaacccaagtatttttccctttgctaagtttttgggataaaactgctgatgggataataacattaaccccttataaattataatgacattttctgttgcttctaactgatcgtataaaattttgatgcattatttatacagttcagataagcaaaatattctcaatagttcagggaacactgctaactaatttcatggaatttttctatttggcaagggagaagtgcaggataagataaagctgtttatgtatccctctgggtttgttttcagttagcagcaagtccagatccagccgtaagagtcagctgtgactgccctgcctgctggcctccttgagattatagatgtttggcaggagatgaaagtagattctactgttgtctcttctctgaagcccaacttgaatgaagcatcagaacagtgtttaagcctggacactctaggaatgtcccaaattaatttgcatcgagtctatatctagtataatatggtcaggttgcatggattcaccaaaggccaaatctcctttctacatgacaagaggcagaaattcactctagaatcagaattggcaaggtttgctggaggttgagaaccaacgctaagtcagagggacaaatactccaagaatccaacgggctacaaagaagtttcctatcttgcttgcctatatggttacaatcaagtttttacaactattgaataataactgacggtaaagacaaattgctggtattgtcaaggaaacatccatagcaaaaataaccagaaatcatcagaaggcatgagttttgtgagaaccttgacttaatttcttctttcttagaggtttcatgatacatgtggaatcatactttgattgagatcttgtaagttcctgaatatgtttacataaaagacacatgctataataacaaacgtaggacacataagaggtaataaaagcaatatcatgtcctgaaaaacatacacaatggatatagttatggccttttcttctggtatttaaagtaatatgggatttgtggagagttgtagttggtgtcgatccaagataataatttatcatgcaataaattaagatggggagataaaatcaaaatattatttaggacctatgttgtctttgaagtttatgttgaatttgagagaaacatctatgagctagaccttaggacttgaagatcaaccacccagcttgaccaaaacaaaaacacctcctacaattaatataagcctagacatattttaaaatccatattttttttctaatttctaagtggcaacaggaaggatactatatctggaaaacagaatgcagtccattccagaagaatgaaataaaaacttttaaaatgaataacaccacatattcaaaattcaatctaatataaaaagtatatagcgcaatatcttatgaatagcagctactcaatgaatgtttattctatttaattaaaaagtaaatgcaaaactttttaataagaagcatggccattatgactataacataaaaaacagagcatataacactaagagttatgcatgtaaaaagatacagagcttactgagaagttatttgaattaatcaaagcatattttcagttacacacagtgaaaaaaattatttggataaattcaaattttggtaattaatagtacctataaggcatattggaccagatgcaaaactaaacaaaaacaaaaacaacatgaagagaaacaaacttaagttatgtgttatcttctttttaaagtcttattttaggtagaatatataaaaagagaaaaggggtattaactcccattaaatggtttcctctgtaataacattttttaggatcaactctaaataataaggctttttcctccccaaaatagattatttcttcatatatacattcacatgtgctacctaaagttctccaaaatttttacaaatctattaaaaattctaaatattcacctcagcaagaattttttgacactgattttggatctataacatcactggcaaccgatcatcacaaataatttacaagtgctccaggtgtgtccttaacagatagaaactgccaatttccatgacccacagcatgtcagaaaatattggcaagggtagtagagtctaaaaaagcaaggttttttttttttttcctgactcattgagcagctttaaacactaaaggattcatccccaatacaaaaagatttcaagtttaaatcaggagaaaatatatgaaaagtattagttttaaaggtctaacaaaatgaagctttagtaattagacatccaactgcataacataagcagcaaaaacaactggaaaggtgtttctcatcctcttgtcttgtttccttttcaccttttaatattcagatgtgtgatttttattttttctatggcttccaaacaccccagccaaatatatttttctctaaggggtaatacttcaactaagaacaattgctattttataatcacatgttttggttgagttcattccttaaaaatgcttagagcttcaaaatatcagttgctcaatacagcacacaccactctgactagtttctaaatatggattctcttctgtcttgcaagtaagcaaggaataaaagcacacatgacaaatttctaaacaaacttttaccctaagagaactgtggaagaaggtaaatcatactcattgtcttttagtcttctgagctccaaacaaaacagatggatagttctgattacattgttgatgaacatactctcatataataaatcttttttaaaactttagtttcttccacatctcacaattctgatatttaaaataaatcatattagcagtcttgctgtttcattacaatatagaaaaaattccaaaaatgcatagtttgtgattggaaacaagtttatctgccactactttttggttttgctgttgtcgttgttgtctttggtcaccacaaactcaaaataatcatttaatgctagcttagaaaataaataagcttcctataaaaactgccttgaacttatgagataaaataataataaatagactatttcagaatttgaagaaacttgttcatggtataattttcactctgatgcaaacattattttgtattagccttatttgcccactttcttgttttactaagacatgaagtatatctgccaagcagtcttagtctatatttattccatttgatttttcagaaatccaggatggcaaatgaaatgtttccctatgcaacaataatagaaaaaatatcttactaattcttctattaattttccaaatacacatcctaaaaattgtaagctctgaagagtttggggaccatacccattttggtaatacaaaacacagcaaagtgtcttgaacacagcccagtacccaacaaatgcttctgaatcaactgagaattattatatttggagaaaatgaagtataattgagaaattgtacatttttcctcataatgtacaccaaatggtacatttggtgacaaatattaaccattttctgcacctgttcaatttccttccactcaattaaatctgcttttaagagcaggtaagcctctgtaggacaccttttatagtccaacaggttaatgttaagaaattaaaatttggaatttcattttatctgtgtaaccaaatgtcatcagtttagtttagttttctcacaaactatcacaaagctgtacttatttattcaaagtggatttaattttcttaaactacaatcccaaccaaattttttttaaaaaaaagaaaataataatattattagggaatattttcatgcaaatacaaatacagctttggacagtagaggccaaaataagatcagttaataaaatgaataatttaaaggaaactttctatgtttattatcaagtgggatttcggaggaatggggtgtcttcttagaatatatgtcaaaatattttaaatgtatttgaatatagtgagctgtcatcactactgatttttttgttcctaccctggacacttttgcacccttacacttctatgaatagtgctcctttctatttgggaaactcttttccactccatgtggtcctagtgaggctgtgaatcacagtgccttcttctccctctctcccttgcccccaacagaattggtacaggaatgagctcatgactcaaccgaatcaattagagttcttatctgggaccctatacactgatgcaaagacaacacccctcactttccaatatacttgctgaggaccatgtaagcctccttttgcaattacagttcaccaccattcatctaaacaaggaatgaggcaaatagaaacataggcaaaacttactgagagagaagaccctgacaacatgattgattccttggatccagctgtacctgaggtaatttccctctctggaccacctagttacaggccagtaacattctatttttcttttccttaaactattattaactgagttcttgtcatgtgaaatcaaaagagtcttaatacagtgaaacataaatatgaggatgaaatcaaatttatatgaaatcaggggttaattatctaatgttcaaatataccataactacattagaaaaatataaaaacatttttaagaacttgcatagatttttattcattttatttatttatctaatgcacatggaatcagaggttaatttttaatgctccaatataccataactatattataaaaatataagaatattttcaaaaacttgcatagattttatttacttataattcagaaatatgaattaagcaatgactacttacccaacactagattaagcattaggtaaaaaaaaaaaaaaacaaaaacaggagttggggcaatacaatttcaaccttcataccattaatgtgaaagttattataatgaaatacctcatctacattcagcgctaatgatccttggacaaagagaagcctagaataatctgatatacagttattcttacattatagccagtcctttttaacaggagtcctgaaaattggtttccagttttgagtaagtcctaccatttttgtttctcctatgaatgtatctttacagttgctcaggcttcaggtttttcatcaaaccgtaattttacaaatagaagttttcacaactaagtggtcaacattcatagcagagtgtgctaaaatcacttaagctaaggtattatcagagtgtttattaggttccctcttctatgaaaatgatttgccttaagagaaaatgtgtttgcaatgtcttctcattccattaaaatatagtgttagacaatataaaatatagtgttagacacttttcttcttagatatttttctaagaacaaacaacaacagacattgctgagaaaaaaattccactccaaaagtgaaatgaagcttatatctccagcactatgaatgtaggtactttttgaaatttcacttttccctttagaaactatctaattcaggtttatttaaatgtcctaaatgtatggatgatcgttcccttcctatttatgcttgtatactttcccattaaaaacttagaaactctggcattaactaccatcacctaggatgtagtgttctcaattcttttggacaagggttatttataaaacatgcttcacaactgatttatttctttctgcttaatactttctgaggtattcttaaaaaaaatgtgggaataattccaaatagtgaaacatcccatggtcctgtttttacacaaggaagggcacagaacattttgatttttattctttccatattattcaccaatctgtggttttcttttatttttaatgttatcttccatagtctgcattatgaaacattgaactagaacccacagggtactcacatctcagtctgacctttactagttcaaataaaatttcattttcaaatataagtcatgcaatcaccttcccaagaacacaaaaataatttaacattccaaggatttaaagataatctgaagtggaaagtgaaaaagagaatatatatatgtgcttgtgtctgtggacaatgggaggggagaaagaaaatgaggaagcataatgacagtagggttttctagcctttccattccacctggcctctaactccctaaaggatatcccccactgggcttttgttctcaagctcaaatcaacttccccctctgccctatgccttcttccattttgtacaataaccctcttgtcccctctgtaaaaacagtttttgctctattcttagtcattcatcttagtcagggacagaatgcccaagttacttttgactcctctctctgtctcttgaaccctatagccagtgagctctcaaattctactaatattttaatgcttcccaaatttaacgttttacttccagtttcactgcccatcctaatactaacaataattaacatttgacagctaatatttgccatgtctctcggagcccagctcaacaagagtcaaagattttatacctggaggtttagccccaccctgttcctgacatgatgcttgccagaataaagaggttattaggtgcttccctcatgatccttgacctagttccattgcgaaagacagaatcccagtgccaagaataatccctaaggaactatgatgatccactgtttcttccaaaactactgagtttcttctctgaatttctaattagtactataagtcccaccacaggaattgtgtctctcctctgaatgtgcggtccagaaattctacatagcttttgtcatgggaatactgaattttgtttccaagttgttggctaggtcctgatcttacggcttgaggatttaataccagcgcacatccaaatgcttgactttgtgtgctacactatctaaaaatccttgttgtcatgactcacatcctaaatttgatcctcttacatgtcagtgccatgtccttttgtacctaagaccttgtttaagtagattgggggtcatctctctcagtggactgcccgacagaaggatcaggagccccatcattagccctgggttagtttcctgccatgcctagctttctaccaaatgatttaaagccaagcccttctaacttaggtcattctcaattgttatctcatttaatttaaaaaataaaacaacaaaatggaaatcactattcccatttgactgagggttttaaaactcagagaaattacattgccggacataccccaggtcacttggcaagacagagttggaattcacacccaggttttcctattcccaactgcattttgtctccactatgctgtgcttcctttcatcgtgtctcacaaggatgacagcaaaatacttataacacatcatcatcttccaaatcatcttgtacattattataagagtactcttcctaaacctgcatggccattatataaatcccatgctctaaattaatcttcgataatttcctacttatttatgaaatatgagcgcattctcaaaacaagtatgtgaaagtctccataatctgaatccacgctacccgtcaatgtttatcccccatacctcccatgatcctagccaaaccacattccagcctacacctcagccagtcagctcagatagttcttgaagttctgtgctctttgtttctcattaaatctatcccaattgtcagagtccagttcaaatttcacaatgaaaggcctcccataacttcgcataactaaacccatcctgtctttatgtcaccttacactataggcatattggcatttaacaccaattgcgttataagattatttcttatcccctaaggtgactcactgaaattttcctcctctaaatgtccacaatgctttgtaaatctttcaggggactaccatactccaaacctcaaataatcattcatttcaagcccctttagagagaatatgtcttattcaagtttatatccttcttctaatcataacacaatgccttaagaatagtaagggctcagtaaatgaactaatgaaagaatgagctcattgaggaaaaaaaggagaaaaagaagaaatgtttccttccagtatatacttgagataatgaattacaaaccttcatatgcaactagctaagattggaaattacatcaatattccccaaaactgttacataccatgtttgcctggatagaaatctaaaaatactaaaacaatgcattttccccaaaattaaaatagaatgcttaagtgattttctggatcaaatacattttagagaaggcattaaaattttaacgtgcaggatgttcataacaaaggcctttttcagccccttgatttttgagttgtaaaagcagaactactacagtgtttcttcttttttttaactaccatgaagaaaggctccaaaataaaactttcttaatctttgctattaagaaattaattctagacaaatgatgtcttaacaatatatgatatcttacattaaggggaccagactatcttggtcattggattttagaggggagagagaacaaacaaaacaataaaaaccatgttgtcaatttttttcaaggattaacttcataaaaattaatgcactgacaatgaggccagatttatttaaaaaacaatgagcaggaaaaaaaattatcaatttagcaaatattctgccttcatagtgccacatatctgaaagacttaaaattttttatttcttctattggcttagctttatgtaaatacattccacagtataatttcacccattagtttgataaatcataaagaatagagtatagtctcttctatctctcctagccatgtgacagaaacactatatttgttttaaagatctaatagatatttttaaaaatcagatggtactatgcaattataaagtccaattcaaatttaaggcaaaattataggttttgtatactatgagggatggagcaatctttgcccttgaaaatacatgaaagtttacattgcctttaatttctacaaagtgggcaaaaatctcaaactatcaatcacgttgataaaaatctcaaccattaatcaaaccaggtttggttgtaatggctccttctttccacctgccaactctgccagatactacgatgtttccccaaaaggtgactttcctaagaataatttactcttccctttgtgagcacatagctgaaatttaactgtattgacatgaaaactatacccatgatctccctccaaacaacactcaagagattttgttggcaaattgtggctaaaataatgcaaattttcctaatttcatgctaaatctttcaacataacttaagttaaagttcatcaagaactttaggcaagaaaggccatacttagaagttacattctagaggttccctaataaaaatagaaaaattaaatgtatccaacaaacataataaaacaatgataacgatgtcatctggaactcagctactaattccttgaaggggaaatctgtagttattacccataaaaatagagttttggaaacaatccatcatctgggtaattctgagctaaaccttttagatattaaaaaaatccaaaggaatagcccagagaggtcctttctccttcccagtataattataaaaatcattacaaatcccagagcaaaataaaattctatttaaaatacaatccactgatttgtttatttagagggtcaaattatcctcctttttacattgtcagtactgtatcctgtattttaaaacttaaatcacagttgtatcagttttatttatcctgaatccagctataaaattatttactatttttacactgcaactattccctaaaacctaaacacaacaatatatgtaaactacaaaaataattgaatctctgttccattctgcacttacatttggtttgtccactagatgtactgataagtgatgaaaccaaattatgttttctctgaaaagctccattaatttttttaaaagcctacgtgctactaaaaacaaatacaataaatctcattttgtgtttctaaacaacatgatctttaaagagaaatttaaaatcccagaaccaaatgttagaagaaactgatattttttcccctgaagattttttttcaatgctttggcttagagaatatatattattcacttccattttaggatggtgtttaccaaaatatcataaatacttaatagcaactgttcccagtgcttgtagcaaaaggcagtaaaatgaaacataaacctcagctatgaaagcccaggagttttgctttgcatttcatcactctccttccccaaaccctgtttaggatagcctagattctaatgatcactagagacagcacaactgaattccaaacagaaatattatgtgctctagtgaaactattaatcatttaaatggaaagaacaacaaatgtagtcaaatagccactagttcaagttgcctgactgatatagttaaaacagatactatatttggagaagggagtaatcacacatcaatccaaatttttattttaaatttctcctataaaacctataaaactttcaggatatcaagacagttaactccagaatcaaagggtgaaagtgtctgagacttaaaatcttaaacttgaaaccacaaacccagtctcacagagcccaacatgcaagaattaataccaaatgtcagttacaaacaaaattcacatctttagaattacactgtttgcaataccaaacaaatctcttccttaatctctttcctctagataatgaccacctgcactggatattaagattacttcttatagattaaaaaaatatacaaggttatgagcccttcctgcccccagagaaatactcacagaattaattattcctttaagagcctgaaatccacctttgacagggaaaacttgctccttggaatcagcaattctttcaagctttagaaagaagaggaagacttaattaaggagtggctgacacatacaacaatttataaacttcgttacatttcagttatgttcatctgaaaaattaccccacaggattaatttaccagcgtgatctgtgttcaaggtcaggaattaaaggtgatgatactagtgttactctaaatgtattaccacaaaatgaattgagatcagtcagagtacctttaagttggccccaagtgcaatttcaaaacagtgcagaggaaatctaacagctatcaacagcgtgactcaggagtctaagccatgctcaagcaaaaatttaaacgtaaaataacttcatgagtgaaacattttcaaatatataaaccctcaaatctcatgaaaaaaatggtcttgtaagaaaaatgatcagactttcattagatggactttcattagagtcaaattctaaataaaatagaaattctaacattataataatatgactacatattatatatataatataataacattttgtcaattgagttaagagaaatatgtgtatcatttcaagccaaatgtttaccttatattagtttaccaaaccaaacaattgagagatttaaagtttcattttcagtaacaaaacctattaaaattcttacattattaaggtagtactcaaaacctacagccatttctataaaaaatctttaacaatcgaccagtgtcacaatgtcatcagtgaaaagaatttgttaaactatccttaagacaattatgtggttcagattaaagtttgcagatctcttgtaacttacctgtgcttgttcaaaatcaaggacaccaacacaataaacactagccccaagtgacctggatatctttgcctatggagaatgaggagggaaagagagaaaaaaagagaggggagagggagaaagtgaattattcaaatatcaagctatacattccgagacacacagcgatgtacagtggggtgtagagaacagtctcagttcaatactcacctctttctctgcatatgatggcaccagaccgtccaacttgccatctgtcagagcaattatgatactggaggttttcaagcctcctgctttctgaatttgttcattcgcctgaaaatgaagaataattatccaactcacaatttaattttaacttttaaccagcatgttccatcaagctgaatttgtaagtctgacaaaatcaaaatattactggctagcttttaaaacagggtaatttgtgttaactattttatttgaaatatgcatatattcacattacagagtagttactattgggtttaaattatatagatttttagctgtggctgcttaatcttaatataaccacaagggaaatggaaaattccttaaaaggcaaaagccatcttaacttttctcatcaccatagtaaataattttttctacttgtctcaactctggaacaactaaaagcactttaaaaactttaagataaatatgtaatgaggttactgagctttgctagagggttttatttcaccacagaataagaaagcattctctcccatatttacaaatgtaaaataacttactagctttagtccttcatggatatatgtctctcctactggactaacacgttttaaatcctccaagcctttactgattttgcctctgaaaataatattaaacaaaagaaaaaatgagcaaagagcaaaggtaacaataaacacttcttaaaaaacatggcagtattgtaactaagctttcttcagtaggaagcagaggaaagaacatgggctttgaaggcagataacttcatatactttttgtaattttagtaagtatttaataacttctgtattttaactaccaaaaatagacattgatgtgctaacaatgtcttgaaaaatctttgcatattctaggccttctgagctgagaacagatatcttcaatcactcgttttcctaaaaggagtaaaatataccttcccttatccacaaaaatacaaaaattgagtagctcatcttcaatgacaaagcatttctgaaacactcactccatctctctaaaagtgggaaattttccttgttatctgcgaattgctaaagcacattatttagcccttatttacagaaattaacattttttcttactgtctcccagagtcgtaagtctcatgatttattcacttttatgacaccttctcacccatccagacattcccttgcacattcccttgaacatagtaggtacttaatacatatttcatgaatgaatgaaaaaataggtggatggatagatagatggatgaatgtatggatagatggatgaattagaaggtaatgaatccttggaagagacactatgaatgaaagcaattaaaaactatagaataatttctttcatcatgactaattcactatcccaactgaatttgtctaaatggggtatgactacaatattattaagagctattttatgtgtatcagttaagggaagtcccaatttttagagtttttaaaatatagatttgaaacctctcgaaaataaataaaaccaattatcttaaaagataagtaaaataatgtggcaaaattatccaaattaaattcaaaacttgttttataataaatttaaaagataagaagatatcttaagatattgttttcagactttttcaatagaagcaaaaaaaatgcctttttaaactggtgagaatggatactacacttgatcttaaccaaaaggctgagaagtgataagaagtgcctttttaaatgtaaaattcttgaaatgataaactgaattagaaaattgtaaataacacatgaagagtactcactcctactgaggatgatagatgaaggagattaattgtaagaagtatcatcttaacatcaaggaacttactggggccatacacaacatttatataggtacatgtgtgtatacgtttatatcacatgcggttataaaatatgtcaaaaataatttcaaaacattttgtcatgctgcaatattgtgtttcaaataattgaaataaataatccattcaccagagccttatatacgttttaaaagtaacttcttgattgtatttttatatcgcaataaaaaatattatcaggcaagttttccatctcataaagtttccaggtaacagaagacaatgttcaaggtatgaccctaatccttctctttcctggttcactcatctctattaactcttgctaattgtctttttaaatatttggtttaaagtctacctattctgaaccattctttaagttcattacactcttattctgagtcaccccaagctttctagtcatactcatattcatgttttaccataataaaaaaaagttctctcctaaaaacattcaactttctaataatttaactaatttaatttaaatattcacttttcaactacactgaaagtttacattaggctattaccatgtcttttatttatgctgtattcccctgctctgtacttattataatgtcatttgcaaagtaagtgttcaataaatttttcaatatatcataaaaaaattataattccaaggatgatagcataagttatgtaattcataagcttgttgtatctaaaatatttacgtttgatagctacagaaacaacttgaaactgattgtgtctgaatgcagataaaagtcaaatatttggtgcttttcagaaatgagtggcagtgtgtctttgagcattagtgtttgctgccaacaagtgaaatgcaagtttacacaaacagattttgcataagacagccttctccattcagttcaaatcagctcaccattgctgctgagtcccagacaacaccagcacaagactttaagctaaaggaacttcccaaacgtggattcaaggtttttttttgtacagtcaggtatctgctagcttattacactggaagagagacagcagtttgcggtttttctatctgtacctatacctgcaccataagattccaagctccactcaatcccatcattacttttgcagctgcatgatcctaagaggaaagtgctccttttccatagccaagaaaaacacatgtgagtcctggccttgtactcccttcagggtaactacctgaagtctgtcagcctcttatcaatcaacaaggtatcactttaggggaaacaaaggccaaaacaagacagggcagacagatctcagacccttgaagaatcccaagcaactgaaaataaatattaagtttttcaattggtaaacagttaacggtgaaaaagcaaaataatgtggtaggttaaaaacagaaatcattcatccccactgtaatgttaaaaaaaaaagcctctaaatgaaagcgaaaatgactaaaattttaagaacaagaagaaagaaaggttatgttataaagataagttcaactccttgaattcaacatcttagaagatcagcttcactgagtttggctttcaagttatgtcttcaactacagggaacagcaatattgaaactactttgtatttgttgtgaagcagttgtcaaggatgctgctgtcatgacacgcatcgtcccctataacatttcaaagcagaagtttctttgtcacccccaagtagttgctatgtacttcctcttttctgcacttgacaaccatgcaaacttatttcttgtcctgactactggggaagcccacagtaaatttcttactcattcacaaaattctgttaagttcatgtggttatcatagtgtttcatccccttttccaaaattttagcactcttctttttatattttattaattttctgcaacactattaatttctatgcagcctcaaatacttttttgaaagagacaggaattgaacaaacaaaatgttatattaaagccctggttttctttaattgagaattgggggaccaaattccattatcaactggagggaaaaagagaaagagaggaggcacacaaacaccatatatatatatatggtgttttcctcgctttcatttagaggcttcatatatattggagacagagtttcactctgtcacccaggctggagtgcactggcacaatcatagctcactgcaacttcaaacccctggactcatgcaaccctcccacctcagtctcccaagtagctgagactacaggcatataccattataccaggctacttttaaattttctatagagatgtggtctcactatactgctcaggatggtcttgaactcctggcctcaggcaagcctctcatcttgactttacaaagtgctggaattacagacttcagccactatgcccaggcttggctaattttttaatgtatgaaattagcactttcagctctatttgtatctccctaatttctttgctgagaagggcagggaagggaaggagaggggagaagaggagaggagtgaggaagggaagggaaaatagccaccacaactgccatgcactgtgccatatcagtagcttttctctgaaacactttggatgtggaaggtatgcaaggcattataactaaaataaagatagactgaaatcatggtgtcataaaacagtctgcagggaatcctgaattgaccaactaacaatgaaggcataattttattttcagtatctcctactttttctttctacgatgtgtctgtacagtacttgaactttccaatgcacattgtcttaactttccagatttcaaagctctttcaggatttcagtcaatgagtctacactcatctgttgagcatctgttgtatgtgaacaccgtgattctacacagtgatgtgagaattcctcacactcagtccaggggtcactcacataaagctctatatatgcactgtggttctccaccctggctgtacactggaatcatttgaggggattttcaaaagctcttctggactctatttgaagagattctaattcacatgtttgtgttgggtcagggttatcactggcctttgaaaactccccagagtattctaatgcgctgccaggattaagaacctctgatctaacctaattttaaaactttcttgtgttattggaatgcgttttgaattacctattttgccagtcattgcttctgtatgagagttttgggtaaataggataatctcttaaaccataaatagtttctgggatggtatggatgaagatgtgcatgagcttatagacagaatagagattagttccaagctcaaccttgtttcttcatttataaaataggaatataaatatctcccccatggggccactgtaaggattcattacagtatattattataaatgtcctattttgttattagttatggttgttaatctcttactgtgcctaaattataaattaagttttatcataggtatgtatgtatagaaaaaaatagtatatatagggtttggcactacctgttgtttcagtcatcaactggggttcttggaacagatctccttcagataaggggagtctagtgtaccccaaaattagtggttatcagcaaaattgattgtttctcatggcactgtgcattgaatgagcagttctcatgcttcacatgctgccagttgagccactggaatggctagaagcggaatgccttcacatggttagcaagtcggtgccagcgctgatactggctgttgcctaggagttcagctaagactgttaaccagagtctcgattctcctccacatggctaggttgggcttcttcctagcatggtggtctcagagtagtcaaagttttcatatgacagatggtttccaagaaaacaatagaggaaactaccatgccttaataaatcttaggcctggaactcaaactggcagtttcatgttcatgtctgctgcattctattgactgaagtaaataaatcgtaggcctagacccagattttaaaaagtaaaaagtgtgtgtgtgcctctgtgtgtgtgtgtgtgtgtgtgtgtattctatgcttcattggaagccaccaaagaaataatctaccactaaaacaaaaagcctcacacactcatgttgtcaaatgccaatttatataattgcaggaatactataggtatttatatcataagtaaattattttctttactctcaatagattattagccacagacttaatctgcttgaaataaacagtaattccaaaacaaaatgtagcaatacataaggattttatgataattagccaattacacagcatcctgaaatgtttcttttagggtaaaatttaatagattgagtagaatatgaaacgaaaatgttctcaagatgttatttatgactatacaaaattgctaatgatttataattcacttagaattcacttagaattgtactttacctgagctattgcatatgaagaatttagtaaaatatgtaatatatagtaactgctcagtaaactttgatacttttattgtctccttccattaataaaccacaaaattaacctgagtaagaaaaatagaaaaaaactgtatgaagagaaatatgttcattcatatatacctgctctacttaactgtgttactatatactactgccctacatactgcttaacggatgaacctctaacaagtaatttgttctcaccaagttcctcaatttaaaaattgtttaaaggtttcaaatgagtgaaagattttttctaaagacacacattgctattgctaatacattctaaaatcttgggaactaatgggttttagctgtatcttactatagtctatgtaaaatatgcttattgtttatttaacatgtcattctaatgccaacataggccaaggcttctgtggtccagagtccagaccagcaaatccaaggtagcagtcatagatccagaaatatctgctcacaaaataccctgtacaatctgaattttgtcaaaaatattctccaatttggcctgcacctaccaaaatgtggtactcaattcacacctgaagttcaggcctgctgcgttttgcatacttttactccattttcccactcactgccttactaaatcatgaaaaatcaacccctgcattttaccacttccgtgtgccaggtctgtctcccaggcatgagtaacaatgtacttaattttctagaacatgctcataaaacagatgtgggacttcagcgaaagtgactgctaacatgtccatcactaaaatctgagttgctgccctgcctggacccctcaggtttagcacaatgtgtggccaaaacagacttttcaaaacaggagtaaatacttgcctaatggaattttttttagctaacccaactattgtctcatcttttcaccccctcactggtttttaagaatagaataaatttagggaatgacgatgtttttgagttgtgactaattctgactgattgaaaactggagaaggagaacccagagagtgtgaatacagtgcggtggtgaagtgctcatgcacagcatcaggcctgggtgtgaaccctggctctagctgcttagctgtgtcactttgagcatagtcctttgatttctttaaacatctgctcgaatcctgatacatcatgatgaaaataaggatggtgtccactgataactgccaaaccccatgttagccttggcctccttcctatgcaatcatcaaagcaacagcaagaaaagaaaaatgaaaaaaaatgaaaaactataaatgagaaaaaattaaaaggtagttagttgcaggtaggcgatagaagcaaagaaataaaagtgaattgataaagttataaatacccattgtgttctctttatgtgtagaaccttagttagtccttctcacacattatacttttctcaagattgctgtatggtaggaataattcactcttattaactggcccaggaattgggcagcaagagggtgagtaatttgttagaagtcacacagctagtatgtagctcctatgcctattccacccaaggtccaattctggtcctttcattaacaaaaaacctcaggactctccatagtaatggttgaatatgctctattcctgaatgcttcttgtttccaacctctgaattccattttgattccaagatagtaacattaatttcagcatttttttttataaacaatacattcttgttgaaataaaatcaaaccacatatatatatataaattaaaattgtgaaggttttttccaccttcaatatcatgcctaagacagtgtcattgttaacaatttgttgtatgttctctagacttcttttcttgcattttcaatcacatacacccccctcaccatataaacagttagggattttgttttctttttattttataaaaataaaatcatactaagagtgtctgctacttgcttttaaacttagtatatctcttatatgttctcttgtaaatatgtacagactttcctatttcttaataactgcatagtattccatccaatgtatatgttctaatttaattatagtatcatcaattgataagcatttagattgaatacagtttttcaccattatgtacaatgttgcagtatccaattttgtatttagacctacctttccatgctaatgctagtatttcagtaggacatagtcccaaaaagtagacttactgaaaggaaccttctagacttttatagatactaccaagcttcctctaaaatgaatgtaccaattaataagttacttactgtatataaagaacaattgttccacaagtaaatttttaattcagcttttaagaaattagaaaaaaaaattcaaataatagaaatgtgtatattgtccaaaattaattaagtgacttttctataatttcctacaagtttgcctacggaagatttttttccccaagtaattgattattgtgctcaggtcaaacaattataagacattttcaggctgggggcaagtgtaatgaaagggagtcataaatatttataactgatttgtaagagtaggaataagaaaaatagcaaatataagattatttattatgtggtataatcacaaaaaaagacaatctatgatggcagctaataactaaggttctgaagtcatatcagctcaatcactcattcaacaaatatttattgagcatctactgagcatcaggctctgttctaggtgttgggatacatgggggagcaagacaaatgaggactcctgctttcatgtttacattagagtcatcaagataaaaataaattaaccaacagaaccacttgaaaatgtgataaccaaatatagtattgtaagagattactggggaggagaggtggggttcctttagacctgctggccaggcaaggcttctcagaagatgtggcatgtaagatgaaacctaaatgaggagaacgagccagctaggggcagatctgcagcaaagaaagagcaaaggtcctaatgtggaaacaagctcagtctgttcagggaatggaaagaagaccacttgagctagactgtgccacatgatgttgcaggagaggactggctggggcactaggatggggcgtttaggcctttgggaaacactggctttccagtctaagtgatgaaattgttttaagcatgagagtggaatatcggctttaactttaaaagattattgtagccaatatactgcttgcaacttgttaactgtgtgtgcttggacaagccgctttatcattgtcagttttgatttcttcatttgtaaagtcgaggtaataacagtatctattacaggaagttcatatgaggattaagtgaagcaatgcatggaaagtattttgcacactgcctggtgcataataattgttcaataaatgttttcaactaaatctctgttacagtattagcataatatttaacagaactgagcttaattcactatccccaattatgcaaaataataactaaaaatactttttaattagtcttgattccaaattctctactgttgaaaggctgggtatttccatactgaatcaacacttggcatttttctcttacctaaccctataatacatccctgggctatttatgtgcatgtgtatacctctactcacacacacactagattacttatctttgtgttaccccaggttccacagtactcaatgcattgaatataagataagcaagtctttaggtaggtgggtgggtaggtggaggaatggactaacagacatatggagggtaaaaatcatgagagcaagagaaaagaaggcagtgtttcaaattaaagtatttaaaagaataaggtttttaagttacgagtatataaaatgcataacatcattttttggcatgtttattactttattcatgcatttacatagtaccggatgccatgctgaaagcataacagaagacacagccctacggtaagtatttactaccttctaatcttgcctcatctctactaagaatcttcagcaacactctgagaaacatgaaagagctacttatttaccaagattgtgaagaattatgagtgctagaaacaaaattgtgaaacctgcagtgcttaacctttggttttctttgcttaacctttgctttcctcacacactctgatctatttgtgattgtaatatataacatcaagattttaatagtttatatgcagaattccaatttctaggctttgaaacaaagattcacaatagttgtggaatcatttgtttactgatctgcatataatatgcaaattgtttcttcacacttaaaagtgtgtaatggaggaaaagtgaccctatatccaaatatagaggaccacagaaacttgagaagttactgatttaattaaataaaattagtaaaatagcaatatagaacaagaaaataatgtcctttattggaggttgtcctatgctatacaaaggaactttatatacattatcttattttgatcttcacaaaaactcaaatatggaagattttatgtcctgcaccttatggacataaaactgatacactgttatacaatttgccccaagtttccaaatcagtcagtgacaaaactggaactctagcctaggcattctcagtgttattttctgccaccccaaactaattaaaaatgccacaaatagtgaaatttattaaaacttaaagtgtttatatttaggaagagacagaggaaccaactatgtataaaacaagttgcaagtagtgttattaaaattccttttggaatattataaatccttttaagaagggcaatattttctttatgtaagcatgattcttctctgatcattaaaatactgtatactgcctagctccagatgataataatagtgataaagcctttatctcttgaaaacttatataccagactctgttctaaatacttcacattcatcaactttcattcatgtaacaattttatggggtaggtattactatcatcatcatcatcattgccgtcattatatagatgaaaaaagaagaagcataaagaggttaagcaacttatccttgaccatttggctagtaaattggaaagccaggatttacacgcaggtagatttggtctagtgactcttagctgcaacattatgctgcctctttaaagaaaggcctcttctggtgaggtgcagtggctcacgcctgtaatcctagcactttgggaggccgaggcggacggatcacgaggtcaggagatcaggagatcgagaccatcccggctaacacggtgaaaccccgtctctactaaaaaatacaaaaaattagccgggcgtggtggtgggtgcctgtagtctcagctacgcgggaggctgaggcaggagaatggtgtgaacctgggaggtggagcttgcagtgagccaagatcatgccattgcactccagcctgggcaacagaacgagactctgtctcacaaaaaaaaaaaagaaagaaagaaaggcctcttctgtaacctatctcagtgtctcccctattagattcaaccaatgatgaaagaagaatcactaacgtgggttaaagatttaaaccccttccatgcgtatctaagcaataccaatctggtcacccagtgacctacacttcatcttcaaagtgctgaggaaccatatgcaaagtgtctagcaaagaacctggcacaatgtttgcagctatcaatgactgagagtttctacaagcctggcatgatgctaagtgtttttctatatataggaatgccataaatgttaaaatggttcttttttttctggattggctagatacaaggctgtttctttggaaattaagctgggcaatggagaaaatttattttcataaaggcgagaactgttaaatcactgagcatagaaagctgccatacacgggttgtggactaccatggctctggctcctgatgagattcattctcatccacacaagaaagtaaggagggccattatcctcagcaaactaacacaggaacagaaaacccaacactgcatgttcttgtaagtggaagctgaacaatgagaacacatgaacacagggaggggaacaacgcacactggggcctgtgaggggtgcaggggagaaagagcatcaggatagatagctaatgcatgtgatgggttgatagatgcagcaaactaccacggcacacgtttacctatgtaacaaacctgcatgccctgcacatgtatcccagaacttaaaattaaaattaaattaaatttaaaaagaagaaagaaaggagaagtatcaatgggaagacaagatcctaggctgcactcagcatctgcagggagattttcctctctaggaaaaggaaaactaaaagcacaaagattaaaatcttatacggataattttctaaatcaattaagtgaattataaataagttctctcccccagttcctttagatattatgatttcttgaccttttcaagggaaaacttaatttacaaaaaactgtttttacagttaacttttcagaaattcacatatcatgcaaaacaaagtacaccagcttcccttgctgaaactacagttcagaaaaattttatttcaaaataacaggaaaccactcattcattcattcaacaagaatttattgaccaaaaactggcttacatactctgttaaataaagtagacataaaaatgaagaataaaagctccctcccactatggatcccattctttaaaacatgtcagtgaggtggggtgtggtggctcacacctataatcccagaactttgggaggtcaaggcaggcagatctcttgaggtcaggagttcaagatcaacctggccaatacagtgaaacccccgtctctactaaaaaaatacaaaaattggccaggtgtggtggcatgtgcctataatcccagctactcgggaggctgaagcatgagaattgcttgaacctgggaggtgggggctgcagtgagccaagatagcaccactgcactccagcctgggcaacagagagagactctgtctcaaaaaataaaaataacataaaatatatcaatgactatttctaacttgtcattgacactgtttgaatgacacagaaatggtcatatgaaatactgtgacattggtctgaaaaagacaccttttaaaaaacactaaggagattaaatagataggtagatagatatagagatatattggtatacatattgatatatactaagttcccttataaaggtgaatatattcagcattaatggacctcagagaaagaccagaaatccaggatgtctactgaatctaggaaattatccaaaaggatccatatctttctccccctcaatgttcttcaaattcctggttgattaatatattatatctaaacaagaaaaatgtagaactacttacagtaacagagaggccggggaaggtaggaagtggtgaatatacaactaagacagggatctagatttcactgcacattccacagccactataaatgatattgattttcagattaactgctcttttatattactcatacctcctttcccttctattagagaactgaattgtctgtgcatctgcttgattccactgagaggcctgaatcaccacttggaaatatcaatcatgcctttaaaattcatctctactaaaagcctgcagtgaaatgataatgcactaacctgtctccagttaatggcaaaataatagttgcttgagaagaaaacacaatgaaagataatctcatttcagggctgcaaaataagaaaagaggcagttaaaacatttttaaaaagaaatattgatacgatacagatgtatagttagggaggttcatttaaaattggtctcactgaatggtccaggcttcttttaaatgacattccctaagtaaatagacgaactctgcttaacattgttgcataagtcattttggatttagtcaacgcttcccagcactcacatactcctccatgacccataaggacttgcatttagagagagactaactggaaagataaattctaagctgatgtaaaattctttcgtagaaaattcctcttcccttggttttctacaacatttcctttaaaggtggccaggcccttcaaagtgattatggttatcaacacttatgggtggagagtacccagtttgacttaatgaccataactatgatatgagtctataaaaaagtcatcctgaagtaagactacttaaagagtcatggaaaatgtgaaagaaacaataaatcactttctgcttaggcattttttattttctaagtctcaaacatgctattttccattggcaacaagtgccccagtcagctatatctttcaagttttaggcatgtctctcacagaacggttcttgcttctcggacactctctgcaactactactaagattcaaaactgaagatatgaaactagaatctataaactgaaaatcagaatcctctcaaaggcttatacatattttaaaagtcagtctcttcattagtcaccccttattcacttcctacaatgtattgttagtaattgagcaactaggcttgagccagacaactgtgtattatagaattccaacttaaaaaccagatcaatgagttaagataagagcttgcttctttaaaatgttgtagtgatgtgattcattgcttttgatcaaaatctacatgacacccttttcacattgaaggattaaattagaaaatttataaacaactgtctgttctgcctttgacatttagggacataggatcttgtttgtttttctttcctagacagttttacctcagaccctgtccagaaatgagtgttaaacttggcttcttaagcaagggactgatgattgaacatggacaggcatacatttttatagggataactttactgctgccaataactgaaagcaaggattgcctaggcctctacagattgtttgaagttacttgcaacatgactttcaaaatgttttgatcatccaagcctgttttacagaaaacatttgggctaacaagactgaaagaagcaatatttaatgatacagttcctattcatgtcctttccattatcttgataaacttgtgtttgctcattgcattttttctttaaaaaaaaaagaaggaaaaaaaaagcctcaaaagcctagtgtcctgaggttatttttaaataggagatgccactaattcctagttacctctaaataagagagtaagctggatttcataccagtaatgctttttataggagaggaaaccagtctttcctggtgatgcttattgcatatatagaacagttaaattttaaaccaaccacacacccacacattgtgtaaacacaagtcgttgctttaaacacacacacaagtgccttttctggtagcgggttattaacacatgttcatttgaagttttccaacactttttgtttgttttaatgagggcctctataatgctaagaaatgtgtggaaagaaaaatatattatggatactattcgcataaaatttatttttttaatgtgataaattatgagaaagcataactgaaattcaaaacagatgaaaattcggaaagaaaaagacatttggaatagtatttgaagatgcttccccagagtctgagccaagtttctgggatccagatgaaataagccctcaaggactgaagggctgtcctaataacagcatgtgtgcaatacgaccttgaggcacttaaaagtaacatttcaggaaaagtttttcctataaaaggtttcagaaaagggaaattctacactttgctctacttctccactgcctagaaaagtaaagtaagaaagatacctcacaaatctctccgcaagttgctgtacgaaattataaatttcaatccagttatttgccacactcccagacctgaaagatgaaattgaactgatcagagaaacaaaacacggaactgaaaagtaaacattttgaaatggttccttcttcaatgccacgaacataggggcacctggcctctttttcaagctaagtaagggtatctgtagctgaaactttggtggtacccagagttaaagaagtcagtcccagagcaagactccgtcaaaaaaaaaaagaagaagaagaagtcagcccgttttctggggtgggtaaatacctgcctaattgtttagagtggaacccagctcttcagagtaaacacaaaagcctttcttcgcaggaaatgcaaaccacattgggcatgttaaccctaggcttttcctggctccaatgaaagcgctatgattaggataaaaccaggcaaactttagcctgcgtacgagcagggtcgaggaggtgggtaaggactctgtggccgatggagcgtggcccgcaagaggccacactcccatttcccaagaggccaaaagactggcaaacagtgaataccccaactccccaaagagccaagtagcccggggctccaatcactacccccgacccggctgatctccgcccacacagatccgaacgcgcttgccctttgaaagaagacagcaacagggcacccctccgcgggtttccaacaccactccccggggtgcgcacacgcatctcagcctcagccccagctgatccagtgccgccctcaccaggagaccctggacctccctcgcacactcacttgtccaggacgaagtagagatcaaaggctcttctgcaggagggctgctcctgggcgcgcagcagccccccgggaccgctgagcaccaacagccacagcccggggaacagccagctcccggggctgcgggccggggaccgctccgccaccatcctgcggccgggggcctgagactccctcccgctcgcagtcccctaagctcaggagggtcgcaaaggtggcgggagtcacccggcacgcactctggggtggggggcggcgagcagctgagacgccggcgcctgcggcagcgggacccaccagctgacagggagggagagagggaggtcctgagaggacaaagggagtctccgccaccgccgcagctgccgccggaactcttgacgaatcccagtggaagcgcgatccagtcctccccctcccgattccggagagttcctgcagacaatgcgggcccacggcgacagctcgcgaaaggagttcctctccggcctggggccgagcctccagcgcccgcctcggacccggacctggaacccaccccgcctggagggctgaagtcccccccgctgccgtgcgcttcgggacaaggggtccctgggacgcggcgacggcagaacaaactaggagtggagactcttctcctccggcggccccaactccctccgcactccgaaactttcctcccggtgctggactctggcactgcgctgacaggccgtcccctttaggggaggaggctagctggccctgggactcccggctggagagaagccacgccgagggcaggagcccgctcgggccgggtctgggctgcgtgtgtcagtgtgcgcctggggacgagggcggggccccagctgaagcctccgagccacacatgcacacttgtgggttcctgccgagttgaagatgact
